United States Patent 8,067,671 (METHODS FOR GENETIC CONTROL OF PLANT PEST INFESTATION AND COMPOSITIONS THEREOF) - sequence listing, part 34

SEQ ID NO: 59829 - DNA, 1626 bp, Heterodera glycines
  Genomic contig location: Contig_ID=SeqID_725; Location=1210..2835; Strand=-
  SCN-specific regions: Sequence locations=1-609,643-654,676-1586,1609 -1626
atggaaaatgagatggcagcggcttcatcctcagcagcaaatgccaccaacactaatgatcagctgaaaagcaatgaaacaaaaggaaacgaaagccaaacaaagagaaatgtgatggcaccgttggcactgaccggcggcactccgagcggtggcggcggaaaatgcgcgtgcatttcgagactgttgcagcaaatttgtgcactgataaagcaccgaccgaatgcattgggtgccgttttaaaatgccatttccatttgattgtttttgtcttttacagatgatgatttgccctccgttagtgtcgtcggtccgtttgagcagcgttggtccacgctgttccgcgagttcgttctcgacccggccaattgttcatgggaaaaatgtgtggcgcacagcgacgacatgctttggtatgtgccgattgtgcgaatggccaacggcggtgcttgtgccgtcggctcggaggtgggcaaaagacagtttttatagactttttttagttttttcttgctgaataaatcgagaatgagcctttgtttaaataattcatgtttaacttactgaaaaaacagttaattgtcttcctgtaatgaacttaaagtaaatttttggggtttgggaggaggagtgttcggtgataccaataggcaggccggggaaaatttttgggatcatatgtattgagtatgaaaaagacttttcctcgtacttacttgttgagtatcttcgatccatttcattgtcagatcagtcatttgcaagtgttccgtcgacagagcaaaaacaaaccgatgcccggagaccaaaatgtgaattggcaggagaccgtttgtctaaatttgatccttcagcaggtgcttcttccccaaattcgtaattttcaatttttacatttatttagttggattattttgtcactgttgcggtgtgtacaaaaaattcgccgacaaatttgcaaatccatcgcaaaacttgtcaagtttgtcgcaactttgcacataagccgtttctcttttcaaatgctcccattttcagagggtttacccttcgccgagtcgtcgtcgaatggacgcaaaaggcgaatgtgaggaggtcacttacccgaagatttttttccccatcgacagttttgacgaggtattttgccgaataaaaaggccaagcaaacagccacaaaataaaaaatgggagaaaattggcgggtttaaaaaaaccgtatgattatatttacgtttttttcatttttgacagtaaagtaaaatttggtagcctacaaattcgacagatggcgtgcgattttaaaacttttttcgtttcggggtacacgccccctggctaataagatttttggagtgtgaccaacaaccgccgcttccaaggtgttcaccgacatggtcgtgtccgagggcgaatgcgtctgcgttgagttggtcgtccgggaccgttaccgaaacgcagaggccgtcattttccttggctccattcgtttcgatgtgctcaaaaagctctatgattcgcgggtattttttttatttgttagtgtaattttttcatttttttacagcaaacttcctcttccggcgcttggaattgggcccaacgctttatcggctcgtcaatga

SEQ ID NO: 59830 - DNA, 1346 bp, Heterodera glycines
  Genomic contig location: Contig_ID=SeqID_5959; Location=215..1560; Strand=+
  SCN-specific regions: Sequence locations=1-566,588-948,970-1109,1131 -1346
atgaaaatcagtgccttttatttgcatggaatcgaactcgatggacaaaaaagctatggacagaatggcacagagcagaacaaagtggcggagaagaacagccaaccgacgctgaagcagtacagccgggtaaaggaaggacgacacttcggtgtcttcaatctctctcacttttcagctcgtctccgatttgctgttcaatgtgccgttgtttcggatggcccgactccgtcgccgctgtgccgtgcccacctttctgtactttaacgactatttcaataagtgccaattcgagccgtggactccgttccgaggcgcaactcatggtgatgccacccggcacacttcccttttcacaatgtcgcctctttgtcaggcaatgagtacccctacctcaacggtctcttccccgtgggcgaattccaattcaccgaggcggaccgacaacaccgtgccactttggtccaaatgttgtcctctttcattcgcaatgggtgcgtcaaaaggggaaacgtttttcatcaatggcaatctttgggggtttttatttaaccgaaactgctaagcatatcaaatcctttatatccattgccattcaacagaatgccgagcctatcactccctggcgactactttttgtggccatcaaacgaacgaagcgatgaaggaaaagagaaagcgctgcaatttgtgcggattggaaatggaacggcggaaattgcctttgcggatgccgtggaacaaagcggcacattttgggaggaattcagtcgcgaatttggtttcgatttaatactgggaattacgtacgaatgtgacgaggaaacaaaggaataacgaaatgaaaagatttccactttgatgcttaaattgtttaaaaagctttaaaattgtaggcaaaagaggtagtgatacaaattcgttctttcaataaaatttaaacatatgatttttatcaaaaattttagttgcgcaaaaagagtagggaatccataatgatgtctggatgcattgcataagacagaattaacgccacaaaatttatttcataataaatcatcatcaaacaatatgtcggattaaaagaagaaaagcgatcaattgaccaatcaaaaggaagcaattataatttatttctgataaaagcaggacaaatattcggaaaacaacgaacattaatagtttacggggaaatgtttgatgatgatcagagtcgacgatggtttgtatttgcagacgacaaactgaaaaagacgggcattcccaacccaaactcaccactcatgttcaaatccttggaaaaaccgaccaacaaaagggcagccagaacaaaccaaaaactgtga

SEQ ID NO: 59831 - DNA, 1649 bp, Heterodera glycines
  misc_feature (301)..(301): n is a, c, g, or t
  misc_feature (308)..(308): n is a, c, g, or t
  Genomic contig location: Contig_ID=SeqID_5959; Location=1601..3249; Strand=-
  SCN-specific regions: Sequence locations=1-566,588-1366,1388 -1460,1603-1649
  Gene Ontology: Mol. function=protein kinase activity; Cellular component=cytoplasm; Biological process=cell adhesion
atggctgttgacgtaaattcggctctgaccaaggcttacgacgagttaaggagcattgacatgaacatatcaatgctttccggagtttcagaaaggtaaaaaacacttcgctagtttttttcatattatggcttttaagatttaaccggaaaagaagcgcaccaacaaatgattctttctctactccctttgatcggtaagaagggacatcaaaagacacttacctagtattgatattttcaggcgtgtgcaggagggtgggccgaaaaatattttatcggccggaagcaggtttaattanacagtanaaatttttggatgactagttaagcgaaaacaattacggtgtagcgaagtggcaattttcttaagaaatcatgcttttatgtgcataatatcgactttcagcgatcgcaatgcgaagcgtgggcgttacgccgcggacgagggtccgcctggtgattattccccgccctcttcagcgcgtactcaccgcactttgcaatctagtgtcgtgatgcccaccattgagaccaaatcgcgtacggcggtaatcaacgagatgaagaagaacgagaacaaagaagaccaagtgcggtgagttgctggaaatgtgccaaagattttttgacacaatgctttaaaagtgttcgcaaacgcccttattgtttagaaaccgacgtcttttcggtaatcttttggttgccacgttgcgtaaatttcaaaacgaggaaaagacggttgggagcaaaggacaagtgcaggtttaatgggaagagttgtatttgcatcaaaaagaaaataacgcacagattgacaagcaacgcgaagttgagcgtcgtttagaggagacggagaaggaaaacagaaaccgaatgatgcgggagagagaggcactgatggcgaagaagcgcgagaaggaaatggaaattcaatccctccggcgtcaaaaggccattgagcaatcggtgggttggaaagatcgtttttgagtgaggaattaaccaaattttgcctctctaaggccgaagagaaaacgaaacatttccgtcgccttcagtgcttcatccaaactcagactaagcccccgctgttcttcctcccctccaaacacacactccgaactttggaactcctcaaagagtcatcaaagaaaattgaaagtgagttttagggatttgaatatttattgtattggctgaacactttcttctgttattccattgtcttgtctctgtctctgtttagcactcattgagttacgacgtgatgaaatgactcgcgaattgcgtcggctcgacacgtacaccaccgccagctttggcgggacaattggtcaggctaagaataatgtggcggatgagtcggacgaccaagacgaggaggagacaaatgttcgcggcggactgaagtcggcgattgtggtgaaaatggaaggaatgactggcgaaacagttgctgaagcggaagaggagaaaagggacgaggaggagggcgaagaagaaacgggacagaaagacggagagggggaggatgaagcagagcccaaagatggagaggagggggaagaagagacggggcccaaagagggcgaggaacaggccgaacagcaacaaaatggccgagcagactcagaagggccggactaa

SEQ ID NO: 59832 - DNA, 1178 bp, Heterodera glycines
  Genomic contig location: Contig_ID=SeqID_5959; Location=6541..7718; Strand=-
  SCN-specific regions: Sequence locations=1-215,237-250,272-349,371 -488,510-573,595-985,1007-1142,1164-1178
  Gene Ontology: Cellular component=mitochondrion
tgccttcggttggtctccgccacactttgcccatttgcctctgatcactttggacggcaaacgcaaattgtccaaacgctttgaagctggttacgcggttggtcctttaaagaaaatagttcaaacagtttcggtctcaggatttttacctgaaaaatgggcatttacccattgctgttttgaactttctcttgcgcaacggaagcggaatcagagaccatcagccacaaacagtttactcatgtgtgaagatagcattttaatttttggaattgaaattaatttattacagtggaagaattgatcgaacgattcgatgagcgattgatcactcgagggagtttcacggtttgagaattgtatttatttgtcgtaatttattcggtttttcagatggacacaaacgaactgaacaattacggaaagctgggcatgtttttatagtaaaagaaaccaaacgagagaaatggaaaatgttttcagcgtttaacagaccaatgacaaggaccttttgccggtgatcaagtcggtattcgacaatttgccaaatgtgtgtattcaacttgatttttgaccattatttttattattaaacatttaccaggaacttcgttgctccatcgaccattctttgctttccgagtcttatctttgtcgtgttctcacctttctcaagttgaaagaagaagcattttgtcatttgggcgaattatcaaccggcgattttcgtttcttcttttatcggcctcgaagtgctcaaaaactgctcgaagtcgtcgtgaaaggggaggcggatcgtgaacaatgcgtcagattggttcgtatttatattggaggagtatatgattttcactatttaccaaattagttttcattttgttttttgcgtgattatttagattacggcactttgccaatggttcctttcgtcggacactgcgcacacttttgacaatttcaaattgttggccacagatttggctatcccttatcagctgctggcaaaaatattccgtctgtcaatgattgacaatgtgcggggtcctccaatcaaagaactgattgaattcttcggcgttgcggaatgctacgctcggctgaacgcaatgggtcaaatgttcgaagacggagcgaaagatgaagaaacggcaccaaagacgacagttacttccctttga

SEQ ID NO: 59833 - DNA, 1011 bp, Heterodera glycines
  Genomic contig location: Contig_ID=SeqID_29322; Location=1..1011; Strand=-
  SCN-specific regions: Sequence locations=1-42,64-424,453-753,775 -969,991-1011
  Gene Ontology: Mol. function=gamma-glutamyl transferase activity; Cellular component=integral to plasma membrane; Biological process =spermatogenesis
gtctttgtagcgaaatcggaaggttcggagaaatttccttgttttaatttttgcttcatttaagggatgttttgctggagggcggaaattctgttgattcgatgatcggttggcattggcactcttccccccccttttccccattcccaatgtgccatttcagccagtttgctgtgcattggcgtcgtcaatccgcagtcgtcgggcctcggcggtggcttcataatgacattgtacaacaccagcacgcaggcaaagcgttcactcatttgattgccaattgcttttaagcctttcagaggtgcacgacaattgacgcgcgagagactgcgccgctgggcaccaattcgacgatgtacgttggcacgccacgcgactcggtcatcggatacaggtcgaaagggcacaaaaacatttgtgaaattatttaatttatttttcattttcatttaggtccatcgctgtgcccggggaattgcacggcttttggaccgctttcacaaagttcggcagcggccgcgtcacttggaaacggctgttcgaaccggcaattaaattggcccgcttcggatttcccgtccgctgcaatctctgccaatggcattcattttgttccgctttaggtctcctcaaatttggcaatggttcttcagcagaaagaggacgacatcgaagaggaccaaaatttgaagtgggaaacggacacactgagaatattatttggacttaattataaataataacaatacttaattgtccattttcaattggatttaggcgcatttttgtggacaaaaaaacggggagagtcttcgaagagggagacattatgacgagggaacggctggcggaactcgtaaaaaacgcttccgagaaagtttcttgagtttgcctattcatttcccccaaatcgcagttggacgaattggccgtcgcaccgaatcccatcgaattgttttataaaggcacaaaaataaatgaaagaattaattgtttatttgtcaaaattca

SEQ ID NO: 59834 - DNA, 690 bp, Heterodera glycines
  Genomic contig location: Contig_ID=SeqID_29324; Location=41..730; Strand=+
  SCN-specific regions: Sequence locations=1-690
tgattagaagaggtacaaaagtgattagaagtggtacaacagtgattagaagaggttcaacagtgattagaagtggtacaacagtgattagaagagtgattagaagaggttcaacagtgattagaagaggtacaaaagtgattagaagaggtgcaacagtgattgaagaggtgcaacagtgattagaagaggtacaaaagtgattagaagaggtgcaacagtgattgaagaggtgcaacagtgattagaagaggtacaaaagtgattagaagaggtccaacagtgattagaagaggtgcaacagtgattaaaagaggtacaaccgcgattagaagaggttcaacagtgattaaaagaggtacaaaagcgattagaagaggtacaaaagtgaattaaaaaaggtacaacagtgattagaagtggtacaaaaggattagaagaggttcaacagtgatcagaagaggtacaacagtgattagaagaggtacaacagtgattaaaagacgtcaaaagtgattaaaagaggtacaaaagtgaattaaaaaaggtacaacagtgatcagaagaggtacaacagtgattagaagaggtacaacagtgattaaaaaacgtcaaaagtgattaaaagaggtacaaaagtgaattaaaaaaggtacaacagtgatcagaagaggtacaacagcgattaaa

SEQ ID NO: 59835 - DNA, 1134 bp, Heterodera glycines
  Genomic contig location: Contig_ID=SeqID_29326; Location=69..1202; Strand=-
  SCN-specific regions: Sequence locations=1-1134
agtccgtatgaggaaatcgaccaggacaaggctggagtgtcgcctgaagaagtgaattgttgttgctcatctgtagcaattggataatgttttcttttccatttatattttttaagcttcgggctgcctttttccgttgcggtggagtcaacgcacactcatggcgtattttggttgtggcggcggagggcgacaacgagacgaccaaattcattggcaaactgttggatttcctcacggcagaagtactcgagatttgcattctttttaatcggattaacgaccacaaatttcagggaacttctgctcctccgacgaattgtccaccggctgctgcgccgcccaattctcagttggccaacccccctttgcaacatcaagccgggacttctcaggtttcttatgatggagcattagtttgctctcgtgcttgctcttttttagcgaaatcattttttgttacacttttaggcctcacaatttccattctccgccgccatccattctcagtcgggcctcacgtgtcgtcaggttgtttttgtgactaaaactttggtcgttgcaaaatttaagtagtcttttattcaggaggttgttggaggtatcgctggcccggaaactcccccggagcacatttacgacactatttcgtcatcctcgtccgccgatgattcccattcgcagcataagaaggtttaaatgggaatttttttcagcaaatgcatgcttatatttagttgagcattcccccgggtcacatttaccatactgtcatgtcgacctcgtccgatggttcgaagcgctcttctgtcttttacgacgttcctccgactcctccaccaccggtgctgcaacatacggttttgttcagggttaatttaggttcaaaatgtgcaatttactcgcttttctcgatttcttcaggggggggagaactttttggattcattttttgaaaaggtcgcacctttttaccctactaccccaaacagcaaaatatgtgatgagagacgtttttttgtggttttgacaatagacaatcaaattttatttgcagcacagaggcgaaaagaaccgaaagaagaacgaaacgccttccccggcctcgaaatgctcggacgcgaaaaaaaggtc

SEQ ID NO: 59836 - DNA, 170 bp, Heterodera glycines
  Genomic contig location: Contig_ID=SeqID_29329; Location=65..234; Strand=-
  SCN-specific regions: Sequence locations=1-170
atgtccgtccgtgtcccttttttgcttcttccgctgcttttcctttgtcccctccttctccccgtttctgtccgtgccgttcagtccgttttttcgtgtccgctcagtgccgccagcgtcgccggcgttcccggcactctcccggcctttgccggtgctttgggcgaagt

SEQ ID NO: 59837 - DNA, 375 bp, Heterodera glycines
  Genomic contig location: Contig_ID=SeqID_29331; Location=351..725; Strand=+
  SCN-specific regions: Sequence locations=1-216,238-375
atgtgcaaacggatgtacgaaatggaagtccgtgcccacatggattcggtggcggtgcgtgcctcccccgcggctgttactttgctgaccaaagtcaacgccaaactcgcggaacaacagcagggaaaggtcggtccgaacaaattcatacacttccaaattctaaaaatcaaacagaaccaaccaaatgaggaaaatgaccgtccggcattgcgcgaatacccaaactattgggaagagaaacggattgaccgttcagtctattggtggttcagaccgatgaagagcaccagcggaacggacgcgataaacatgacggaattgtcggacgatttgcgcgaagcggcggaattgaagcggaaattttcggaaaag

SEQ ID NO: 59838 - DNA, 2491 bp, Heterodera glycines; identical to SEQ ID NO: 5960
  Genomic contig location: Contig_ID=SeqID_5960; Location=1..2491; Strand=+
  SCN-specific regions: Sequence locations=1-429,451-1082,1104 -1190,1225-2314,2347-2491

SEQ ID NO: 59839 - DNA, 249 bp, Heterodera glycines
  Genomic contig location: Contig_ID=SeqID_5960; Location=212..460; Strand=-
  SCN-specific regions: Sequence locations=1-10,32-249
atggagaaacaatttcattttgattattttcgatatcagatccggtgagtttattatatttttccttacagtactgttgagaaaacttttatgagattttatatgacagaggataataaccacggttacagttcaaagctctcgattaagattatattcgttttgggggtacttgagtgaaattttatttggttttgatggggattcatttttaaaaatgcacgaatatatggcattttcagaaataaa

SEQ ID NO: 59840 - DNA, 249 bp, Heterodera glycines
  Genomic contig location: Contig_ID=SeqID_5960; Location=865..1113; Strand=-
  SCN-specific regions: Sequence locations=1-10,32-249
atggagaaacaatttcattttgattattttcgatatcagatccggtgagtttattatatttttccttacagtactgttgagaaaacttttatgagattttatatgacagaggataataaccacggttacagttcaaagctctcgattaagattaaattcgttttgggggtacttgagtgaaattttattgggttttgatggggattcatttttaaaaatgcacgaatatatggcattttcagaaataaa

SEQ ID NO: 59841 - DNA, 530 bp, Heterodera glycines
  Genomic contig location: Contig_ID=SeqID_5960; Location=1654..2183; Strand=-
  SCN-specific regions: Sequence locations=1-530
atgatttcgtcggataatggtgatgggttaatgtgcaaatggaaccgaatagttgcagccaaaagaaagggtgagcaagtaaggccaaaggacacacgagtaaatcggaacatttgaagattaattgaagagggaggtaattggatatttttgagccatagaaaacgggtacaatcacgatgattagggtgtactaaaacttgaagaaaagctttttctatgtcgcatgtaattacaaatttaggaattcgaaaacgcaataagaggcccacgaggtcgggaataagaatggggcctgggtacagacagtcattgagtgaaggctctttaccaacatgggccgaaccgtcatatacaattctgacttttccttttatttcattaattacaggatggtgggctagataatgaagaggaggtgaaaattttgaagaaatagggacgggttcaatgattcccaatgtcttttgttcttgaataatgtcattatattttttaagaagtgttggattttttgaaagggtattaaa

SEQ ID NO: 59842 - DNA, 775 bp, Heterodera glycines
  Genomic contig location: Contig_ID=SeqID_5962; Location=549..1323; Strand=+
  SCN-specific regions: Sequence locations=1-390,414-735,757-775
atgtgtgtattcaatgtagtccaaaaccgttggccaaaaattggcgaatttgttcttgtataccaggaaaatgcgccccgttcaatttggctaacagccactattttaaacgtattttataatgaactcaatttccccaattccgccaaagtaaaaactattaatggccatacaacaattcgctccgttcatcatttgtatccacttgaaactcaagaagaattagcttcaaaaaccccaaaaatttcatgggccccttatcctcccaattaccaacctcccgttattgaaaggaattttcccagtaaggtacacattaagcagaaccgtagatggaattgggccgataaaccaccaacaaacacagccctttcccagctctaactacaagacaaatcccacataacattacagtaataattttttcccgtcgcgcccggaggtgctgcgctattcggttttcccatccccatcgtactctcccctcctgtgcattgcgctgtttcgttgtgctgcgctattcggttttcccatccccatcgtactctcccctcctgtgcattgcgctgtttcgttttcccatccccactagccatcgtagccttccttcctgtgcattgttttaaacggatatcagccaatttaatctaacatttatattaaagcgtctccgcaaaattcaatttttgctagagagccccgcccttacccaactgcttatatatccaggcatcattgtatttttcactcaattatctgctcatttacttaagaa

SEQ ID NO: 59843 - DNA, 1660 bp, Heterodera glycines
  misc_feature (65)..(65): n is a, c, g, or t
  Genomic contig location: Contig_ID=SeqID_29332; Location=72..1731; Strand=-
  SCN-specific regions: Sequence locations=1-302,343-345,380-496,520 -693,715-740,815-936,970-1100,1123-1180,1204-1217,1240-1660
ggatccgcttcatgtcattatattttctgattaatttgatccaaaatggcagttttttgaaaatntattttcgagggcttttccagatcaatttggaaattttaagcatcatatgaaagcgccttcaacgtactctctctctatttattgcttcatctctttttttaagatggtggctggcagggatggcacggaattccgatttccgacatttttggggtcggaattccgatttccgaaaaaattttagtcgtcggaattccgccttccgaaatttttgatgaaaagtcggaaattttcggaaattttttttaaattttttttcaaaaaattaataattttggtataatttctgttaataaattgaactgaaatttttaaaaatttctcggcgacgcctatcggcaccgccggacactaaaaatacttattttcttgaaaatttgctcaaaagagcaaaattttgtcattttggacaaattctgttaaaaaatcgtattaaaaattacaaaattttcccggcagcgcctgtcggcaccgccggaccctcctccatgttcccaaaaaatttttgaaaaaagcgcgccgtaaaaaacgtgtaaattagtcactccttttcccaaaaatgttctaaaataatgcaaaatgacataaaaaaagattttgataaaatcattgaataatttttcaagcaaaatattcaaataaccaaaaacctttttgaaacaccttttacttggtaataattaaaaaatttagcctattaaaatatttagaaaattttttattatattttttattttttgaaaaatttccgatttccgacgtttttggggtcgaaattccgatttccgaaaattttttgatccccggaattccgatttgcgaaaatttttggggcctcggaatgccatccctggtggctggggaagctccaatattttcataataattaaaaaaatttattttgctaattttcaggtggttatacacttggccaatggttataagactgccgatttcacctggttctttgatggactgaagaaagctggtggcagttttgatgttgttggcatctcacattatccgacctcgtcaaattggcaaaccttaaatggacaggcagaaacaacgctgaaaactatgatcagtcggtacggtagacgactgttttgtagtttaaaaaattctgagatttattggaggttcggttcaaatttttgtaatctaggatatttaaagtttgctctttaaaaatgggtaattcttaaaagagaaattcaaaactcccacagctttaaaaattttaacataaaattaggcaatttttcaaattttcataacaaattatcaaaaatttatgtaattttcagcggccctttttggtaggcctcaatatagccactttctaaaagccgaactttgccattttaacagatatggcaaaaaggtggtggtggccgagattggcttatcatggaacgagccaagtgccagcaaatccatgcttgacgacatgttcaagcgggtgaaagcattggggaacaacggcattggcattttctattgggagccgcaggcgtcgccaggctggaaccattaccagtggggcgcgttggacaattcgggcaaatttacggccgcaatggaatcattc

SEQ ID NO: 59844 - DNA, 775 bp, Heterodera glycines
  Genomic contig location: Contig_ID=SeqID_29333; Location=597..1371; Strand=-
  SCN-specific regions: Sequence locations=1-775
actcaatccaccaacatttcaatcactggggactcaatccccttacattcaaatcactgggactcaatccaccaacattccgatcaacgggacttaatccaccagcatttcaatcagtgggactcaacccaccaacattccaatcaacgggactcaatccaccagcatttcaatcaacgggactcaatccaccagcattcaatcactgggactcaattcttctgcatttcaattactgggactcaattctcctgcgtttcaatcactgggactcaaccctcaagcatttcaatcgcagggactcaatccaccaacattccgatcaacgggactcaatccaccagcatttcaatcactgggactcaacccaccaacattccaatcaacgggactcaatccaccagcattcaatcactgggactcaatccaccagcatttcaatcactgggactcaatccaccaacattccaatcaacgggactcaatccaccagcattcaatcactgggactcaattctcctgcgtttcaatcactgggactcaacccaccaacattccaatcaacgggactcaatccaccagcatttcaatcactgggactcaatccaccaacattccaatcactgggactcaatccaccagcatttcaatcagtgggactcaacccaccaacattccaatcaacgggactcaatccaccagcatttcaatcactgggactcaacccaccaacattccaatcactgggactcaatccaccatcatttaatcactg

SEQ ID NO: 59845 - DNA, 812 bp, Heterodera glycines
  Genomic contig location: Contig_ID=SeqID_29334; Location=15..826; Strand=+
  SCN-specific regions: Sequence locations=1-82,105-467,502-812
cattcaaacactgggactcaacccaccaacatttcaatcactgggactcaacccaacagcatttcaaacactgggactcaacccaccagcattccaatcactgggactcaacccaacagcatttcaatcactgggactcaacccaccaacatttcaatcactgggactcaacccaccaacatttcaatcactgggactcaacccaacagcatttcaatcactgggactcaacccaccaacatttcaatcactgggactcaagccaccaacatttcaatcactgggactcaacccaacagcatttcaatcactgggactcaacccaacagcatttcaatcactgggactcaatagctttttacactaaactgaccaaacaaaaaagcaaaacaaacatttcattttaaaaatcattattcaacaatgtgctatctctaaaacatgaaagacacagtagtgtgcatctcaaaccaatacattttttaaaaaacttgacaaatttcagttctgtgtctcatggatgagaggcacaatagtgtacatctcaaacaatatattttaaaaacttggacaaaatttcacacttctgtgggtttacaaaacttttagtgtacatcgcaaaacaattcactatcaaagaattcttttgacaaaagttcacactctgtgggtttctaaaacttggtaggcacattagtgtggatctcaaaacaattctaataattacatataacaggtaatgtgattgactaacataagccacacaccacactaatgaattttctaaccaataataacaaataattcattta

SEQ ID NO: 59846 - DNA, 341 bp, Heterodera glycines
  Genomic contig location: Contig_ID=SeqID_29334; Location=1085..1425; Strand=-
  SCN-specific regions: Sequence locations=1-72,94-341
atgaattgtgctctcgcttcatcgttttcgccattcgggaaacatttcgctgcagtcgttgcggacaagaaaggaatgagggctgatttgtacgtcaatggcgaagaattggtagaacgtcttggttcatgcgttaagaacacacagatcgaacttcaaaatttttttgtgaaagttgaaggtaattgtaattgtgtcggcattacctttggttttaatttgagttttcaagtttttttattatcatagatgaatgccttcagctacattgcgagatttcatccgttaaaattgatgctgggcgcgttaatcttgaggcgattttgacgacaccaattaaa

SEQ ID NO: 59847 - DNA, 376 bp, Heterodera glycines
  Genomic contig location: Contig_ID=SeqID_29335; Location=50..425; Strand=-
  SCN-specific regions: Sequence locations=1-376
atggtaaaatggggtccggcggttccgttagggtcgccgggaaaattttttgagaaattttattcaatttgtcaaggaaattgctttgccgcagacatctctcacagcccccgagggggaattgccaggatttatatactggcacaatgggaatggactttggatatgatgaggggtaatgacggcataaacacaaaggaaataagagataaatggatgacatatgcaagaggtgaatgggataaagaagtcatgataacattggaaatgagagggatatgatttggttgggatgagacgaacggacagacatgtttatgacgggattgggtcgggataaagtagggcaacttacattatatgtacacaaaataaa

SEQ ID NO: 59848 - DNA, 1131 bp, Heterodera glycines
  Genomic contig location: Contig_ID=SeqID_29336; Location=855..1985; Strand=+
  SCN-specific regions: Sequence locations=1-350,373-700,729-773,795 -1064,1087-1131
atggaaaattacttaattcctggaatcccttttcttcttgacggccaaatcgccataaaattcttcactttgcgatatttcactagcaatcatcatccagcaccgtttgagatggatttcgatgactggggagtgagacacatgcactcgtccgagcaagggtatttcgccttgcgtgcggttgagttcggcgaccaacaacagttcgaatatgttcttaatttggcttcggccagagatgtgaagaaccgaggaaaaagggtccgcggctataattatgggcattggcagacggtcaagagagaacacatgctgcgcgtggtcttggaaaaatttcggcagaatgaaccgctgtgtgaagccttgctccggacgggctttgtccgactcgtggaagccagcactgaccgttattgggccgccggattgctgataactgatgaagctatacgcagttcaaataattggatgggtctgaatgagcttggctgggtgttgatgcacgtcagagaccaacttcgaccattgccgcaacaagtccacctgatccacaagcactacatcgtatgccaggcggcagcgcctgactacgttgtggcactcgcagctgagccacatgttcagccgtatgctgttcggattaacaacgaaactgtcaatgctgcccgacaactgcaaattggcgatactttggtgatagaaagtgtggagtggagagaaggttttgagcagcttggggccgaaggaatgaacgacagaccgtgttgggtacaccaggccagactcaactggcaagctacggcttcggccgtgtacagtgtgtgtatgcaccagtgggttcctgccagagccaagatcttgcgttgcgtccgcggagggccaagacacaaccgagctgtctgttccatacgcatccaattagacggcattgaatttgtagtgacacagcgaaacgtcaatggcaacatcggcttggcacgacagggccaatggattgatgtttgggcgattgtggtggcagagcattggcacgcagattggggattcattttgcccccggacgctgtgtttagagggagacaccagattgtgtcggatgggcgtgtcagaatcccggtgtttgtggggtga

SEQ ID NO: 59849 - DNA, 854 bp, Heterodera glycines
  Genomic contig location: Contig_ID=SeqID_29337; Location=220..1073; Strand=+
  SCN-specific regions: Sequence locations=1-20,89-107,155-172,379 -420,455-489,563-676,700-731,788-788
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 59850 - DNA, 219 bp, Heterodera glycines
  Genomic contig location: Contig_ID=SeqID_29338; Location=1102..1320; Strand=+
  SCN-specific regions: Sequence locations=1-219
atggctgagcaaaattcttttaattctcaaaagggcgaaaatgtggagggaccaattggttcggatttcgatccaattttgtttacccctgaggagaaccaaaatctgaacaatgtactgactcgaatgcgaacattcgaatccgctatttgccgtcaatttcgtaaattggagcgagaatttgcagagttgaaaattgtggctcacccaattagatga

SEQ ID NO: 59851 - DNA, 409 bp, Heterodera glycines
  Genomic contig location: Contig_ID=SeqID_29339; Location=492..900; Strand=-
  SCN-specific regions: Sequence locations=1-45,67-236,258-409
atggaatacttttatgaagcgatagaacagaagctgctggccaaagtttgggcttttcatagttcctataactttgcgcttaagggaatggaaacgttggcccttcgcgacgtaatttgtaatgtcagtgagacacttttccaaaattaatcgcttaatcgaactgcttcagctcctcgattccatttcacccgcaaatggtcattccgtcacgagaatggacttgaagaggttggcctttccttttgggtgttgatccgatcacatcgatcatttgggactttttgtttgtctgccattttaggtccgggctggcccatcgcttcttcaacacttttgtcaattggataaaatacgtggatcaagaatcgtcggacggggaaagagcgtctgtgaaggtgccaattag

SEQ ID NO: 59852 - DNA, 539 bp, Heterodera glycines
  Genomic contig location: Contig_ID=SeqID_29340; Location=520..1058; Strand=-
  SCN-specific regions: Sequence locations=1-70,110-203,226-461,500-539
atgtttcctcctccaatgactttgccaaggcatggctccgtgtgtgaaatgtttgacggtccaatcgaatgccatcccagtgacacagcagcagcaaaaggaggaggaaaagccgatcagaagcagagcaattcgggcgaacaaatggcagacggaggaggaaaagcggtggcgaaagacggcgtcagtgagcagaatgagcaatttgtgagaaggggaaaagcaaatgatcgacaaaagtcaattaggcacaatttgcaagggaaaggcaacggcgaaatgcaattcaaaattatcgcttaattacccccacaatcaggcggaacgagtgcaatcgctgctttgaacatgtcgaccgtgccggtccgcctcgtttctcctcagttccgttgccgaacaccattcttaaatgtgagactaattgaacacggggcgaaaaatggacaaatttaaattgggccaattaattgtataattattattaattacttttattttagcgctttccgaaatggaagaacgaaattgcacttggatga

SEQ ID NO: 59853 - DNA, 582 bp, Heterodera glycines
  Genomic contig location: Contig_ID=SeqID_29341; Location=347..928; Strand=+
  SCN-specific regions: Sequence locations=1-55,77-104,199-549,572-582
atggaagaagaatatgtgccagggaaagtggtcggctacatagaagacccgcgagaggaaaaggaaggggaatgggacatggccaaagcgttgcagaaccgttcaaaagaagacgaagtgcgaataaaaaagagagagcaaagagaagaggggtggaaagagctaataagcggagaaagaaaagcgaagggaagagaaagaccgaaattggtggaaaaattcgtgaaaaatgtgttgggcccagctgaaaacgacgtcagccgaaatcccggccccccccccgaaggtagccgcagaggcccgacaccgattccttgttggaaccgctacaaaaaaaggcctcgcttcgtcagtccaattcgaaacatcagtccggtccgaacacgccaaagcacagttggaacgcagacgacaaacgcatggcccagctgcataggagacgtggtggaacaaatgcaactgatgaagacgaagctggacgaactgatcgccgctctcaagaaaaaggaggaagaaaaaaacaatggaaacaacgagcaaattggcgagaaggaagaacaacagaaagaaaatggaaaatag

SEQ ID NO: 59854 - DNA, 2085 bp, Heterodera glycines
  Genomic contig location: Contig_ID=SeqID_5963; Location=37..2121; Strand=-
  SCN-specific regions: Sequence locations=1-1126,1148-1384,1406 -1584,1606-2085
atgagcgcggaccaaattaagcaactcctcgaggccatgcgtgtgcaatcggatgcaattcaacagctaatgggccaagcaccacaaaacgccacgagtcttaaccacgcaaatttggcgagttccatcgacggccgaatttcaaaattcaattatgacgccgaaaccgggaacactttcgaacagtggttcaaaaggtttggagttctgattgaagaggatggtaaggacctccccgagtcgaccaaagtcagactcctccttggcaaactcggcgacgaggagtacggcaaataccgcgacagcatcagtccgacccagcccgacaaagtcaattgggtggactcgatcaccaagctcaaaggattatatgccgaaacgcgatcattattcgtccggcgctacgaatgtttcaaaattcgtcagcagccaagccaggacatctcatcgctggtcgcacacatcaacgcgtcctgtgaaaacgccaatttgagcccgaccaaggaacagcttaagtgcataattttggtgattgcacttaacgacgagcatcacgacctgaggcaaaagtgtctcaaaatgctggaggacgcagaaaagaccggcacagacatcactctccaaaaggtggaagaggaattgaaggcgattcaaatcgtcaaggaaagtgccctttctctgcttactcaaccggtctcaaccagcgccatccaattgcgacctcagcaatggcgagagaccagcaaaggcaaacacaaggcaaaaccggcacccaaatggccacatcatgaaccggcacccaaatcgccacatcatgcgccttcgcctaagcaaaaatcggacgacaaagcaaaccgaggccatccatcgcatccatgcgcatcatgcggaagcaacgatcactggcgatcggactgcaaatttgccaacgcattttgcaacaaatgcaaccggcaaggccacattgcgattgtctgccgtcagcgctcgtcgaacacggcacacaaatctcagaaccgatcatttcacacggtcgtggtcaagtcacattgtatggtgattggcacaacccaaggccgatggtggaagatcccggtcatgatcaatggcataaatttgaagatgaatggagacagtggagcccaagcaacagtcatcagcttcaaaacgtggatcaaattgggccaacccgaactctctccaacggacatcgagacccgcaactgcaatgacaccgcattttcaaccgaaggaaaatttcattgcaccgtcagttgtttcgatcggccatccaagacactgatcgcttatgtcagcagtgacttaaagcatgatttgttcggccttccgtggattgaggaatttgagctcatctcaaaagaaattttgtatccacagagcaccaaaggaaagaccaacgcgtcaatcaacgccaatgtcgtaaaggcaccaaacccggcgattggcatcacggacgaatcctcgctcaccgctgtgttgcaaaacgattttgaggaagtttttaagagcggacttggccactgcgcaatcaaggcgcatctgattctgaaaccggacgcccgacccattttctgtaaagctcgaccagtcccccatggtgctatcgaagcagtcgacaccgaactggaccgcctcttgcagatcggcgccatcaaaccggtagaattcagccattgggccgccccgattttggccgtcaaaaagaaaaatggaaagacccgggtgtgcatcgacttttcgaccggattaaacgattcgatcgaattgaatcgccatcctcttccgaggcccgacgtcatttatgcagctttgaatggagcagaatttttctcgaatctcgacctgagagatgcgtacctccaaatggaattggacgaaaaatcgaaaccgctctgcacaatcaacacccaccgcggcctatttcagtgccaacgtctcccatttggcgttaaatcggcaccgtccatttttcagcacctgatggaccaaatctgcgcaggaattccaggggtcttctcttatttggatgattgcctaatcgcctcaaagaccctggaagaccac

SEQ ID NO: 59855 - DNA, 687 bp, Heterodera glycines
  Genomic contig location: Contig_ID=SeqID_29342; Location=710..1396; Strand=+
  SCN-specific regions: Sequence locations=1-292,315-338,388-687
atgggagaacccataaaaacaggatcgggatcccgcgaattttctcgggatcctgcgggattaaacacgagaacacgacctcgggatcccacccgattttccaaagtcttcgggacttatgaggtattaatcgaaatttttataccggtggttgccgttttatgcttcttaaaatgatgcagttgaaatcaatgcgattttccaaatttttgttcagccgaaagaaagactgattcctaaggtcgatgagaatagttgtttaatgatgctaaaatagaatattaggtaaaacaatttttaaaaaattattaaaagtagattggcatttgtcgagatggaataatattagttaaaataattttttaaaaataataattattaaaaaatgatttactgccaagagtgtgtccatgtccttcctacccaaatgtttatatacaaatctcatcatattacacatcagcatggatatgagctatcatcatcattagctaatttttacactaataagtgtagggtggaagagaagctcgagagtttccgtctttccgtgtctgatgaaagaaatgtcactaaaatccatccgtacagaaatcacatttttttcattttttggcaaggccaaaacattaattaaacaaacaaaaattgattggagcgaggaattaaatcaatgaaaacattgaa

SEQ ID NO: 59856 - DNA, 892 bp, Heterodera glycines; identical to SEQ ID NO: 29346
  misc_feature (18)..(18): n is a, c, g, or t
  Genomic contig location: Contig_ID=SeqID_29346; Location=1..892; Strand=+
  SCN-specific regions: Sequence locations=1-72,94-178,211-892
  Gene Ontology: Mol. function=lipid transporter activity; Cellular component=integral to plasma membrane; Biological process=lipid transport

SEQ ID NO: 59857 - DNA, 519 bp, Heterodera glycines
  misc_feature (143)..(143): n is a, c, g, or t
  Genomic contig location: Contig_ID=SeqID_5967; Location=1475..1993; Strand=-
  SCN-specific regions: Sequence locations=1-155,212-424,495-519
atgaaaaatagtttttatgagcagaaaaagaaagaatttatagaaaaaattgatgaatttaaaagtttatatggccaaggcaaacaaaaagaatttgtgaaggaattgggcatttttaaagagacattccgaagatggaaaancgaattgttgccaaaatataataaaagtaaaataaaaatttattttgatatttaaattatttttttaagaacaaagtaaatattccaatgaggacaaattacaaaagatgaagcaatatttcaaaattaaagaaagaaatccgaaaattaacgacagaaaaattgcaaagaaattgggaattggaaaaacaaccttgaaaaagtggaaaaagaaatttcctcaattttgaccattggatttgagggtgttaatcggctaaagatatttgggaaaccaaaagtttttttttttttaaatgaatttgtataatatttatttcacttttaaaattataaaaaagaatattttttgttcggaaataatgtatttaataaa

SEQ ID NO: 59858 - DNA, 751 bp, Heterodera glycines
  Genomic contig location: Contig_ID=SeqID_5968; Location=13..763; Strand=-
  SCN-specific regions: Sequence locations=1-13,52-101,124-357,430 -437,459-566,623-751
atgaatttatggcatataatatttttaatattttgctttatttataaaattgagtcctgcaaaattcgaccaaattttgatgaaatattcggcaaagaatgggacaaaaatgaaaatgaagaaaacagagaagaaatgggaaccgaatcaattgataaaatgagtgaatattccaatcaaaatgttatcaaaagtgatcaaaatagcaaaatggaaccaaatgaccaacaaaaaagcgaaattatccaaaaatttgaagcaattaaagaaaaactgaagcaaaaaggaaaatatcaagggaaaaaaagtgtcaaaattgaggctaaaattggaaaattattaggcgcaaaccgcgacaaaatatataaatggaaaaaagaattaaatttaaatataaagcaaattaaaataatgaaaaatagtttttatgagcagaaaaagaaagaatttatagaaaaaattgatgaatttaaaagtttatatggccaaggcaaacagaaagaatttgtgaaggaattgggcatttctaaagagacattccgaagatggaaaaacgaattgttgccaaaatataataaaagtaaaataaaaatttattttgatatttaaattatttttttaagaacaaagtaaatattccaatgaggacaaattacaaaagatgaagcaatatttcaaaattaaagaaagaaatccgaaaattaacgacagaaaaattgcaaagaaattgggaattggaaaaacaacctga

SEQ ID NO: 59859 - DNA, 1416 bp, Heterodera glycines
  Genomic contig location: Contig_ID=SeqID_5968; Location=1154..2569; Strand=-
  SCN-specific regions: Sequence locations=1-128,161-256,291-489,511 -569,667-683,738-816,839-1090,1133-1265,1314-1416
  Gene Ontology: Mol. function=3-oxoacid CoA-transferase activity; Biological process=succinyl-CoA metabolism
ttaatctcggcattggcattccaaccctttgcccttcgtatatcagtgacaagtcaataaaagtgtgcatacacgcagaaaatgggatgcttggcgtggtaaaaaacacgaaaaaaaagatgaaaatcatttatttaaataaaaatgtaaaaatttaaatgcaattttcaaatttgtttcagggtcaatatccgattgcgggcgagcaggacccagattatgtgaatgctggaaaagagtccatcacgttcggatgatttatattaattttttatgtaaattaattaatagttcagatataatcctggtgcttctgtgtttagctcggatgaatcttttgccatgattagggggtcaaaaaaacaaaaatttccataaaaaacgtttgtaaatttagcggccatatcgatttgacaatgcttggtgggctgcaggtgtcaatgagaggggacctggcaaattggatgattccggtgggaaagacaaataaacacagaatgacaaaattatattgtaaatagttcggccttttgaaaattgttgaaaaagttacattttcgattttgatgaaaatttaataattaatcaaaaactaagcaattaaaaaataaattctaaaaaaaaaatttgtttcaagaaatttgtttcataaattttatttattttcatcaaagtcatcttcgaattttttttaaataaattaaaaataaaaagaatgtaaaatatataatttttaagggaaaaatgttgaaaggaatgggaggagcaatggatttagtgagtgcaccaggctcaagagttgtcgttttgatggaggtataaattttaaaaaatgccaacaatttatcaatttatcgcataagaaaattctttttagggggttagtaaacagagtaagaattattgaatggggcctaaatgtcaaggatttatagtctgggattggattaatataatccattattttagcacagcgccaaagatggtaaacacaaaattttggaaaattgcacattaccgttgaccgggaaagaagtggtgtcaagaataatcactgaaatggtatatcaattattaattaggtcgggtcattattaatcattttaaaatcataaaaaatatttaaataaatgaaatgcataaatttggcattaaaatgaataaaaattcagtgcctcataaatttttcttcaaactattatatttttttttggtcaaaaaatattaatgtaaaaactgtacagttaattatgaatgacccaacctaataaaagattaattaacttttaattagaattattttttaatttttaggcagttttcgatgtgtgccgaaaagaaggcttaacattaattgaaatacacgagaattacagcattgaagacattaagaaggcaactggttgcaattttaag

SEQ ID NO: 59860 - DNA, 581 bp, Heterodera glycines
  Genomic contig location: Contig_ID=SeqID_29353; Location=238..818; Strand=-
  SCN-specific regions: Sequence locations=1-20,44-68,90-305,327-581
atggaaaacaatcaaataataacgaaacgaaacaacaaaaaactcgaacatgaaggatgcctctatgtcttccatatgttcaatgctgaccgtgacgtaaaattttggcgctgtgaacatcagcgcgatgaattcaaatgccgaggacgaaggtggttggtgtgcattacaccctttacccatcgcggtccccccttaaaaaactgtccggagaggggtggggtgggaaacgaactgctcccagttgggtggatgataaaaatatggggttttgaggtcgctggtcttcaaaattgaaaaactaagttgttttgacttattgtttggttggggttagacagaattggccaaaatttcaattgtttaggtgtacaaggaacaagttgagggagcgcctacgcctatcaatttgaacgttcaatttggcaccaatgcgcgcgagctcatttttgacatggacgattcaatagccgtggtaaaagagaagatccatcgtgcgtggccagtgacgccagtgccggctcaaatgttgctttacttcgcacgtatggttgatttcataaattgcttttaacaataaa

SEQ ID NO: 59861 - DNA, 134 bp, Heterodera glycines
  Genomic contig location: Contig_ID=SeqID_29353; Location=636..769; Strand=+
  SCN-specific regions: Sequence locations=1-94,116-134
atgggtaaagggtgtaatgcacaccaaccaccttcgtcctcggcatttgaattcatcgcgctgatgttcacagcgccaaaattttacgtcacggtcagcattgaacatatggaagacatagaggcatccttcat

SEQ ID NO: 59862 - DNA, 394 bp, Heterodera glycines
  Genomic contig location: Contig_ID=SeqID_29354; Location=680..1073; Strand=+
  SCN-specific regions: Sequence locations=1-394
atgaggaaggagaacaacaaaagcagtgccgcctcagcagattctgatgccaatgccaacagtggtggcgatgcttctctcaccgcccccactgaagaggagggcgaagaaatcagtgccaatgagcaacagaaggagcagcgcaagtcgctggacgcactgtacgctgcggcacgcgaggagttcgatttggacatgagccctttggacagtgcgatgaaaacgctgcgggagggccgcgagatacaaaagttgtccgtgctgcgcaacctgtggtcgagctggtggagggcgagccggacgaggcgttacaccgcctgttgcccatgatgcaggcaatgttttggacctgggccgggcggattggactttcagtttgtttccgtatatctaa

SEQ ID NO: 59863 - DNA, 676 bp, Heterodera glycines
  Genomic contig location: Contig_ID=SeqID_29355; Location=103..778; Strand=-
  SCN-specific regions: Sequence locations=1-126,157-540,562-676
acttttttttcaaacataagggaaatgcctattccctttcgagaaggtcctttcttctcggctcgtcgggtgaacatacccgagaatgcagattttcaacgatcgcttttttgagtttggcgacccagaaagagaagaggaggaggagagagttcctatccgacgtgaaccacgcgctcatcgccaaagtgagtcattgagttcatggattgagcggtcttatggaccgcactggtatgagacaacacgggatcgccgtgctgtcgatgaggacctttgcagagtgcttcgtgaaggagccactctaattggcgaacattttggcagagctgtcgatattcatttcgatggactcacctgttatggtccggagggtctctacctttctccgggtttaacagtctttgaccattttgtgcggttgggtctccaagtagacccattaataccgtgcacacaagaatatgtgggcttcagccctcacgagggagggatgttagtcgatctttacccgatcgagcttatcagcatcagacatcgagtcagagctgcttggagagcaccagaggaggatgaacttcatcctcctgcacgttaccgagcccaatcaccggatggacacctggagaaccgtcctcaacgtgtggtccaacgacgtccaatgaaccgatggtga

SEQ ID NO: 59864 - DNA, 161 bp, Heterodera glycines
  misc_feature (158)..(158): n is a, c, g, or t
  Genomic contig location: Contig_ID=SeqID_29356; Location=10..170; Strand=-
  SCN-specific regions: Sequence locations=1-28,62-161
atggtcatagtcaggtgtgttaagtaactaaatttttaattaaaattttaaaaaaaattttcaggattatgacagtgaaggctgcgtgtccccgtccgtgtctcgctgtaacaactgcagcacaacaaaaacaacggcatggcgtcgggatgccaccnggg

SEQ ID NO: 59865 - DNA, 1656 bp, Heterodera glycines
  Genomic contig location: Contig_ID=SeqID_29356; Location=491..2146; Strand=-
  SCN-specific regions: Sequence locations=1-573,595-684,706-802,824 -1122,1144-1528,1556-1584,1606-1656
  Gene Ontology: Biological process=reproduction
atgcgtcacgcggtcgcccaactgaacggcaaaatggacagattggcacagcaaatggctcgcgttgaagcagctgttgttgttggccggaaaacgaataatggtgccgggatggtggtggtgccaaccgctgaagaggcggaggagagaacggagcagcaacagcaggagacaaaaggcattccaacaaggacaaatggtcaattttccaaacggatgggcgtcaaggaaatgccaacaatgccgacaccgaggtggaagcgccaaaaggacaagcgcaaaaagaaaagtcccgacataatcgagagtctcgacctgagataaagtcttgggttccaatcttgagccgtgccaacttggtttctttagagactcggatggcacccgccgggagtcccacgacaaaacgagcatttttttagtcactagaacttccgaaaatttcgattgaactcaaacttagggcttgataaatgtgtaaataatttcagttacacatcatccgccacgtggaatggcgccgccatcacaacgaacggtgacggtggtgccaaatcgtcgccatcgccgcgagggattacggtaaaggaggaaattgtagtggcatccaacgatggtggcatcatcggtagtaacgaccattactatcaccaacagcagcggcacaacatcagcggtgacaatggcggcggcagcggtggtgccatcaataccgtggcggcgggaacttttgcgtcgtcgactggcaccggcggcaccacaatgccaacaacatcggcaacgacaaccgcggttggcagcaggaagcggaagccggcacggacggccaacaacagcaacaacagtttgccgtggacgacgacggcaacgagtacaacgacgcatggcggctaccgtgttgaagcatcgccgccggcgttatcgacgaccaccgtaaccacgacggatgagctgttgttggccaacctgtttggcattgtgccaactgccgtctcgtcgtcctctgttcatgccgctgctccgtcgacgtgcagcgctgcctcatccgcttcatcctccgccgcttcatcagttgctgctgcgacggcggcatcaacacagcaggcggccgctctctattccattctgttgcagcatcagctgaacaacaacaacgcggcggcgacaccgaccacggaaacgacgacggcaatggacattggtggcattggcacaattgctgctgacggcggcgtcaccggtgtcggtgccgaactgaacggcagcggtgcaacaaattgtgatggtgttagtagcaattcaacagatgccacaacctcgcccaacttgcttagtgctgctgctgctgaatcgcagcacataataactgcaacagcggtggcacaacaaccgttgctgttgaagaatggtagcaatgccaatgatggtggcggcattgttatgattggctgcggcggtgccaacgcgacgagtccacccgacgggggcggcggaatcttttttggcgacgacttccaactgttcaagcacaccaacaacaacaacaataacaacagtatcaagctggacgccagtgatcatcataatgccatggtgatggaggcaagcccgccgggctcacgtgagaatcaacaggtgggaacaaaaaaggaataa

SEQ ID NO: 59866 - DNA, 491 bp, Heterodera glycines
  Genomic contig location: Contig_ID=SeqID_29357; Location=301..791; Strand=-
  SCN-specific regions: Sequence locations=1-491
  Gene Ontology: Mol. function=zinc ion binding; Cellular component =integral to membrane; Biological process=one-carbon compound metabolism
atgaatgggtctgagcacaccgtcggcggcgtcggctacgccggcgaattgcattttgtgcaccgcagcgtgaaatggccgaacattggggaagcgttgaagcagccggacggagtgttggccgtggcggtgtttttcaacgaaaacctcgaggacaacgcgacgctggcgccgctggacgacgctttggcccgcgtcactttccgcggcgccgagtgcccaatgcattcgcttcgcctctcccaactgatgcccgtggagaagagcaaagagttttggctgtacgacggctccgaaacggcggagcctttccgcgaaacggtaggcaaaagcggaaaagtgccaatgaaaatgccaacggatgacaggtcaaatgggtcgtgtgccgatcggcggtgcccatttcgacggcacaattggaaaggctgcgccaactgcgaaagagtcgggcggaggacgaagttgaggaaacaatgcagcccatccgtgcg

SEQ ID NO: 59867 - DNA, 871 bp, Heterodera glycines
  Genomic contig location: Contig_ID=SeqID_29359; Location=869..1739; Strand=-
  SCN-specific regions: Sequence locations=1-159,181-318,354-838,861-871
  Gene Ontology: Mol. function=glutathione peroxidase activity; Cellular component=cytosol; Biological process=establishment and/or maintenance of chromatin architecture
atgagttcttcgtcttctgccgccccatcggacccgcagcaaaaaagcatttatgaattttcggccaaagacattgacggcaatgagaccagctttggcaaataccgtggcaaagtgctgttggtggtcaacgtagcgtcgaactgcggcttcaccgactccaactacagtcagctgaagcagttgctggacaaatacaagtcgaagggactcgaaatcgcggccttcccgtgcaaccaattcaacaaccaggttgtattctgactctactgcacttcaggcgtccgataaagctttttttacgagtaatttttgatgaaaataattttaaaaaatttagtttaaaaatttttgattcacagcattatatgaccgcatttcatcaagaatatgatagtatttttattgtgatagagacggaacatgtatttgatactgcaagagtttgaggttattagtatgaaggtgacgtaatccatttttcattgcacgttgccaaatggatgtgaattgaaaacccattcgatatttaactaatttgcactatattaattaatcactgaattaacaaacgattaaagaataagattaaaaaataaattaccaactaattcgattgggtgcctaaagtgcaatagagccgtattgttatatctgtttgaattttacattcttcgtttaggaatcgggctgcgccattgacatcaaagactttgtgaccaaaaagtacaacttcgagccggatctctacgacaaaattgacgtcaacgggcccaatgagcatccgatctacgcctatctcaagagcgtccaaggcggcatcctcggctttgatgcgatcaaatggaactttaccaaggcaacacaataa

SEQ ID NO: 59868 - DNA, 1365 bp, Heterodera glycines
  Genomic contig location: Contig_ID=SeqID_5970; Location=1810..3174; Strand=+
  SCN-specific regions: Sequence locations=1-614,636-782,821-910,933 -1344
atgccgccccttggacaggtagaacaacttgttcaacccatgttcatcaattcggcacatcagcaaatgccggtattttgatttgtttttaatcggaaacccattctgttttagtcaccattttgtgccgatggcactcacaccattcaatttttgaatgggagtgtctccattgtgggccgcccgctgccgtctgttattcattgcaacgtttcttcaattcaattgattttttcaggccgctttgtctcaccgttgtagcattggaccaccgtccgcaccaacaaacgccagctggctcactcccggtgaccaatgttgtgctgcgcaatggcgacggtcagcgtgtagaagcctcgggttggaagcaacaggccagtgttctggcgtctttgaacatcgggagcacctactggttcaccaactgcactgcgcgggcccgataccagcaactggactgttggtaccgattggcgtcgatggcaaaaatgccattgtcgtccctcacactgccgctccacaggtaagtttttttatacgtttcttataatagaattttgtgttaagccgacggctccgcaaagtggtggactccgccattcaattgcctccattttgggagaacaggtgattttcattgattcaaaaaaaaaaaattaaatatggaaatatttaaggcgccacatgttcagacgggtggaggccgcacggtcaatgatgcgcgtgcccctcccgcagccgacccaattgaggaggacgagaataacaatgtgagaaaatgatttttttttttgtattgtgtttttttttttttttttttgaataaaatttgctcagacaattgatcatcgttttgggatcccggtgcgtcatcagagacgggcagctcaagtggttggttattatgatttgctttttcttgaataatttaaccatgaataaataatttaaaggtgactcgaccaattgaggactgtttcgtcattgagaggacgacgccaatgcgcaacacactccgaaacacgaggggcgaactctgcgaaatccgctttctgcctctggaggatgccgagcgacctgatctccttctggagacgctcatccagcatctgctcgaccgtgtcctggaaggtcaccccccaccgatgctcgttggacttcagcttcacccgccaggcttcgaccgaccgtatgtcatccgactccgcccaccggagcaaaacaacgcagcagcattggcggcggccattgaacgactgaacgaacagtcggcagctggaatcgatcttctcgccggaactactgttgcgaaagtgcttgctgtgtggcccctggagccaattcgtgcggatgcgcagcgcggag

SEQ ID NO: 59869 - DNA, 1000 bp, Heterodera glycines
  Genomic contig location: Contig_ID=SeqID_29362; Location=88..1087; Strand=+
  SCN-specific regions: Sequence locations=1-105,127-276,299-400,436 -567,589-625,653-722,769-884,906-1000
  Gene Ontology: Mol. function=ATP binding; Cellular component=cAMP -dependent protein kinase complex; Biological process=protein amino acid phosphorylation
ctcctccaccgccaatgcgtctctgatcgattttgaacgcattcggatgatcggcacgggctcatttggccaagttttgctggtcaaacacaggcggacgggcaaatattatgccatgaaaatgttggagaagcaaaaagtgctcaaactgaaacaggtggccaaattgaaaatgggagcagaaattccacaataaaaagcattttaaacatttcaaccaaaataaaaatatttcaaaaatacctgtaaaaaatttttcgaaattaatttcattaattggcaaagttttttcttaggtggaacacaccatcagcgaaaagcgcattttacaggccaccgaatttccatttctcgtaaaaatgcactactcattcaaagtaaatgacataaaattttgaacaaataaattaaattgtatcatttaattaattatttcgggaaataaattgtcgctttttaggacaccgccaatttgtacatggttttggagtttgtcagtggtggcgaaatgttctcccacctccgtcgcattggccgcttctccgagtgccattcgcgtttttatgccacccaaattgtgctggccttcgaatatttgcactctttggacgtggtctaccgggacttgaagccggagaatctgctcattgacgtcaatggatatttgaaggtgcggagcattgggttgagaaattggggacaaagacttatgccagagagtgaattttttaatttgaaaatattttatattttcaattataaattaaactgattagcaatcttatatttttcaaataatcagtagctttcgagaaacaaattgctcggaaataagccattaaaatagaattgtgtagtagcaaatgccaagaagcccgcgaaatgactttttaatttcactttttatacaaaaatagaaaaaaacatctgcagtaaaaaaaaaatataaattacgctttattccatttccttgtcaattacttaattgattttacatttt

SEQ ID NO: 59870 - DNA, 891 bp, Heterodera glycines
  Genomic contig location: Contig_ID=SeqID_29363; Location=84..974; Strand=-
  SCN-specific regions: Sequence locations=1-14,285-316,338-441,497 -639,675-692,733-823,846-891
atgaaggaaatggtgagagacaaaaggagagagaaaggagaaaaggtgagagcgacaaagagaggataagagcgagagagagcgagagaaatagaaagaaaggggaagagagagaaagagagaaaaggagagagataagacacaaggagagagagacagagaaagagagagattgagagagaaaaggagagagataggacacaagcagaagagagagagagagagaggggagaaagaggagaagatagagagagagatagagagagagagagaaagagagagagggggggggggttgtttttttctgtgtgtaactttttattctttagaaatttttattgcttatgtttagggcataaaaaatatggatataaaatggcaaaatatggccataaaatattgacataaactttttggttatttttgacataaaccaaaaagtttaaaaaaatttaaatgtaatcaatattttgacaaattttattaatttttttttggttttagacttggaataaaattttccataatgctgaatttgattcaatgattttttgtcgcctggtgattttgaaaatgggtaaatttgaaaatgttaatagatggattagacaatggaaaatcactaaacaatccaatgggaattaaaataagttgaaaatattttaaatttaaatgatggcatttttgctaccaaatatttttaaaaaatcatttggtggagttttattatgcttaattagaccatatttagcctttttctctctgtaaacatacaacgcatatattacatttaaatatttatgataaggttttttgtcgaccaaatgcttattttgaaaattttcagttggcaaacctgataattagggatgggaatttaagtcaaataaa

SEQ ID NO: 59871 - DNA, 607 bp, Heterodera glycines
  Genomic contig location: Contig_ID=SeqID_29366; Location=131..737; Strand=+
  SCN-specific regions: Sequence locations=1-353,375-442,467-570,596-607
atgaatggagaagccaggctaagcaggacaaacgattcgcgtcatcagccaacgaattggaggtggaattttataggctattttgaattaaaagttagtccaatttgtggtgtagtttcttccataatacttgaattaaaccaggcatttaataaccctaattgattatataaaaaaaaattcagaaattgctgaagcaagtgagcgaagaattggagaagcttaagaaattgaacctgcccgaatgaatcgcggccttgcgattgacatcttattgttagggcagaagcgaatatattctttcttttattgttttataataatcgcggaccttcttaccatttaatgggttttaccactgatctgaaattttggcaattgttttgttcttttgctgctataaatgaatgtctttaaattagagatcggtattttgtaaaaagcctgtacctgtacctgtacctgtattccaaaaatggcctgtacctgtattttctgtacaaaaatacaggaaaatacaggtacaggaaaaatacaggccactcgaggcctggatccaggctgtacctgtattttttaatttttttataaaaaacctttttaatta

SEQ ID NO: 59872 - DNA, 908 bp, Heterodera glycines
  Genomic contig location: Contig_ID=SeqID_29367; Location=749..1656; Strand=+
  SCN-specific regions: Sequence locations=1-98,121-203,225-507,529 -833,855-908
atggcaatttttattaccagtgctcgaatggcagaaaattcccgagactcgagaccaaaacgtgtggcctcgagactatcgaacagcactaacaatcacttccactgcagggaagctgttcaacgactgcacaatgagcgcaacaccgtgttggacgagttgcgagtgttggcgggcgagggaaagctcattgagcaagccgagaagacgaaaaaagagttggaggaagagcgacgcatgcatgccgaagcaattcagcaaatcaacaaggtcaatggacgaacattaattagtatttcatctaacatatacctaagacaaatctcgagagattttcctaatttccggcacgtgaaaaaatcaggcataattacgtggatggcatggcatggcttaaaaaatgagacaactctattagagaaaaattgaaaaatgcctaagatttgataagcaaacccaataaggggagacattttcaaatgttacggtatcacagtatatttttgcaaaaaaaaaaaaaaaaattatggcaaaatcttaatttcaggataaggatgaattggaacccgtgctggccgaagtgcgccaaaaaaggcgtcgaacggaaaccgagttgggccaacgatatgccaaagtgccatttctgtgggaccaactgagcaaacgagcgcgtgagctggaagtgccgtgcgcactgatgacaccggagggactgttgccaaaaactttgctgtccgagtgagcagtcgtgctttactttcgcttgatgaaatttcttagaaaattttattattcggggccggggcctggacatgtcggcaatatgggtcatgaaaagattcccaaaaatgggacaaagtaatcatcattaataattcttttaaatccatggattttgttagcgtgta

SEQ ID NO: 59873 - DNA, 831 bp, Heterodera glycines
  Genomic contig location: Contig_ID=SeqID_29369; Location=73..903; Strand=+
  SCN-specific regions: Sequence locations=1-232,257-831
  Gene Ontology: Mol. function=ATP-binding cassette (ABC) transporter activity; Cellular component=membrane; Biological process=cell motility
atgaaaaaacaattggaaggaaagacgaaagagtgcgacagtttgaagggaagtgtcaacgagttacaaaaacaactgatgaccatgggcacaacgacaatgccaagggaattaaacgaactgaagaacgaaaggaaggacctcatgaagaagaacaaagaaaaggacgaaatgattgcgaagttgaagaagaaaatggatgaagactcacgaaaaatggccaatttgttgggacaggaaaagaaaaaggaagaggaacacagaaaaacagtgaacgccttaaaggatgagtaccagcgaaagatagaggaagtgaccaagaaaaaggaccaatcgatagagaaacagcgaacagagaacgatcgattgaaggcggagttgagtaagaatgagaagacgatccaggaacagaagcaacagttggtgaaagaccagcagcagaagacggacagagtgggcagagaggaggcactccgcgagcagaagagacaattgacggagcaacaccggacagagaccgaaaagctgaagactgagatgcgcaaaacggaggaggaggcaataactcagcaaaggaaccaaatgatggaagaacagcgtgaaaagaacgacaaactgaggacggaactgttcaggaagaaggaggaagcactgctcagacagaaggaacaatttgaggaggaaagtcagcagaaaatggacgagttggaggcgaaactgcgcaacgaatacaaactgaaacttgaacagagcgagaagcaattgaggagcgaattcgaagctgaaattggccaattgaagcggcactgcaaccaaggcggcagagactga

SEQ ID NO: 59874 - DNA, 1219 bp, Heterodera glycines
  Genomic contig location: Contig_ID=SeqID_5971; Location=845..2063; Strand=+
  SCN-specific regions: Sequence locations=1-125,186-251,273-288,387 -443,468-562,599-603,717-724,746-761,815-987,1060-1109,1134-1219
  Gene Ontology: Mol. function=protein binding; Cellular component =nuclear ubiquitin ligase complex; Biological process=G1/S transition of mitotic cell cycle
atgcttagtgatcttgaattggctggctgtacaaacttaacagatgcgggctttgttcaattgtcaaaaagttgtcatgagcttgaaagaattgatcttgaagaatgtcttctaatcaccggtcaatttttttttttataaatttaattaaatttaattatttttttatatttatttgtttttttcagattcaactctgacaaatttcaacgggtgcccaaatttgtacagtctttccctatcacactgtgagaatttgacggacaccggtttagccgaattgtgtggtaaatttaaacattttttaattattttaaataaattttcaaatatatataattttttttattaatttgtaagttaagaataaaatttttttttattttctcataaatttaaaggaaatgataaatttaatttgcagatttaactcgacgactcgagaaattttttaaaaaattgttttcagatgagaatttaaaaagcttgaaaatttctgcaaccgaatttcgtacacagctttatgtatttatagaaatagaattttagaaaacattttcaatagaaagttttgggaaaaaacctaaaaataattttcagcactttttttttagaattttttttttgaaaaacttaataatttatcgaaaaattttgaaaaaatagctagaaatttaaaaaaaaaaaaatttttctttacttttttttttaaatttcgggtggcgggggaggacagcggggaggaagaacaatgtgcatccttatttaaattgatttaaatttataataaaaataataatttaaatttaaatttcagtggcccatcgagaaagattgcaggtgctcgagttggacaactgcccaaacatcactgatcatacgttggaatccatgaagcatttgaaggtgttggagcgcgttgatctgtacgattgtcaattggtcaccaaagatggcatcaaaaaatttaaagtaattttttgtaggtaaaaataacatatttttacatactattaaaattatattctacaaaaaaaaatatataattatttattaatagagttcgacattttgtaaaaagcctggtcctggacctgaattccatgtttggatatggcctggatttctggaaaaaattccaggaaaattcaggcccaggaaaaatccaggcttgtttgcctggatccagccaggcctggacatggatttttttttataa

SEQ ID NO: 59875 - DNA, 548 bp, Heterodera glycines
  Genomic contig location: Contig_ID=SeqID_5972; Location=144..691; Strand=-
  SCN-specific regions: Sequence locations=1-186,208-346,378-403,425-548
atgcctttgaagcccatggtaaatgccaatgccatgattgaagacattggcattgccacgacaactattgacaggtgggaccgtgaaatattaatggagacattagatgagaaccactttgatgaaatgatttactaccatgagccaataccgcattggcaggtacagtatgacaggttgaggtgcttataatttaaaaaaaaaataccgaactgggctgtacagtgtgccagtgtagtgtttaggagtggaagggcatttcctaaattgcgccaaggggttcgaaacaaaaaaaatgtagcacataaaaattcatatcaaaaatgggtacccccctaagaatttgattttttttaattttatttaaattaatatttcttacagtttcgaaaaaatgcatttttggtatttatttaaagaaaaattcaactttctctgtgattcggacagtgaaatttaaaattttatcattatttttcgattttttgtgctaatatgcatatgcttatttcgtgtttaattgatgaattttttgacgcgtaattaaa

SEQ ID NO: 59876 - DNA, 210 bp, Heterodera glycines
  Genomic contig location: Contig_ID=SeqID_5974; Location=453..662; Strand=-
  SCN-specific regions: Sequence locations=1-210
atggcattggcaatgctttgtgccacaattttcttggtgcaattaattttacaacaacagcacccgaattgggctgccgctggtgatgatcgagaactcaagaccatgatcgaaacgtgcgaattcataacggaacgcttggcaccggaagggatactggaaaatttggctgtcattacacttggcacagcgattgaggcacagttttaa

SEQ ID NO: 59877 - DNA, 71 bp, Heterodera glycines
  Genomic contig location: Contig_ID=SeqID_29373; Location=640..710; Strand=+
  SCN-specific regions: Sequence locations=1-71
atgcgaataatgcgaaaggcgaaatgcgaaaagcgaaacctaggcacatccctggtttatatggttgccaa

SEQ ID NO: 59878 - DNA, 661 bp, Heterodera glycines
  misc_feature (138)..(138): n is a, c, g, or t
  Genomic contig location: Contig_ID=SeqID_29374; Location=224..884; Strand=-
  SCN-specific regions: Sequence locations=1-131,178-271,385-431,462 -513,552-661
atgcaaatttcattatacctataccgttcgccgcgtggcacttgcttgggcactgctggacccaggtgcggcattgaaaagtgccacatcgccaccgctgggggccgtactcgtcgtggggtgcgcatccttttttanatttattattttattttttttaatttttaattttaatttacaaagtcatcgtagataaaaatttcgtctggcactgagtgggaggtaagttgatgatgcgccccctgaacgttttgaagttgatgatagactggctgctgctgctgtctttggagccaagcagttatttgttgttgttgttgatggagctgatgttgttggggttgtactgctgctgatgctgctgctggttgattttgttgctgtagaggatggggctgtactggcccaggttgttgatgcggttgtacggattgttgttgttgttgttgttgttgttgctgatgatggaccaaatcagatagaaatgcttgttgccatggcgaaaagtgtgacatttattattattgttgttgttgttgataatattgccatggcggaatgttttgtgtcccccatggcccgaattccgcatgttgttgatgttgtggttgctgctggttgtagttgtggtcgtgaaaaacagcggtttgattttctgtaa

SEQ ID NO: 59879 - DNA, 389 bp, Heterodera glycines
  Genomic contig location: Contig_ID=SeqID_29375; Location=355..743; Strand=+
  SCN-specific regions: Sequence locations=1-137,183-389
atgccgcagaaactgctgatcaaggaaaacagaaagaagaacatttggtgtgtccgcattgtaatggccacataaaacctggagaattgaaaatgcaattaaagggtaaacaatcgccagccgaacaacaaaaagtgaataattaattaaatattatttttaaaaaatataaataaatttaacaggaaaagccgaaagtggcacgagagcgccacccttggcacgtgatggacgatgtgcaaattggggaggaacatttgccgatgaataaaggggacgacgatgcccatttgagaatggaaaaaaagttgactcgcgaaacgatcggcgaacaaccaaagttttggacggaatcttctgattattgaaatttatgaaaaagcgatcaa

SEQ ID NO: 59880 - DNA, 650 bp, Heterodera glycines
  Genomic contig location: Contig_ID=SeqID_29381; Location=433..1082; Strand=-
  SCN-specific regions: Sequence locations=1-52,116-318,340-484,518-650
atgggaaaggagaacgaaattaatggctcggaggggaatagcggcaccaacggaagtgaggggcaaaacggaatggaggaaggaaaggaaaaagtgaaggaggaagaggaggagacaaccagcgaaggttggatggcttttacgactactatttgcacattaacctaattgactacttattggcacattaaccgcttcccccccccccatcattaaggctcggattaccctgtttccgatcacgacaccgccgactcaaacgatttttgctctgacaaccccgaccctgctgaagagcagttgtggaatggtcgtgcctttttaaaaaactaattttaatgctttttgtatgatttagaaagttgtcaaaaagccgctcaaagtcagcagcagtcggcgaaaatttgaaaagagtgctaaaactttggcaacaatttacactgactgtttgtgcatggcaactcattcaaaactggcctattcattttagaatttatttatttatttttctttgttcgtgcgtttcttttaacattaataagggtccataattttgtgcttttaattgtttaccctttgatctccatgtgaattctcccgcgttaattgtccaactcaattgttatcgttaaaaagcaattatgaataaa

SEQ ID NO: 59881 - DNA, 337 bp, Heterodera glycines
  Genomic contig location: Contig_ID=SeqID_29381; Location=1..337; Strand=-
  SCN-specific regions: Sequence locations=1-147,169-280,302-337
  Gene Ontology: Mol. function=NADH dehydrogenase activity
ttttgcttattatgtttgctaagcatttgcgcaatttcccttttggctgttcttttgctgcgcgtcccttgaggcgatactcaggtggagcatttcgttcattaattgtttcttcatacgtattcctttcattaagcccatggactgcaggtgcacagggacaacgagcggaacaatccgaacacgcctttccaatttacggaagccaatttggccaaaattacggtgctgttgaacaatttcccggagggacataaaggagctgctctcattcccgtgttggacttggcccagcggaagcacgggtggctgcccatttccgcaatgcacgaagtgg

SEQ ID NO: 59882 - DNA, 365 bp, Heterodera glycines
  Genomic contig location: Contig_ID=SeqID_5975; Location=717..1081; Strand=-
  SCN-specific regions: Sequence locations=1-176,209-343
atgaccattccgaacttctccgacaacgacgtgggctcctacaccttcccgcttgaacagtccaacttcagtgcaatgaatggacccaatggatgcgaactccagggaattggctgcacaacattgaaattattcaaaaagaactgattgtatggagaacaatgatgaatgatcagattggaaatgaaaataataattatccaaaaaaggatcctcattggctgcagtttttgcatttaccattattacttacatttgattactcaggaaaaatgaaaattgatcactttctcaaattatagtacattattcatctttaatcaacataaccgaaatctttatcaggagagtcaaatttaaataaa

SEQ ID NO: 59883 - DNA, 1238 bp, Heterodera glycines
  Genomic contig location: Contig_ID=SeqID_5975; Location=1158..2395; Strand=-
  SCN-specific regions: Sequence locations=1-17,54-353,445-629,731 -917,971-1001,1154-1162,1185-1215
atggaaaatgatgtgagattttaaaatcataaaaaatgtaaattaatttaaatgagatgaaaaattagggagaatgtccaaacaatgaccgcattcatttgatcgaacagcaattgcacaattgccaaaaccaaattgaacaaattcaatcactaattcaccctcctttgccaccacccgtgccgcaacaaatggaaacaaatcccgcggaacacatggaggcttatgttttaccgcaactgaacgcttttcctcctacgcaacaacaacaacaacaactcatttttcctcatgagcaagaatttcatgctcagcttcatcaagagtgttctgcagatgatatttatgaggtcaataatataagttttaattataaattaaaaaattaaaattaatatcctttcaaatttcaaataaaaatgtaattatatatttagtaattatgtgctttttcataattttttagctggaacgaataattgaccaccgaatcaatgcgtatggcaacgatgagtggcacgtttgctggagcggttataatcaaacaacttgggagccatgccaaaattttattggacaagatgctgttcaaatgttagccgattttgaacatgctagaaaaaaggtctaataaacataatgaaattaataattaaatgataaaatttaaataaataaaaattaaataaatttaaaattatatattggaataaattttaaaaaactaaattttttatccgttttagaccgtactccatctcaaattgggtacatttttcaaatatgaaactgtacctggaaaatttatggtcaaacgccaaactgcaaccagcaatgagccgcagtatttgtttgcaggccaaacagcatggaccacaaatggagtgatcaaattaattgtgtttgtgtggttgtgaagagagatagagagagagagagagagaatcagagagagagagagagagagagaaaatgtgtatagagaggtaaaagggaataaggagacaaagagagaaagagagagagagagaatcagagagagagagagagagagaaaaaatgtgtatagagaggtaaaagggaataaggagacaaagagagaaagagagagagagagaaagagagagagaaagagagagagagagaaagagaggcaaattctgagagagaaatattgagaaatgcaaatgaggtttagagagatgagatagataaaaacataatgaaaatataataaa

SEQ ID NO: 59884 - DNA, 1766 bp, Heterodera glycines
  Genomic contig location: Contig_ID=SeqID_5977; Location=666..2431; Strand=+
  SCN-specific regions: Sequence locations=1-111,143-1124,1159 -1163,1185-1192,1215-1649,1679-1699,1721-1766
atggtgaagggacagaatggcattgcgattgcagatgatgagcttggcggtattatcgtattattcatatatttttcacttgtcccaattttcattcataaaatttggcacattttattttttcaaatttttattaattttacccatttttgtagcctgcggcgtgtccccagtgggccgtggcggaggatggcaattccttcacctggcaatgactaaccgacggtgcacggatgtaattttggcagcacttaaaatatttgcattcattttttgcctctgttctcccattttgtcaatgtttattttcaatttcactcccatcgggattgaaaagccgggatttaatttgaatttaatttgaaactgcttaaggtattcaatatgtccgtcgttgctggccatgaattgatgcacgcgcttggctttgtgcatgagcaaagccgaagtgatgcccggaattacgtcattttacggaaaaatgatggagtaattaacaaacatttcaatataatttttcatttgctcattataaagtattccaaaattgaccaatacacgcaaaactttggcttcgcttacgatttcgggtcggtgatgcattatgaatctgggggcaatcataaaaagtatgaacggttggattttaattacctaaaattggaattaaagaggcttatacgacctgatcactttgccacgcttttaccaacaaacgattggccaacgcgaacaaatctctttcaaagacgcggccataattaaccaaatttattgcaaaggcaaaccaattaaacataattaagtaaattttccatttgttcagactcatgcaaaggccatgaggacaagtgccaaaacgggggctatttgaatccgaatgattgcacaaaatgccattgcccggacggaaacggtggccaatactgtgccgcactcgaagagagtgagcaattaatcaattcaacaattaaagcaattataaataaatttgaagatttgaattgcgaggatttgagtggaattccgagagaattggtggccaatcagtcagcagtgttattgaaaacgaaggccaaatatgtggggaataagccgtgccgatgccattggcgaattaaggcaataaataatatttttgaaaattttaattattttgagtgttattaatgcaaattttaattgcttttagcctgaagcagggaaaaaggtgcgaattcagttcaaaagtttgagcaatttgtttgaatgcacacacaactgctcatcggcgtatgtcgaggtcaaataccgagccgacaaaagagcccaaggcaaaaagacaaacaattaactaattaatcattaattagcaaaatgatggctcattaaggtgccaaactttgttgtgccgcatcactcactgatctgaacgcaaatgaatacaaaaattggattgaggcggaaaacccggacatggacattgtcatttccgcgcacctttcaacaaaatggaccgtatcatctaccagggatcacacggaattacgacgatttccgatcgccattcttggggttggaattccgatttccgaattttttgataaaaattcagaaatttttggaatttttttttaattagcaatttttatacaatttctgtatataaaatgcactgaaattttgaaaaaattttcccggcggcgcctttcggccttgaaataaccttttatttggttaagaacgtattcaaactgacgtatgaatcaggcaaggaaaattgaaaa

SEQ ID NO: 59885 - DNA, 286 bp, Heterodera glycines
  Genomic contig location: Contig_ID=SeqID_29384; Location=5..290; Strand=-
  SCN-specific regions: Sequence locations=1-286
atgggaactctgaattatataataattttcccattgaccccattcgatttgagggaccttttgaatggcaaagttcttgcgcgtcactctctgaaggaattacttggggatcaaagttggttcgcttttgtcttcgttttccatttgttttctcaagacaaacatcttctcgcctccgcgttttctcttcgcaaaaatgagaaggaaaccaattcgacttcgatatttttggaattgctctttagcgattttaattcatttgcgttttcctcaaactcggcggatg

SEQ ID NO: 59886 - DNA, 677 bp, Heterodera glycines
  misc_feature (50)..(50): n is a, c, g, or t
  Genomic contig location: Contig_ID=SeqID_29385; Location=129..805; Strand=-
  SCN-specific regions: Sequence locations=1-60,82-677
tgaaaaaaatatttatgaaacaaaaaaatcgattttttcaagtgtccgtntggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59887 - DNA, 586 bp, Heterodera glycines
  Genomic contig location: Contig_ID=SeqID_29387; Location=67..652; Strand=+
  SCN-specific regions: Sequence locations=1-54,76-260,283-288,310-586
gtctgcggtatctatgaacgcggaaaaaaatcagtgaaatttccgcctcgagaagaggatcgatgttcaaagaagcaactcgaagatcccgaagttcagaataaaattcaacaatatgttgatgaagcactcaaacgagttcaagatgactttcaaagggaagaggtcacaaatgttatcaaagcggtaaagcgcatcgcatttcatttgcaaaaaagtctattttagcttgtcagcaaaatcctcgaatctgacttattgactttgacaaaacctgaaatttacaggtaaaagaaatcattagagcctggattttaatgtacatgttttttactgtcttgctatggcctaatacgcatgaaaaacgcgtttttaacttggttgcgtttataacttggcttgaagatttctagcttgaaatttattgatacctaatccggcacgtaattttggtgccttttttaagtttcatgcatttttcgtgcatttttttctaaaaaacaattagtagtaaaaccagcgaaaagactacattaaacattcttggtatcattagatagcccttgaaatcctcatcttaatgaaa

SEQ ID NO: 59888 - DNA, 1181 bp, Heterodera glycines
  Genomic contig location: Contig_ID=SeqID_29389; Location=602..1782; Strand=+
  SCN-specific regions: Sequence locations=1-226,265-309,331-334,359 -586,608-836,859-1181
atgccgcatccgttcagcggaatttatgtttcgtggttcttcaacccgcacatgggataccaggaagatttggacaaaattgtttgtcatactgttttttttcattattttaaatgttaattccattacagtactacaacaatgtgcacgactttcacaattacgttgtggttactgtaattatgggcacatacctggcgttcagcatcttactgtaattatcagcaaaaaaatttataaacaaaaataattaaaataattttagcatcatgaaaacgtacaagtttaaatcgtccacccagcaaagttattcccaaaaaatggtaaaaattccaaaattaaaaataaaaataaaaatgcattttaaaatttcagacattcatccaagttgtgctgatcagctcaatcaacgcatttgctgctggaatttatgtgtacatgcaatacttcaaaatcagcaaagcactgattgtgattggccaactttcatggtaaaaagcaaagaattacgaaaattgttcaaaaaaaattttttttcaagctaatttaggcaattagattagcaaagtataattgttgtcattttctttacttatataatgaagaaaaattttttggtaaattaattgccgagcaataaacaatagtagaggctgcagaaaaaacatttaaattgttgtcgatgaaaaatgatttctgctgatcacctgcgctagaatttatcatttcttccaaaaaaatcaatttcataaatatcaaaaaacataattcaccgattgggatcattttcaattagtgattgaattcatttaggccttagaaagtccaaaatcataaaatataagataaatcaaaacattattcttcctatcgaaaccatcgggaatgatgatcatttttaaaggctgttcgcccatggcattccgtcactgatctatctgtgcttgaacaaaacaattcgcaaggactgcttgaagatgaccaccggattgatcagtcaaatcactggcaaaagcatcatgcaaacgaacacaacccgaatgcttaacactatcaatgtgctcacaattggtggtggacgcataaacatggcgaccgcgtcacggcacggcggtatgagccgagttgtgccgacaaattcaaccatgaacacaacgccaacaaacaatggtgaacgccaa

SEQ ID NO: 59889 - DNA, 299 bp, Heterodera glycines
  Genomic contig location: Contig_ID=SeqID_29391; Location=686..984; Strand=+
  SCN-specific regions: Sequence locations=1-203,283-299
atgatgagcaaaacgagacgaaggccggagattgtgcgaaaaacaaattgtgaatttcaattggaaattttcgtttcagtgccctccaacccaattgtggtcattgacattgaggcgattacgttcaagaagatgttacgatttatttacacaaatgatttaagttccattgacggagacggaattgacattctttatgctggtaaaaaatattttaaaaatattaaaatttaaaaaaagaaatatttatttatatacagtttttaattttatttttatttacagccgaatatatttaa

SEQ ID NO: 59890 - DNA, 477 bp, Heterodera glycines
  Genomic contig location: Contig_ID=SeqID_5978; Location=797..1273; Strand=+
  SCN-specific regions: Sequence locations=1-87,124-182,204-477
cgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtgcattctgatttggacatttttcagaaatggctaacccaattgcaaccaaaaaacaaaaagtaaaattgtcttacgaaggccgcctttacaccttcgctaaaatgagttctgatgggatgacaaaattttggagatgcgagttcaaaaaatcaatttcacattattttggagtttctccggggaatttctcgcaactatcgaatgaacccgtgaatttctgttaatttttacat

SEQ ID NO: 59891 - DNA, 2025 bp, Heterodera glycines
  Genomic contig location: Contig_ID=SeqID_5978; Location=2790..4814; Strand=-
  SCN-specific regions: Sequence locations=1-5,31-57,79-352,397-467,489- 492,515-540,579-863,885-1467,1501-1593,1615-1642,1664-1781,1816-2025
aaatttgtttaatttttcataaaaaccagaaaataaccaattttttccaaagttcacaaaattaagaattttttcaatgaaaatctgctaaaaatatggtcaaaattcttaattttttccccggcggcgcctatcggcaccgccggccccccttgttccccaaaagttttttggaataagcgtgttttgaataaagttgtaaaaatgaggctttttgactcaaaatgaggctttttttgcataccaaatgaggcttttgaaacttttaatctgggagccctgttttttttgcattttaattttgattcataatttttcagttgaataaatgcaattatttcaaacgtagtagtaatttttcataatttttaagaaataagaaaatttttaaaaaaagtaattcccctccaagtagttgtttttcttctaatttttcaaaattattcatttttcggtgggaattcaatcataattttaacaattaaattcgtaaaatattttcattttttggactaaatcagttaacaaattgcacttaaattttaatgaatttttgttttgtgcgtttttggaatgataaatattgtaccaactgaatcaaaatttaaaaaaaaaccaaaaattagttaagaatagagtcaaaaaatgtttttaacgatttttaagcgaataggaaaattttttgaaaaaagtctcgagtctcgggttttttgggtctcggggttttcggtctcggtctcggggtcgagtctcggtctcggggtcgagtctcggtctcgagtctcgggaaatttttggtctcgaacagcactagcagatacacctatccgtagctgcccttcgcacacattttccactatttatgtaattaaagagaattttgaaataaagagacatcaaagatgaataagatagaacatgttggccgttggctgttttccggaaaaataaaaaagtaattgttgatcaaaacaaccttaaattgtgatagctattcatcataatttttcgatccattaaatatattcccaaatggtgttttcttccgaaatgaatgcccgtttgcttgagcttatccaagctcgaaaagaccaacttttcccgggctcacgccatgctgacgcaggccgaatgcaaaaggaagcatggtcggcggttactcagattttaaactccgaattccctctcgatgtcccctccgggggcctaaaggttcagcaggtgcaaactcgttggaaaaatatccgccaaactggtaaagaggacgcacaaaaagacaaaaagtaattatgtccgtctatcatggaataattgaaccttaagacatcgccttgaattttccatttcaaattgttgttggcctaattgattgcactcacattcctattttaatgccatccgaggcccaacatggaagagattactataaccgaaaaggctgggccagcataaatgtgcaaggcacgcaaaataaataaaaaaaattaaataataatttaagcaattgttgaccaaaaaggccgcttcctaaacattaattgtaaatggcctgggtcgactcatgacagttttatattgcgtcattcatctgtatgggaagattttgaaaacaggcgaatacgaggtgttttattgggtgagtaaaattttaaggaaatatttccaggagacagcggttatccatgtcgtaaatggcttttaacgccatttgcaaaccccagtactaatgtgcagcaacattataacaatgctcatactaaaacacgagtccttatagaacagacatttgggcgatggaagaaaagattccatgctcttcaaactccaataagaattaaatttgaaaatattggcatgtttattgtggcagccgctgttcttcataatattgcaatcatgcggggtgttcctgaatttgatgaggaagatctggttgatgaacaaccagaaacagaaattatgttagaagaaaatgccggtgatggttttgcagcccgagctagtgttacacaaaactatttttca

SEQ ID NO: 59892 - DNA, 132 bp, Heterodera glycines
  Genomic contig location: Contig_ID=SeqID_5978; Location=6710..6841; Strand=-
  SCN-specific regions: Sequence locations=1-132
tcagtgctcccaacgatcaaacagaaatttgaagaagtgaaggaatgggtccatgagaaaacgacgacagtttctgttgagggaccgcaggagaaagagaagtacaaagtgatcgaattggacgaaaaatag

SEQ ID NO: 59893 - DNA, 193 bp, Heterodera glycines
  Genomic contig location: Contig_ID=SeqID_5978; Location=6651..6843; Strand=+
  SCN-specific regions: Sequence locations=1-193
taagttttgagcatttattccaaatggataataataatcgcgatttttcgattgttttcctatttttcgtccaattcgatcactttgtacttctctttctcctgcggtccctcaacagaaactgtcgtcgttttctcatggacccattccttcacttcttcaaatttctgtttgatcgttgggagcactgact

SEQ ID NO: 59894 - DNA, 1035 bp, Heterodera glycines
  Genomic contig location: Contig_ID=SeqID_5979; Location=794..1828; Strand=+
  SCN-specific regions: Sequence locations=1-157,179-415,438-663,685 -707,759-1035
atggccgagatcgattggatcgacgaatatttggggaagaaagtaagcgggggggggggaagttagaggacgcgaatttgtggccaagagggaatgatttggcaagtctttcggaaccaaacaatttcaaaacaattgacctttgatgtgggccgccatatttgctgtgccatttaattggccgtccgttcagccgcgatggcccgccggtccatccttcgtccaattagaggcctaattgatcaatcgcttggctttcctccttcacaatgttttctgatcgcccatatttcaattaaaaaagtgataaatttattcgaagaatgttcaccattttatacgaacaaatctgctcaaaatgggctgtttctcggcaatttctaccatatgatttggattattttattatgataaaggggagaaaaacaaagacaaaattttgtcctaaggaatttcttatcattttgccctattcttcttttgtctgatcgccattgaagaatgaatatccgcgccaaaattggcaatttttctggccaataatctgatcaaaaaaacggattaaaaatgaaaacggaaaaaagaaatcacaaaatgataatgaaaatgatgataggagaaaagaaagcttcttagaagtgtttaatttattgtaattttcaaataaacataaaaatgcacagagaaatggcctaaaaatttcattgaaataaatttaaaatattttaatttcattttgttacattattttattaattgatctcacggcacatttactcgcattttcagctttctattcgaaatgccctctcttaatttgaattacacatcttaattattcacatcctaacaaaaatagaaacgacgaatttgtgtttgttggtcaaggacagctcaattgaattcaattttcagcttttcggatcacggcatgcagcagcagctacggcacgagacttaactaaatgtgcagcattggcattgttgtgtagcatccacaagcagtacaaaaagcaatccaacagcaacggctaa

SEQ ID NO: 59895 - DNA, 153 bp, Heterodera glycines
  Genomic contig location: Contig_ID=SeqID_5979; Location=1..153; Strand=-
  SCN-specific regions: Sequence locations=1-153
catttcaattgcgctaaatgtttcgtccctttgtcattttggcgttttgcctttttttcctttgcgctgtcgaccgttcaaatgccggcggaatgtttgaggatttgctggagggaataagcgacaaatttagtgaggggctcaagtcaatgc

SEQ ID NO: 59896 - DNA, 1565 bp, Heterodera glycines
  Genomic contig location: Contig_ID=SeqID_29392; Location=140..1704; Strand=+
  SCN-specific regions: Sequence locations=1-40,79-80,102-185,213 -222,247-301,340-479,523-546,568-658,729-1344,1525-1565
atggttggaatgcgaccagaaggtcagttgaaaaacatttaaataaaattataaaaattaaaataaaataaaacaaaaaaagaacaaaaattaattgttttaagaagtgcaaacgaaaagaagccaaaaaagaaaggcatctgttaatacggcattatcagaagcggaaattcaaacaaatgcaaaaaagaagaagcagcagaaaattggaacgaaaattgaaaatgagaaacaaatggtaaaattaacgggaagaaatttaaacgatggaattaaaaattaggcaaaaaatgaaaggtggataaataaaaatcaaactatttaattaaaaataaaaatgttttgaataagaaaaagaatttggcattggcaaaggatgagccaattgcttcagtcttatcatctcaacaatcactgatcacacttgtaaaaagcgtgagaaaaaggatcgaatttttgcgcttaaaacgacaaaaggcatttaaatatttaaatttaaattaaaacaaaaaatatttaaaagggcgaccaatgtcttgtcaaaaagttggacatttgccaattgtgtgagatatttgagcaagaaaaggcactgtttgaggaatgccttttgaacgacgcgacggtggacggagaacgattgtttatggtgagcatcaaataaaatatttttgattaatttaaaaaagtggaaaataattaattaattaatttcaaataaattatttgtttcaatttgttttctctcttagcaatgccaaatttcgctggatgaccgacagcaaattgtgctgagctggcttattttggaaagtgccttttgcacattaaactgtggaggaattcagacaaatcgtgcgtatttgccagaaaagggatttgtggagctccacgtggacggattaacggaattttacaaatctaaattcgccctcgaagcaaaaagtttggccaggtgtttgcgaattcagcagaactgaaatagttttatttgcctttaaatggagtgcctttgtttcagctttgctcttcccattggcaaattctttttggaaagtctgtgccggtcgctccaaatgagccattttaaagggcgggtatattctatttatttaagccttgcatcgcaatttaattgggcaattaattaaggagtgtacatttttcaggaaaaagatgcaattttcgcacttttactgctcaatgcccaacccaattttgcgagcacttctgatccaaaagtcgtttcgtgccgagaacaattgaaacggcaaattttcaaagaagttttgctggacgaaacggtatcgcaaaacggcggcatttcgagtggacaaacggtgcaaaatgagcagaaaaagaaaatgaaaacggaaaaagaggcgaaaaaattaacggaaaaaacgcagaaacaaaatggggagggaaaaaggaggagagatggcacaggaggagaagaagaagcggaaattggcaaagggaagaaggagaaggaaaagcaaatggaagagcaaaaggaaaaggtgggggcaattagtaattgtgaaaagaaagaccatcactaa

SEQ ID NO: 59897 - DNA, 346 bp, Heterodera glycines
  Genomic contig location: Contig_ID=SeqID_29395; Location=876..1221; Strand=+
  SCN-specific regions: Sequence locations=1-97,177-199,221-283,305-346
atggcttcttcactcaccattgaaaaacgctgcaaacttttcaacacaaaacaaatggaatgccaattcggtaataactagtaaacattttaggggctaaattaattatttatcagatttaaatttgattaaatttaacccaattatttgttaaattatattttgattaaattttacttttagatggaactgaagccggaaaatgtgctttttgtgtaaagcttccgtgtaaatttggagcagttaattgtgcagaggaagtgagcatctcttgtgtaaatccgcaagaattggaaaaatgctgcaagggtaatttacatgtttaatgtctaaattaaaaccaaaa

SEQ ID NO: 59898 - DNA, 105 bp, Heterodera glycines
  Genomic contig location: Contig_ID=SeqID_29395; Location=155..259; Strand=+
  SCN-specific regions: Sequence locations=1-63,97-105
tttttggtcgaccgaaatggcaatgttgtgcagcgttactcgcccaacacagagccaagggacatcgaagcggacattgagaagttggtggctgccgcagcctaa

SEQ ID NO: 59899 - DNA, 67 bp, Heterodera glycines
  Genomic contig location: Contig_ID=SeqID_29397; Location=363..429; Strand=-
  SCN-specific regions: Sequence locations=1-17,44-67
atgtcgacttcatcgtccctatttttggttgttgttgttttggcatctttgctgatctcggctaaca

SEQ ID NO: 59900 - DNA, 580 bp, Heterodera glycines
  Genomic contig location: Contig_ID=SeqID_29401; Location=1..580; Strand=-
  SCN-specific regions: Sequence locations=1-20,89-107,155-172,379 -420,455-489,536-539,562-580
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgaaccgcccccagtcaaactccccgcctgacactgtcatcggt

SEQ ID NO: 59901 - DNA, 215 bp, Heterodera glycines
  misc_feature (174)..(174): n is a, c, g, or t
  Genomic contig location: Contig_ID=SeqID_5980; Location=57..271; Strand=-
  SCN-specific regions: Sequence locations=1-215
atggagacgaacaacatgctttatttggtcactgaatacgcaccaaacggcgaaatttatggtcagagatttaaatttaaaaaagcatttgcattttcttttcagatttaatttcaaaacaaaaaaaactcagcgaggaaatggcaaagcaaaagttttggcaattatttcggncgtggatatctgcacaattgaacatgtgcacagggatttga

SEQ ID NO: 59902 - DNA, 358 bp, Heterodera glycines
  Genomic contig location: Contig_ID=SeqID_5980; Location=1835..2192; Strand=-
  SCN-specific regions: Sequence locations=1-156,238-358
aaacggcgagtcattcgttcggaagggcaccagcagagactggaagaattacatgagcaaggagcaaagtgatcggatgggccgcgcgttcagacaaaagttggccggcacagtggcagagaattggtggagaacggaaatgcgatggaacgaagcggaggaggaggaggaggaagagaaaaaggaggaaaaggaaaacgagcaggagcaaagagaagcaaagaagaaggaggaagacgactcgggcatggaaagcggcgacgatttgttggaacgaagcgccaaagtgtcggacgattcattgcgtttgaacggctcgcccgccccgcaaggaccgacgacgacggacagcaaatga

SEQ ID NO: 59903 - DNA, 713 bp, Heterodera glycines
  Genomic contig location: Contig_ID=SeqID_5981; Location=549..1261; Strand=-
  SCN-specific regions: Sequence locations=1-225,261-575,617-617,651-713
atgcacaaaaatcgcaaaatatgcacaaaaaaacatgaaaattatggcagcctgatcattattattaatttgttacacatttcttggataaacaaattccataaattccatgtgaagtgttttgttaccgattcggcagttattattacgctgtgtaagactatttggtccaaatacaaattccttttaaaagttattcatgcaaggaccaactgaataatatccataaaaacatcaacaaaaacatttattattgttatgtggcgaagtgctgaagtgattgatggtggcaatttttgtaccattccaatgccgggggggcagaaaatcggacaaggcaaatgccgtaattgtagatgatgatgaagttgtcgaagaaacgcaaactactacagcatcaggagcagagtcaatcgttggtcaacccaaggccattgaacaaatggcaggcaacccattggctaagtaagtacaaaaggacaccgagtaaatatttgtaaataggagcagcgaaataaattagtaaatgaaatgctattacggccttactttagttaattaattgctaacctggatttgtaaatagacatctttaatttcaaatttcaattaaaatattggtattttcttttgtgtctgtttaaaaaatgctcttattattcagttaccactggtggatatcaacaagattagctatggataagttaaaataa

SEQ ID NO: 59904 - DNA, 850 bp, Heterodera glycines
  Genomic contig location: Contig_ID=SeqID_5981; Location=2932..3781; Strand=+
  SCN-specific regions: Sequence locations=1-136,158-199,228-537,559 -561,583-850
atgattggggaacaaacattatgtgaattgatggagtggacaaaattggaaatgcacacaaatggaaaaaagaaaaagagacgtaaaaaggcgcattaagcaactttgtcaaaaaaacgaacaatttgtaaagcagatgttgtttggtttttgatgtaatattggagccgaccaaagatggtaaaaatttgtgagttcatgctatttttataactttgttctgaaattttgtaaaatacattaccgtctcgacccatgttttttttgaaaagttaatatcacaggaccaaaactaaaaactgcttaaagttttcaaaaaagcacttaaaacaaaggaaatgcaaatcccactgtaccggctgcacatcgcatgagctttttgtgaccgggtcccggcttttgtcatttcatgtttatgtttttgtttgttttttaaatgccctattaaaattttggcattgtacggctttccttattgaatttgacacttcagtagcaaattttttcatttaaatgaaaagcgccaccctaattagcattttaattttaaaaatatttgtattttcaaattcctttctatttatttgcagattttggaggattaattccgtgggggataggcatctcggatgatgggttgccaatgccttcgacttaagctgttagccattttcagtgttttcaaaaatatgccgtggtttattgacaacaaaacatgcccctttgagtggagtgatttttgaaagcaaaagcattctctgctttttgtatatcgcgagggatttggcaaggataaacgcaaaagggatgagcatatgagcaaatggcacaaaatatttatttacaaaaa

SEQ ID NO: 59905 - DNA, 151 bp, Heterodera glycines
  Genomic contig location: Contig_ID=SeqID_5982; Location=1162..1312; Strand=+
  SCN-specific regions: Sequence locations=1-151
agtcggcctcgtcaagaatccgcaccacattctgttcctttatgatgtaccgttgcggacgttttctgcttttctgaagatgttctgcgcgtccgatgtccagctgtttgtcgatgtcccttgtgaatgcagtaatgaagtcactcaatga

SEQ ID NO: 59906 - DNA, 757 bp, Heterodera glycines
  Genomic contig location: Contig_ID=SeqID_29402; Location=382..1138; Strand=-
  SCN-specific regions: Sequence locations=1-136,160-757
atgagccagttgtgctgcttgaactgcagaaaacctacttcaacaaatatgacggtgtgtcatgacagacgaaacgggtcactgggccccgaccaacagggccacggatcagttttttgggtataattgctttcatagttatccgaattgaatgaattccatttcatttaatagccctacgttttctctattagcctgcaaaatttcaaaaaaatattcattgaattacaaaaaatttatagacataaatttttggaaatcgtttttttttttagcttttttatgataacctttttgtaaccccaaccgaattttttgaaattttgcaggctgatagagaatactttgggcttttgaatgatatcgaattcatttgatccagacaggtatgcaaggaattataccataaaaactgatccgggcctgtcccacctcccaaaaaaaacgcaaaatccaaaattttttttagaagactgtaaaactttttgtcccattgttcagagtatctgaacaaggccgagctgcgcaaattcttctccaaaggccacatcaagcaggtgttcgaaaatttcatgcccaaggacgtggaaatggccaccgatgtgaacgcgaccggcagtctgttcataaagatgaagcgcccgctgcgatgtacgtgtcggcagaccgggagttttcaaaacctcaacggggccatgaaatcccggaaaagtcagggattctcggcccctacgtccgaccggtcactggattttag

SEQ ID NO: 59907 - DNA, 49 bp, Heterodera glycines; identical to SEQ ID NO: 51181
  Genomic contig location: Contig_ID=SeqID_29404; Location=534..582; Strand=-
  SCN-specific regions: Sequence locations=1-49

SEQ ID NO: 59908 - DNA, 852 bp, Heterodera glycines
  Genomic contig location: Contig_ID=SeqID_29405; Location=172..1023; Strand=-
  SCN-specific regions: Sequence locations=1-129,152-226,248-259,281-852
atgtcggaaaacgaaatttattatagaaaatgtcgaaacacggaaattacaacaccgaaaatgtcgaaaaccggaattccgactccaaaaaagtatgtttttgtacgcgttcgacatcaacagcagaactgggtgtgtgtgtttgttgttcgacgcggttgcccctcccgccgcccgactaccaaagaaaaggcaattaatcttaaattaattgcttgcactataattgttatttttggaacattttgggcaataaaaattaatggataaaatgaggaatgaataccccaagcattctcctctctctctctctcgccaattgattcggccactcctccgtccctatccgccgttgttttggttttcccatcccaatcggcaacaaaacaaacagacaaaaattgacaaataaaaactaattatcttatcttccatataattagtaaagattcattgaaatttagttgttttttccaccgtttaattccttcaaattgggtggctaaaaagggtcaacagaaaaacaacccatccatcagcagaagctgaagtgagggaaaagcgccctcaaaaacatcgcattttttgccattttttcaaataattcttttatagcaaacacctaaagtcaacaacagagcggtgcatcaatccctcatgccaaaggaatatatggatcaacaacaaaaattgatgaaatcagtcaaatgattgtatacagataaaaaaaatgggggggggggggaaaagacacaaaacaatttgatgataaaaaatttaaaaaaaatgatgacatggatttgcaggaatgggccgggatcgcaaatgataaatggacgaaatttaaataaa

SEQ ID NO: 59909 - DNA, 47 bp, Heterodera glycines
  Genomic contig location: Contig_ID=SeqID_29405; Location=1244..1290; Strand=+
  SCN-specific regions: Sequence locations=1-47
atgggacattcggtgactctgtggacgcaaatggaaatggcaatggt

SEQ ID NO: 59910 - DNA, 687 bp, Heterodera glycines
  Genomic contig location: Contig_ID=SeqID_29408; Location=96..782; Strand=-
  SCN-specific regions: Sequence locations=1-687
atgccgtcgaaggataacaagggcacaaaccgtggcttgttaagcacaggtggcggcacggcaacgcagacacagaaaggcgtcgggacctcttccaacaatcctgctggcccaacccgatctttctttggcatcaacatgttgagcaactcattatcgataaattcaaatttggagttattcggagaagaatcggtatacgctttcgatgattgggccgagcgattcaaggactacttatcggtgtccggaaaaaatctgaccgaaggagagaaagtcacgcgtctcaaattagcgctcaaggacacgccgaggaccctgttcaaggaactcgaggctgaccaaatcgtaactctcaccagcgccttggatgccctgagagccaagttggactcgcctcaacgacgggaattggcgaagcgaaccattgcactgtgccgacagcgtgaggatgaaacggttggccaatttttaaggcgtatgactccgctagttgagtcatcaaatccatcattgtctggtgatcagcgcaaagagaaagtttgtgaggaatttttggacagactcaagccaaacatgagcttcctcattcgtcttgttggccttacgcaagccaagaatttggaattggtcaaagcccaagcagaagagcttgaggctctatttcttgcctctaaaggagatgat

SEQ ID NO: 59911 - DNA, 154 bp, Heterodera glycines
  Genomic contig location: Contig_ID=SeqID_5983; Location=1..154; Strand=+
  SCN-specific regions: Sequence locations=1-154
cggagtgaatttgttgcccttgcgctgattcagagacatttcatttgattaatcgtgcaaaatgataagataattgataatccatcagtcaatcggtcgatttccattttttatgttcgcaatttattcatatataaataattaactgatttaa

SEQ ID NO: 59912 - DNA, 1705 bp, Heterodera glycines
  Genomic contig location: Contig_ID=SeqID_5983; Location=682..2386; Strand=+
  SCN-specific regions: Sequence locations=1-15,37-97,276-287,315 -499,539-562,584-611,634-772,795-885,908-910,932-1177,1199-1217,1240 -1705
  Gene Ontology: Mol. function=structural constituent of cytoskeleton; Cellular component=insoluble fraction; Biological process=post -embryonic development
cgaggcggcggaatgggcggagggatgggcagcggaatgggaatgggcagtggcatgggaatgagtggcatgccaggcggtggcatgggaggaatgagtggtggcagttacggaagcagtgggtacggtggaaacagtggttacggtggaagcagtggttacggtggaaccagtgggggaagttacggtggaaatagtggatatggtggaagcagtggaggaagttacggtggaaatagtggatatggtggaagcagtggaggaagttacggtggaaatagtggatatggtggaagcagtggaggaagttacggtggataaggtggctaacaaaaacaaatgcctattgatcaggggagatgatttctatttttgtggtttattattgtatttgcttagtgcgtaaaatgtagatataataaatttgaactgctattttgaatggattacctaatttaaatcgagaaaagtctatgcaatctatcgaataaaatccctattttattttaaaaaatgttttttggaaaggctaatttgttttgctttagctttagccggtacgatatttaaatagctattttttcgtgtttttccgcttattatgataaaacattcattccgttttatttattaactggtttttaaattacccccccccccacccctcccatttgtgaactaatttttgtttttgttctttttcttttaaatgatttgaatttggttatttgggttctgtctgatgaacctacgcatttttcaatgaattaattgcccaaataaacccattcttttcactaatagtttttctcatttttctccatttactcgtcacaattttcaatgtttttaaataaaccaaaagatcaaaaaaaaaatagacgcaataaaaaaataaaaatattaagccatggaaaaactgatgctaattttttacttcttatttgtttcacaattttttgtgccaatggacggagccgaagaaaaagcggacgaatttgggtaagcaatataaagccgaacatcaatcaactcgaccttttttttgaaattttacgaattcagctttttcaaaatcaacttattcattaaccccatttcacaataatcgctcaaacacattccttaagtaaatcaaaacgctctggcggatacggtggtggaagttacggtagcggaagctatggtagtggggtttatggtgcaacgaatttcggcagcggctttggtagtaatggcggagtgtacggcactagcgggagttacggtgggaaaagctacgggagtgggtcatacggtagcagcggttacggcggccgaaattatggaagtggcggttacggcagtagcagttacggtgggagaagctacgggagtgggtcatacggtagcagcggttacggcggccgaaattatggaagtggcggttacggcagtagcagttacggtgggagaagctacggtagtgggtcatacggtagcggcggttacggcggccgaaattatggaagtggcggttacggcagtagcagttacggtgggagaagctacgggagtgggtcatacggtagcagcggttacggtggtcgaagctatggctagcggaggctatggaggcaggaattttgggaacgttggtttcactgctggcagaggaaccatggccatggtagcggttacggtagtggcggatatggctaattct

SEQ ID NO: 59913 - DNA, 162 bp, Heterodera glycines
  Genomic contig location: Contig_ID=SeqID_5983; Location=4478..4639; Strand=+
  SCN-specific regions: Sequence locations=1-162
actcaattcatttttcttttggcacttctgccatttctgttggtcccaatttgttgtgaacaatgcagttgggacgacgtgaataacatttgcgtgggagattgttcatcactgtgtgtgctgaaagattttgacaattgcaactgcaaccgcttaccaaaa

SEQ ID NO: 59914 - DNA, 76 bp, Heterodera glycines
  Genomic contig location: Contig_ID=SeqID_5984; Location=899..974; Strand=+
  SCN-specific regions: Sequence locations=1-76
tttttcctgagatccccgtggcctgaaacgcacgaaaaacatgtttttttgggctgttgttaagctacttttcgag

SEQ ID NO: 59915 - DNA, 342 bp, Heterodera glycines
  Genomic contig location: Contig_ID=SeqID_29412; Location=799..1140; Strand=+
  SCN-specific regions: Sequence locations=1-92,114-154,177-342
atgaccactttccgcagaggaagaaccgactcaaaaaaaggaaaagctacaacaaaaagcagctccaatcaatgctcgaaatgtacttgggtaaaaaattttggatttttattcatttatagtcaaattttgtttgaaattagtttttttgtacatttaaaaattaacaaataaaaagtggtgtattaaggcggtccaatgggtgaaggagttctcactggcccaattgacctggctgaacttataagcgacattgacatggcctacaacatcacatgcctattggtaaaaacataatttgtagccgtgcatttaacaattaaaattgattttgtcataaaa

SEQ ID NO: 59916 - DNA, 66 bp, Heterodera glycines
  Genomic contig location: Contig_ID=SeqID_29415; Location=108..173; Strand=-
  SCN-specific regions: Sequence locations=1-66
atggctatctctttttttgagaaattttctatgcaacaaacgctctcgaacatgaaacgaagtgcg

SEQ ID NO: 59917 - DNA, 146 bp, Heterodera glycines; identical to SEQ ID NO: 56264
  Genomic contig location: Contig_ID=SeqID_29415; Location=280..425; Strand=-
  SCN-specific regions: Sequence locations=1-79,113-146

SEQ ID NO: 59918 - DNA, 146 bp, Heterodera glycines; identical to SEQ ID NO: 56264
  Genomic contig location: Contig_ID=SeqID_29415; Location=532..677; Strand=-
  SCN-specific regions: Sequence locations=1-79,113-146

SEQ ID NO: 59919 - DNA, 146 bp, Heterodera glycines
  Genomic contig location: Contig_ID=SeqID_29415; Location=784..929; Strand=-
  SCN-specific regions: Sequence locations=1-79,113-146
atggctatttctttttttgagaaattttctatgcaacaaacgctctcgaacatgaaacgaagtgcggtgcgccatggccattttatttttcaaataatttttatatttaatagatattccagaaaaatggctatctctttttttga

SEQ ID NO: 59920 - DNA, 50 bp, Heterodera glycines
  Genomic contig location: Contig_ID=SeqID_29417; Location=954..1003; Strand=+
  SCN-specific regions: Sequence locations=1-50
ctaacccatggaatgcaagaacacacagtgattgtctacacaaaagtgat

SEQ ID NO: 59921 - DNA, 438 bp, Heterodera glycines
  Genomic contig location: Contig_ID=SeqID_29417; Location=151..588; Strand=-
  SCN-specific regions: Sequence locations=1-21,43-306,328-438
gtttctgacattacactgctaaaatggtattatttttgttttgcataatcgcttcgtgaaatttgcacttttccttaattaagggcaaacacaaaaagccgttcattgaccgcaaaagtgcagtgaattattctttacacaacaaacatttggaggaggcgcagcggaccagtaatcgtaaaagtgttgcgaattttcgtccctttgataaacactttgaggtaattcaaaatgttgcgatgaataatttaataaatggatggagcaatgcttataggatttttatgagggatatgcgaatgaagcggaggaggacggagcggaggaaatgcatgacggagaagggcaaattgagaccgatcctgcgcttttctcttctctgctggcggatgggcaatcacagcgatgtggcgaagagcgttttcagcgggaggtgcc

SEQ ID NO: 59922 - DNA, 932 bp, Heterodera glycines
  Genomic contig location: Contig_ID=SeqID_29418; Location=179..1110; Strand=+
  SCN-specific regions: Sequence locations=1-29,52-160,206-431,467 -588,610-932
atggctgattttgtccgtccttttgggccatattttggccaaattgcttttgggtttactcacttcggactcagtgctgaacaattgaaagggcaccgaagcagaagcaattggaaaagccaaagtgatttaaattcatttgaacaaaaaaatggaaaagttttaattatttaataataaaatgcaattgaaaaattattaaattcatttttgagaaaccaaaaaattgacaaattttgcaagagaacaaaatcaaaaaatgagaaggaaaagaaaggtaacaaaaactatcattgataaactaggcaggtgctatgtcattacttaaaaaccatcataatgaaaatttttgcttataactttgctctaaaaagaccaaatttttaatccttgctatcattcgatagatctaaatgttctttatgagcctgtaaaatttcaaaaaattttattaagtttaaaaaaagttatggccaaaaatgttcgaaaatcaaggttttttgagttcctcgagctataacttttttgaaacttaacaaaattttttgaaattttgcagactgatagagaacacttagggctatcaaatgatatcaagaattaaaaatttggttgctttcgagcaaagttataaataatttttcgacaaaaattttcataatgatggttttttaagtaacgcccattatgatggtttttaagtaacgacccagcaccgtttaaacaaggatgatgagcaataacacgtcatatttattgtgggtcaccggcccataaagtatgccgttggtgttctcgcatactcctgatggatagtgacatttaaatcgaaaaatttgaaatgcgttttttgcgctcttttctccaaaacagttgagcaagcaaatagttaaatcacttaaaatagcgactttactaattaaaattgctga

SEQ ID NO: 59923 - DNA, 109 bp, Heterodera glycines
  Genomic contig location: Contig_ID=SeqID_29418; Location=101..209; Strand=-
  SCN-specific regions: Sequence locations=1-109
atggcccaaaaggacggacaaaatcagccatccgttcaacgtcatgacaatgatcatcaaaatgtagccgatcagaagctgaacagcgtacaacagcacatcaaaggca

SEQ ID NO: 59924 - DNA, 958 bp, Heterodera glycines
  Genomic contig location: Contig_ID=SeqID_29421; Location=87..1044; Strand=+
  SCN-specific regions: Sequence locations=1-268,309-382,404-540,585 -702,724-883,905-958
gtccgcttcatctgctacccgcggacttcctccggcgagtgtgaaccgttgcggcccgaaaactttgaaccaggcgccaaatttgaacattgccgagcatttgaatggattcagaggaacaacccaaattggcagcaacagcaaagcatatcgccaaatgacagtgacataatgccaagcaatgccccaaattcaaattttgaacaagcaacgcaacgattgtccaacaaattattctttattagcgggaataccacacgctaattttatttatgcaaattttattttaataaactgtgcattaatttcgcaaaaaatcaacaaattacaaaaactcaatgaaaattaaaaatatttatcatcttgaaaatattatcgaaacataaaaattaaatcaaaataagtaagcctttaatgtattttctaggttcataaaaaattttcatctttcactttttatttaattcacactacaacagtgatttctcggttatgtcagctgacgattccgtcactcacaagcggtggccgcggttcgtcaaatttttcaatttttgattttattaaatttattattttattttgtgccttcagctttttgccgaaaaaacactttgtcatttttcccgtgccgtgccctttttggttgtcattttgctgctgggcaacctgaacagttccatcttcgcctcgtcacggtcaatattttaaaattaccaaaaatgacataaatcgttcgtttttcagttatttgtttgccggtgccaaaaatggcattttgctctccgcgttgagtacggtccatgccaattcgatgagtccgcgggtggacattctttactaagtgcattttcatttgatcatatacaaagtaaatcaaaacaaataataattttaaagtgttcgctttgatcattctgtcattcatctgcgacttggagaatctgatcggatatat

SEQ ID NO: 59925 - DNA, 2410 bp, Heterodera glycines
  Genomic contig location: Contig_ID=SeqID_726; Location=1306..3715; Strand=-
  SCN-specific regions: Sequence locations=1-445,467-499,521-1209,1255 -1355,1377-1419,1441-1532,1554-1833,1855-2410
atggaggattacgcaccaggatctatgaataaagagaaatacgctaaattcgaaaaatggtaagaaaagagggacaaagcataacaaaaaattttttttcaggtataacgaaaacaaggagacgcccttttatttgaacgatgaattgatgaattattgcagaaacgacacggagattttgctattgtctattattgagtttaggagaatattgatcaacgatattacgaaaggatttgaccccttgccgaggagttgtacgaatgcgggggtcgcgatgaatatttttaaggcaatgtttttattgaatgagcaattatcgattgtcccggataagggatatgagcggtgtgatcgggccagtgtggtggccattaagtatttagagtggcggagccagcgagatggagttgagatacggcacgcagggaatggacgagaggtcaaagttggaaaatataaattggatggatttattgtgaatgaaggaactatggacaagtgcattgaagtgatgggatgctacatacatgggtgtttgaattgttatgaccccgcggcggaactgattggaggaaggacagcccaggaattgaatgatgagacgcaggagagattggcggagctgtggaagactttggacgtcgaagaagtttgggtatgtttatttgacttttgcattttttatctccggttttttctaggggtgtcaaattgagaaggaattgaaaaaggatgaggaaatgagagacttcttcgcggacagaggaaatgagaagggaccgattgatccgcggatggcttatgcgggagggaggactgggccgatgaaattgtttgcgaaatcggatgagaagaaaaagattagtgtttacgatattgtgagtctgtatccgtcagtgaattacggtacagcttacccgattggtttgccggagattattataccgaagagtgatgagattaatgtaaattggacgagaccggaggatttgaagtataatgggttgtataaagtgagggtcaacccgccgcggggtttgcggattccggttctgcagttgaagtgtgatgagagattattattcccgttgtgttggagatgtgcgtcaacatttaagaaggaaactacgagatgtaattacaattgcccccatgatggggcacagcggagatacgtggcgacgtacaccagcgttgaattggtaagaagttatgtgggaaaattttaagaaaatttgacatttcaggcaaaggcgttggaatgcggttatactgtggacagattttatagagcgtggcactacgaagaggaggcgaatgatttattcaagggatacgtgcgattatttttgaagctgaaggaggaggcgagcggtttcccgaagggggttgagacgggggagcagaaggatatgtggagagaagagtataaggaaaaatatggaatcgacattgaattggctaaagtgaagaagaatccggggttgcggtacataagcaagttgatgctaaatagtttatgggtaagaaaattgaaaataaattacgataggtaattttcactttcagggaaagttttcgatgagaaattgtttgaacaagaatgcggtgatagatagggcgtcggagttttataaaatagcgtgtgaccataaaattgaattatgtgatattgttgagtattcggatgaggcgattagattgatctacagggacaaggaggactttgtgatggagcacaagtccagcaacatcgttatcagtttatggtgagttcaaaaattataaatttgtatataaactaattttcaggacgacgagtatggcgaggttaaaattattggaatttatgagagaagcggagggaaatggaggagaaatattgtacacggacacggacagtatatttgttaggcacgatcgggatgtggagccgatcacgacggggaaatatttgggagagatgagcgaggaatacggcggctatgagattgaagaatattgttgcggaggggcgaagcagtacgcactgaagatgagaaacaagcagacgggggatattgaatatgttatgaaaattagagggattacgttcgacgtggacaacaggaagactttgcactacgatacattcagggagatggttttgaattacgggaaaggggaagtcgacccggcgttcttcgtctacaagaatgattttgggtgagtttttcaaaaaaaaatatttgcatcactaataaatcaatatttaggccaacgcgggattcgaaagtggtgacgagggagaagcataaaatgtacaggccggtctgccagaaggggatcatcgatgaggagcttaatgtgatgccatttggattttgttaattttgtattttattgttgtttttttttgttaaataaa

SEQ ID NO: 59926 - DNA, 2194 bp, Heterodera glycines
  misc_feature (2110)..(2110): n is a, c, g, or t
  Genomic contig location: Contig_ID=SeqID_727; Location=9..2202; Strand=-
  SCN-specific regions: Sequence locations=1-79,102-106,130-630,740 -747,983-1661,1683-1759,1783-1814,1852-2135,2164-2194
atggctgcaaaacgcaatggaacctctcaacaaagcggaccgtcgactaaaaaatgggattttagatcaatcgggtaagtaatttttaataatatatttaagagacaattttattcaataatttttcagaaacaattttattgaagaaatggaaacttttaaattgatggattatcgttcgacgatttgcgaaaaatttggatttacgaagaacattgcggaatttacgatcaacccggatgtgggacgccccgatgaagcgattaaggacgcggtcgacaacatgatcaaagtggcttttaagactacggaagaaaaaatgaatcggaaagtgaggatgtttggagtggtaattacgggcgccgggcttgctttcccggtgtgggtgccgtatcgggcgttcccccagaataatgcggatgtgattctggaggagattaataagttggggcagagcggggacggagatgaaaataagaaaatgctgttgctctcggagcaaattacgatgaaaataacgtgtgtgacaatgcccggtggagaggggccgaggaatgttcataaatttgattttggattcaaggagcatcagcggataaggtaagtattttcaaataatttaatgaagggaaaaaaaacgaatagaaaaaaaaatgaataaaaaaaaacaaaaaaaaaaatggaaaaaacagaaaaaataaaaataaatttaaaataattattttaaataaaatttattgaagcaaaaaaaataaaaataaataaataatgaaaatttgaaaaatatatatgaataaaaaaaacagaaaaaaaaataataaaaaagaaaataaaaataatatttgaatagaaaaacagaaaaaaaaataataataaatttaaataattatttaaaataagcaaaacaaaaaaaaaaaatattttttttaaatcaaaaaaaaaattaataattgaaataattaaaataattataataataatatttattaaggatttctaatggggataaattttgtttgttctacgcactggcttcgtcgatgaattatttggttatggataaatattcgtttattcgttttatgaagaatgttgtgcgacagaaagagacggcatatgaacttttacggaattgtgagattaatggaaatgaaatgaattatggagtggagcatttatcgagtgttcagaattattgggtgggtttttaaaaaaagattctcaaataatgagttttttaggatgagatttaccccagtaaataccgggttgttgcatttgagaaatctgcggatccgcggaaatcaatccgagttttgtggaagggccctatgggtcgtgaaaatgtagtgccgatatttttggagaatggtcattgggatggattaaagaattatgtttgctttttcaatcgtgggaggaagttctgtattgactgtgagtgcttttactcgcgtgatgtttaccacacattggagtgccgggccaggtgttattactgcaatagagttggaggaatgccatgtgaaaaggagagtggagtgaagattgagtgcccaaagtgtcgacgttacttttacaattgggagtgttataattatcatcatggacatcagacttgtaacttatggaggcgttgcgtgatgtgcgataagacttatttatttaatccgaagaaggggcatgaatgcggtgagacttattgccagctttgtagtgtgtgccacgaccccaaacggggttgttatatcatgccgatagaggaaaaagaggaaaaggatgtttaccgtattgtcgtttgggtaagtttaagcaaaaaaaaaaaatatatatatatatacaaaaaaaaaacgccttaatttcaggattcggaaacatcgcaggatacaatgtataagggggaccagaaggaacatattattaaatatatttcggtgagagtgacgtgtacggaatgctgtgacgacaaaaataggacaaattgtaaaatttgcggggatgagaggaccaaggattggagcgaggcggagggacacgagccgacaaaggattttgtggaatggattttaatggcctttacgaattacgatacgtacatttttgcgcatancgccgggcgttttgacggtaatttcaaaatttaatttttttaattttttttaacccctaaatttcaggacatttttgtatttaa

SEQ ID NO: 59927 - DNA, 3722 bp, Heterodera glycines
  Genomic contig location: Contig_ID=SeqID_728; Location=1..3722; Strand=+
  SCN-specific regions: Sequence locations=1-614,637-862,885-919,941 -2375,2398-2430,2452-2534,2556-2878,2900-3505,3530-3722
gacccttagggggtcctagggccatgcattttcccaaccaatcgactcttccaagaactttggaaggagggccactcttgggatgatgccctctcagaagaggactcaatccgctggaattctatccaaagccaatggaaagaagaggaaatcagaattcctcgccgcgcaatgctcaatgacacacagtcaattgagctccatgcatttgtggacgcatcggtccacacattcgcgaccgcgatatacgtacgctgcgccatgaacgaaaagattcaagcgtggctgattttctccaaaaatcgtttgaagccaaagagtgcctcaaaggcactcacgatacccaggatggagcttttggccatcctggtgggcaccagagcactcaaatttgctcaaaggcagttgcgccgtccaattgccagccttcatctttggagcgattcacaaatcgctctgtcatgggtcaaaacccatgaaactcaaccacaatttgttgagcgaaggctgaaagaaatccgagaatgtctcggatgtaccttccactttgtccgtactgcggacaacccagcggacctcgcaacacgcggagcaactccttcggagctccgcaaccatcatctctggtggaaagggccaacttggctcacacaggagagccatctttggcccaactaactctgtttccaagtaacagagtctgaccaacaaatctcggagaatgttggcccgagtggtgcgtttctcgcatacactcactcaaagcagccaaatgagcaggtcttaattgacccctcacgcttcagctcatggaagcgtctaatgcgaacgacaatgttcgtattaagattcctcgccttaatgtttaaaaggggcgaggaaacggttgcttcacttgcgaagcacagaaaggaaattcgccagatttccaagtctggggacttcaaggcggaagacttcgcactcgcagagcgagttctcatccgcctagaccagatggatgacgctgaagaattccagcactttaaaacagtgattggagacgacggaattctccgtctgaaaaccagactggagatgagtgagaagccatacagcttctctcatcccattcttctcgccaaacattccgctttggcaaagctgatcatcttggatcggcaccaaaaaaggcatcaccttggagtggacactactctgacagaattcctgagcgaattctggatgccaagtgcacgtttaaatgttaaacgagctcttcgggactgtcttttctgtcgccgaatgaatgcacaacaatttgcattaccaaccatgccacccttgccgggtgagcgagtgcgccgacacgcgccatttcagtccattggaattgactatctcgggccaacgacaatctcgttggccggagaaaaaataaaggcatggatcctcatcataacatgcctcgccacgcgcgctgtctaccttgaggcaacattggacctcacatcggaatcattcatcaatgttctccgtcgattcataagtcgacggggaaaacccgacatcatttggagcgacaacgctacgacattcaagctcgctcagaaaaccctggagcttctcagtgctccggggccggatcaggaagtacaaaacttcctgacccataatcgaatccagtggcgattcattgcccaaataagtccttaagcaggaggcttttacgagcgcctcgtgaagctagtcaaggactgcttcaagcgaactttgggccgaaggattctttccttcgaccaactcaacacattcgtggccgaagtggaggccaccctcaattacagaccgattactgcggtctcagacgcagtggatggaccaattccactgcgtcccattaatctcttacaaccagagattcagatcaattgggaaacaacaacagacccaattgattcagaggaacagttttcctccacgcacgaacgtttagcttcccgaatacaagcacttcgggaagccaacgacgttttctgggccaaatggcactctgagtatttgacattactcagagaaagagcccagtgggaccacaaaggcccacgactccaaaacttcggagaaccgaaggaagggatggtggtcctaatctctcaggacctcgtcccccgcaatcaatggccaatgggacgaattgttgaaacacacggacggcctggagccatccgaagtgttaaagttgaaatccctgtccgagggaccaacaacgggaaaccaaaggacatgccacgaaagacagtccttactcgtccagtgaaccgcatcttccccttggaagcgggtcctgaaatgaccaaccaagcaacagaggctgtttccgccgttgaacaaccaaatgaaaaccaacccaagctcgctcaagagccaggacatcaaatggtcaccagaagaaaggccaaactattggaaatacttccagtagtggctttgaccatcctcgcgcttgcatttccatttgcaagtggtttcccaatcgggaaatgtgatgagtgtggcctcacttgttacacgaaaggaatcgttgtgacagtgccacccgaaatccaaaagttcgaaatatgctgtgcagaaagctgcatagttcggcaaggcatcaaagccttgaacttcgaactaccaatcgaagtcctactcaacaatcatcactgtgaggccagattttggactgactcacagcacaccttcacatcaaacacgacctgccaggcagtcgatgaatgtgttctcatcgactgctacttttgtttcacacaaattgtgaatccaacatgccagcccgtcattgcggcaatgctggcaggaggcctgtccctaagcctcctgtgcttcatcttcaccatgtgttccatggtgggatacgccatggcaggactgagaatccttttttggattttctcagtcttgttcgcgcgcttattcaagccgcaaaaagagacatgggtgttgagtgaagaagaggaaaacctcctctatcctcaccgacgaatacgccggcacaggccagcaaacaagtaactgggccagtggccgagttagccaaatgacaatgcttgtcatggcatctcttccgtttgtacacgggggaattgagacagtggccataatggccaaatcagagagctgtctcaacaacggcacaacgaaaatgtgccaagtcaagggaagcgtaacccttgcgcttctcccggcaggacaaccgaatgtcctgtcaatgaagaccgatgatggtctcattttgggaacccttcaagtgatcttgaaggggctctctctcgaatgccaagcatacaccaaggcttggaaacgatcatacgagatcgcttccgtggccagcaaacgatgtccgtcggctggctcatgtgtcggtgacttttgcacaaaagtccgaccctccacagccatccgagagctgagggagaccgaaacgttccccgggaacagtttctgcatagacagcacggctttttggggaaaccaatgtctcctagcagccagttcatgtctcttctacaagtggtttgccaaaccacgctcatcagccatttacgaagtcatcggatgcaactcttgggagtttggcatccatattcaacttcgcctcgactctaccactggaagaagtgcgacagtcgaaactgtgcttcttccaggccgtgtgctcaaatggcacaacatcagca

SEQ ID NO: 59928 - DNA, 83 bp, Heterodera glycines
  Genomic contig location: Contig_ID=SeqID_728; Location=6131..6213; Strand=-
  SCN-specific regions: Sequence locations=22-83
cagcagcagaaatgaatgaatggaaatgtggaagtgagcatataatgaaaagggtgccctttttataagccgaaaatgtgagg

SEQ ID NO: 59929 - DNA, 1561 bp, Heterodera glycines
  Genomic contig location: Contig_ID=SeqID_728; Location=4657..6217; Strand=+
  SCN-specific regions: Sequence locations=1-456,483-1043,1065 -1186,1208-1536,1558-1561
atggcggaaaacaatggccgccaagcgcctctccaacgcggagagcgagccatggactatggccgccccaattcaccggacggcagctttgagaatcgcccacgaagggcggtccccaaccgtccaatgcgccgttggcagaacggccttttcattgtggccgtggctttgtgcctcggcaatttggcggagggaaaggaattcccttcgccaaggacttgccatcagccgcttgaagcggcggacatggcacgtgaaaatcaatggggattttcaccaatgcctttcccatggccattttcccacgatcagaaagcaaatctgatcaagggaccccgccctttaaatggcagtcagccctatataaaggcagggattttccatgtccccacatcattccacaccccaaccatgccaaaacccatcaaaatgccctcctcgtcgccctctgcctactcatcatcatcatcattagcatcatcgccggatcgccagtcgccgccaccgccccgcaaaaaggcggtggaattgttcaacatcgccgcagcgacaccggaaagggacgcaaaaagcggacggaacttttccgtccgcgatttcatcgacgcggaagcgaaggaggagtcgtcgtcaaaacgcatgccgacatgttcggcgtgccaactctctggccatcgccgcggggcaaaggcctgccccctttatgttcctcctcaaaaggagcgaacggcggcagcgagccgccccggcacatcaaacacacgccgcgactcccccgaggaaggggagatcaccgccgataaggcgggccgcgatcgcccaccggtaagggctccctccaaaggttggagggcagagccctcgatcagtcccccccgtaaaacgggggacaccaacaaacagcggggaaggtctcggaccctccgccatttcccaatggacaccattctgaaagccatggggccgatcgccccaatcaaaaaaattcccgcacaggacaatacgggaactgtggcgaacacgcagccaccaaaggccgccgcggacattgtggccattctcggagagctttccgctctccgcgcctctgtggcgtacttgacggctgagcaggcccgcctggctcagttcatccgccaccgcctgggcacaccgccaaacatgtcgggcggaaatgcgatgccttgtggccccgggcgtcggcgccaccatcagcgacagccaagctcggaggacgacgagcacccaacacaaaagcgggcaaagcaccaccaccatcgccgctcgccgtcgccggacacgcaacacaaaccaaagaaagagcgccgacaccaccgcgaagaatttcgatgatgccgcgggggggagtttgtcgctgacagcagcgacagatcttatcgatcgccagctgtttttgtttttcccacgctttttgctagtgatagtctaattaagttttttcctctgtgcccgccctcacattttcggcttataaaaagggcacccttttcattatatgctcacttccacatttccattcattcatttctgctgctgctta

SEQ ID NO: 59930 - DNA, 1500 bp, Heterodera glycines
  Genomic contig location: Contig_ID=SeqID_5985; Location=1476..2975; Strand=+
  SCN-specific regions: Sequence locations=1-161,184-333,398-492,525 -1056,1079-1319,1345-1500
atggccaaagactggggacagattgaagaagatgaaaaaatcggagatgaatacgaccaaagtgccgacgaagatggccaagtgtttttggcggattttttcgttgggcgaattaatgcaaagatttaattgattttcaacaaaaaatccaattgatttggtttaattgaaagaaatgggaaattaattcaataatttaaaaaattcaattgcccggggcaatggcaaaaaaaataataaaacaaacagtttcattataaatattttctatttcactttgaaaactcagcacaattcgtcctaaaagatagattctgtccacaaaatgaaccgaaattatgaaaatatttatttttgttatttagcttattttaccattttaaaattaataatttttgagatttgcgtggtttttaaagtgttgtgcctatttttaaaaatattgtcaattatttatgttacagatttttaatctttggcgataaatttctctaaaattgaattttaaaatattttaattaaaacccaaataatcttcgttcagtttttatatacgtttaatgggattgcgtgtgttcgggatcccgaccgggtttcgttcttgaataccgattttggaatcccgcttcggttctcggttttcaaaaagctttacctctctgaatcccgaattttcaatcttggcgggaccaggacagaaaataagcactggtaagagagtgttgctttcgttctaatgtctaaacctcgctggtttttactacacaattagttgaaattcgaataaaactttttcacacttttgatgcaacacttttttccggcactgaatgttaaatgatctaaaataatatattttgtaggtttttgatttaaaatcgaaaattcgaatggacaaaacgtggaaaaatttggtaatccttaaaaatgtgggcaattcgctttgcacactctaatcgttataattaggaccggcaattttagtgtcgagaatgtcatccataatcaaaaaagctggttgttttttaattttgctcttgctgtcagaatgcccgatttccatttttaagaattttttgcggcgtgttttttccaaaaaatctcgaggaatgggcgaggggagagagtccggcggtgccgataagcgcttccggaaaatttttgtaattctttctgatttattagcatattttcatcaaaaaaatgatcaatttttagctctacctctctgaatcccgaattttcaatcccggcgggaccgggacagaaaataagcactggtaagaatggtgactactccaattaattgatagtttattacaaaatgtttaaatgtatttttgtaaaattatgcggtggcagaaacagaaagaaatggttaagaaagaggcggagaagacaaaatatgttgtggaccataacgttttatgcaatgcgcaaaggcaatttacaaacttaattatcatgaaaatctataaaagttttagtttatttacaaaa

SEQ ID NO: 59931 - DNA, 4538 bp, Heterodera glycines
  Genomic contig location: Contig_ID=SeqID_5985; Location=3036..7573; Strand=-
  SCN-specific regions: Sequence locations=1-293,315-320,346-362,384 -447,482-739,772-1040,1063-1337,1359-1400,1422-1474,1497-1630,1652 -1712,1751-1934,1956-2678,2701-2779,2804-3242,3266-3883,3905 -4046,4114-4146,4170-4274,4296-4505,4531-4538
  Gene Ontology: Mol. function=peroxidase activity; Cellular component =extracellular space; Biological process=protein targeting
gcaacaaagcaaagtccagggaataccacgcaaaacaccaactgtttttggaggatttcaagcatctgttctacaacaaagaacacggcatttggtacgacttcaacttggaaagcggcacatcgaatgaggcgtactacggtagtgcggcgatgccattgttcacgcgctgttacgatgtcagcgatttgggcacggccgagcgaatgttcgcgcggatggagcgattggacacggcgacgaacaggaaattgatcagccacccgtttggtgtgccggcaaggtggtgaggggttttggaagtgttgaactccttccaactgatttttaaaggtttaaaaatttacacctctaaaatagaatttttgacgggacagggccatttgggcgcagccgtttgggcacgagagaagtttattaggatttttttaatttttcgtagttttcttaaatttttaaattaaaatttaaaaatatatttcaaacttggacaaaaagtcgaatgtccaaattaaagtattttccggttggtcacgccattttttggatttgtatttaataaatgaccaatttttcagcttaatcaatgactcgtcacaacaatgggacttcccaaacatttttccggtaaaaactttttgaggatttcacaggaaattttctcatttatccaaattatggatttaaaaaaaaaatttcgaaaccggagaaatctctcgagacgacctggggaaacatgaaaataaaaaaatattaaacattttttttatacaaagttggacagtattcatgccaaatgagtgttagtcatgaatttaaaaaatctcaaaattttcttcagcctttacaacacatgcttattgagggtctgcgccggtcaggcactaaaaagcaagttttttattgttttaaaaaatatttggaaatgaatttaatttaaaaaacaactacaaaaatttagaatgaaaggaaaagcatttgaattggctcaaaagtgggtgtccgccaattacaaactttaccagaacaacaaaaattgtgggaagaaaatgtgggaaaagatttcagcggatgcagccacgccgggcagaggcggagaatacaatgttcaagtgaggaggagggggtgaaaattactactgtagttcaatgtccggtaatactgtgctttatccccctttttttgaaaaaatttttccaaaagtcatgaaaacatgttttcaaggttttcggagttgctgatcatgaatccggcattcttttgggacaattccgaattctagacccgacttcgaaacatgttttcatgacttttggaaacataaaaaatttttcgaaaaaagaggagggacaaagcacagtattacccaatgtccaagtgagagggagaaagtgaaaattactactgtaattagacaatatccatgtgaagggagggtgtgctggcgcgtttcttaaatccgccaatgtgtccgaaaacaaaaaattatatatataaatgcataacttagctcacttcatccaaattaattcgactgattgcattttgaaaaaatatctgttaatttaataacccagttcaattttggctggacaattggcactgtgctggacctattagtcacctattcggacgaattggcgttgagcactgatactactactgtctactgcttggaacaaaaaattgaggaggagccaaatgaatttccaaataattttgtaaataattaaaaaaaaatttaaataacgaaattaattttcatgttttttaagtcggagtacagagcagagaggctaacagccgcacagaaggaagttgatatgatgaacacatcatgggtatgaaatttggcgtcataatggccgggatttggggcagcttcttcccccctcccccgaaaatttaaaataaaatttcaaacaaaaaaagcttacaaagaaaaattggaaaatttcaaccgttttttaattttgtgaagaaatattttttataaaaattccagaaaatttgaaaatttttttgcacccgtaatttttagggtctaaagcccgcaaaagaagcataatattgaaaaatatgtattgtatacatagtatgtattaaaatcacaaagaaaatttgttttgccaatttattttactttcagattaaacactcatttttcaggccgttgtcaatgaaagatttgcactgatgaaagatgaggatttcttgaatttttttggcactcctgtcgatgagactgttgaggaggacaaaaatgagaacaacaacatccatttgcgatctgagctgaaggcagccgatggagaggaagacaaaaatgatcttccaacagaatttgacgcacgcgaagcatggaaagattgtgccgaaatcatccaaagtggctatgcacaaggtggattggaggatgatttgtagtgctgttcgagactctcgagtctcgaagagtcgtgggaaattttcggtcccgaacagcattataaaacttaggctggtaccgaaactgcgagcaccgaaccgtcctgttccgaattttttcaactattgtgacgttttgccaaaatatgttaacaaaaatgcaataaaaacggaaaatacactcctaagaattgacctaaaattttcaaaaaatacgcccctaaaacttttaaaggaaccgttatttcttgaaagttttttcatttacaaaaaatttcaaggcgactgtggttcctgttgggctgtgacagctgcccgaacgctgaccgaccgaatttgcattgcccgtctgaaaaagggaaagaaaacgaacagcagtgacccgagggcatatgtttcggcacaattcaccatggaatgcaccccagacacaaaagggtaaattacaaataatgaattgttagggatttcaatgttttctaatccaaaaaaacacaattttctggattttaggctgaaatttaaggaattttaaaggaatttacagtgagacggcgccgggagaagtttttgaaatttttttcggttttaacaatttttccacaaaaataattattttcatgaaagaaaactttacaaagaaaatcagctttgacacctttaaaagtaggtaaatgctgataaatcagcacatctggcaacactggtatttcatattttggcattaaaaaactctattagaaccgccccctttattaaaacaacactttcgtttgactgaaaactttcaaaaaagctgagaaagcttaagatcatttttaaaattgtttttccaccattttaaatctctcgttgcctagtggcctttttaaaaatagtccaccgtatttctttcactttaaggtgcggtggaggaaatcctttttatgcgtggaaatattaccgtaatctgacagtatccggaaccaaccatacgatgaacacgggctgcaaaccgtataaaatgccttcaaagtcaaattgcgtgttttcgtgcaacaaagaatggctgcaacaacaatatccgaataaagcaaaaacaccaaaaacgcctggggggataccattgtttggaaccacctgggaagtattcctagctggtaagtgttttcatctcagtcagtttattagattgtaaaaaatcgaaataatatttcaatcagtctcttatgactgggctgggaatttaagtcacgaaaaatttccaaaaagttgaataaaaagtcaaaaaaatatgtcaaaaaagcacgaaaaaatgcaaaaaatcctaaaaaaattaattttggtccgtcctgttctttgtgcggaagagtaaaagatcaacccgcggtgggacttgaaccccatcaatccgtgccgtgctctaatccactctcttactctcaattccccttatctttggggcgaaattacttccttttgtctccactgccacataggcacaaggagagaaagtgccgcatttatcacatgtcttacttttcataaaataattaattgattatataaatgggtgtcaatgaataggccttaagcaagccgaaattctctaatttcctggtcaagaattacctcaaagaaaaatttttttcattttttaaaaattttagcaatattattatttaaaattacttcttataatttatgggtataatatttatatgaatttagcgaatcgcataattaaattaaattattttaacaataactgagcctaatttgggaaagaaatttttaggggctggcggaatgcataaaaagggggtgatgggttgaccaagatttttcgaatggctctgagggttaagaaagttcggggtgtcataacaaaaaaaaatttgcggatcccgctgcggtattggggtaatccgtactttcttgagccgggatttcatcggatttctgctgtttttcaatcaattttttttcatcactttaagaggctactaggatgccagtaatcaccggactcacacaacatcgaaacacgcagaattttgttcggcactccgaaagtgtgaattttctatacaccaaattaacatttatttcattcattgtccgttgctaa

SEQ ID NO: 59932 - DNA, 96 bp, Heterodera glycines
  Genomic contig location: Contig_ID=SeqID_29425; Location=752..847; Strand=-
  SCN-specific regions: Sequence locations=1-96
atggtcgcttggaaaaccctgttgaatgtgttcgagaaatgcgaggaaacgctgggcgaaagtctgtacgaagtcggaccaatggacggcacttcg

SEQ ID NO: 59933 - DNA, 911 bp, Heterodera glycines
  Genomic contig location: Contig_ID=SeqID_29427; Location=320..1230; Strand=-
  SCN-specific regions: Sequence locations=1-245,277-421,451-692,715-911
atggaacacaacaaggcaaagaggacaatcgccaagctttgcaacaattcgctatggggacgcttctccctccgcaatggcctgtcaaagacgaaaattacggactccccggcaatgctacgctcccttctcgacgacccaaaaattgaagtttcaagtgtggatttgctgaacgaagaaactgttcttatcacatactcggctgtcactgagttcattgaggagcacggctgctccaatattggtaaaattattttaataattttaaaataatttgtgaatttatagttttgtcgctttggacgacctcagccgcccgtctccacctcctgagtcttatgcaacgcgtagtccgtgcccaaaattccttattaatctacaccgacacggacagcgtggttttggcgtataaggagaccggtaaaaaactaataaaaaataaaattataaggttttattaagacggatgtccattgacaactgggccgcacctgggcgacctctcagacgaatatcccgggcatgaacttttggaatttgtgagtggaggatgtaagcagtacgcgctgagaatgcggagcaaaagaacgggagaagaagacactgttttgaaagttagaaaaattacattgtgcgccgacgcgtgccgcttattacacttcagcgcattcaaacaaaccgttttgcggtatgacactgcagaagaagaagaagatgcttttgaagaaataataattgactatccaaaccagcttggccccaatattcgtgaaggagcagtgcaatctgtaagcattttgaagcgataccgtcccgttgtgaccaaaggaattgtatcagaaaattttactgtacgtgattttggatttaaattgtagtccaattttttcgtgatttattttatcaataaa

SEQ ID NO: 59934 - DNA, 885 bp, Heterodera glycines
  Genomic contig location: Contig_ID=SeqID_5986; Location=698..1582; Strand=-
  SCN-specific regions: Sequence locations=1-436,468-637,680-793,815-885
atgctggtccggctccaatatgacggtgagtctgttcaacgtaagcaccaaagttgaggaggagcaatgcgcggtagaagtgacaaattgccaccgaaagtactgcaaatacggtaacttaccgtaatgaataccgtgccatggcgggtgttattttgtgcagggaatgggtcggcttattactctttgggctgcgggggaatggacgcgtgcgagtcggggcccgtggcgatgctttgccgggcgagcggccaattggcatgcaccaattgcacgggcgaactgtgcaacggagcgggggcaaaccaccgctttttgggcggcactttcgcagcgacacttttggccattttcatcggtcaattaatcaagcattaattaattgttggccaattagtgatttggaaattgtcagcgattgggcaaaaatagcctcataaaaattaaattaattataaaattaatttgttcctatagcactttttgttcttcaaagcaaatgaaaatgacagaagaaaagagggaaaagtgaggacaacagggacgattgattgacaaaacagatcaaccaacaattggctgataatttatcattttgtaatttgacaatttcagttaagaaaatatttgggaatacatttaaaattatgttaatgaactaattaaaattaaaatatatgagcagaattctgttgatgagaagtcatcatttcttaaattaaattcaccgtagtaatccaccaagctttggcacaaactttccttcgtgccgttccctcgcgccattcagctttttcttttgttttgcatataaatgcctattatcgttcgtaattctgctaattgccttatttttctcccagtaattgttttgtgcataataaa

SEQ ID NO: 59935 - DNA, 1992 bp, Heterodera glycines
  Genomic contig location: Contig_ID=SeqID_5987; Location=1635..3626; Strand=+
  SCN-specific regions: Sequence locations=1-27,50-103,126-371,394 -1137,1161-1365,1391-1613,1696-1714,1757-1818,1840-1952,1980-1992
  Gene Ontology: Mol. function=thyrotropin-releasing hormone receptor activity; Cellular component=integral to membrane; Biological process=G-protein signaling, coupled to IP3 second messenger (phospholipase C activating)
gttccttttccttcccattttgccaccgtttcccctcacttttctcttttcttcggctctttgatcgcttttgtcacttttgtcggcgttttggccaatgcttttgttgtggtggccgtcgctggcgataagaaaatgcgtcgttctccgatgaatttgctgctgctaaatttggtcagttttgttccgttaccgtatctttttacggtattttctgttttggatcgtactgtacatcaaaatttaaaaatcgacaaaaatgctcataaattcactaatttcgcacccatcaacgggaggggcactcactaccaattttcctccctaccaaactgtcccataccgtaacgtgccatttcactttcgcttctttctttgccccgcccccttttttcgtcaaatgccttcccaccgcagtttctttaggctgttgccgatttgctttatctgctggcatttacgcccttttgggcttcgatgtccgtccacggggacggcggatggcatttccccgagagtttttgcccaattggacgctatctgagcaattgtctgctgattgtgtccatcttcacttatgtggccatttgtgtggaaaggtgaaaaatcttttatatgaaaatcaaatactaatttgcttatttggccaatattaattgtaaattgtgcctaattaagccaataattcttataattacgcatttgatttccaaagattcgtcgccattgtccacccaatgcatgcccaagtgtggtgcactcgtagtcgtgcactgctcgctgttctcggcctttggacctttgtgatggcctatcaattaccttatttggcactctttcagactcaaccggcgccatggaatggttttgaattattaataaaatatgtttatcaatcccatccctatttaattttaaagttgaaatgcgcatttgtcgcagtcgtttggctggtaagagttcgttgtggcgtgcctacaaatggtccgaatttgtgctcacttacgctcttccggtgctcctttcggcatcactttatgcgcgaatttgtcgggttttgtgggcaaaaagtgccattttgcaaaacaacggtaatttgggcatactgtattgggaaattgccaaaaattatatgtttgtaatttaccattctttcttttgttctcgctaacttaattggcattttgagtgcccaagcgcagtgccatcattggcactgcctcgatgacggcggtgccctccgcgacttatcggccgaatggcacaattcgccgcgttttggagacaaaattagtgaacggaataagcaaagtggcaccgattaagccaacgacggcggcagcacaaaagccacaaaaaggttcacaaaagtcatcatcatcatcagcaggtggccaaatggaattttgaattggcatttcgtttaattaatattttaaaagtatagcaaatgataaagcaaggcgcaacgtggtcaaaatgttgatggtttgtgtcacactgttctttctctgctacacgccgatggtcgtttactttttgtgggggtaagcaaacgcaaaattcacaaatacgccaattaagcatctgtatcggatatcgctactccacccctccctctctttttctcttactcattctatccttcctttcctcccttcactctctctctcttgccccctctctctctctctcatcatttgctattcatcccttctttcatccctttccctccctcccctctcccttttcagtgcgttgttcggccgtccccttccgttgcccttcgaatttgttttcctcaccagcactttcgtccaattccaaagcgcatttaacccttttctttacacactttttgcaacaaaattccgagaaaagttggcaaaattagtgaaaaggaagcaaaaacaacggaaggacaatttgagggacaaaaatgaacaaaaggcggagggaagagaagagaaaggggaaaagatggaacaaaat

SEQ ID NO: 59936 - DNA, 804 bp, Heterodera glycines
  Genomic contig location: Contig_ID=SeqID_29435; Location=88..891; Strand=+
  SCN-specific regions: Sequence locations=1-581,603-804
atgtgccgccaaatcgggcttggagagaccggagaacacttctggattcctccgcagttcctcgtaaagagcagggatgagttgatagactttgtctatcccgacttccagaaactccttggaaatgacaaggaactgctaaatcgtctgatcctcgcacctcacattgacacatgcgatgagatcaacgaaatcatgatggcgaatgtgcctggtcaagtgcgcgaatatttgtcctcggacaaaccgcttgacgagcggccactggatattgatgaaatcgagtccgaagtggcagcgttgaatcgacgcacagactctgggatgcctccccaccgtctgcgactcaaggtcggaagcgtcgttgttctccttatcaacaaaagtgataaggaaggactgatcaacggcacgcgcatcgttcttgaagaacttggcgacgatcgtctggtcggtcgcgtcattaacagcaacgctgttggtggccaagttaagttcttcatcgaacgaacacgcaatgtctacgaggacaaaacgcctggcggcataaaatatgagcgtttgcagtttcccatcaaacctgcctttgccatgaccattctcaaaggtcaaggccaaacaatcagcacggtcggaattgacctcgaaagggatgtgttttcccatggtcaattgtacactgccttttcaagggcaacagacgggaacaacgtccgagtgtacgctcccagaagggagaccgatggccaaggtcaaaccaaagtgttgaacattgtggccaaaaacatgctcaaattacaataa

SEQ ID NO: 59937 - DNA, 555 bp, Heterodera glycines
  Genomic contig location: Contig_ID=SeqID_29436; Location=320..874; Strand=+
  SCN-specific regions: Sequence locations=1-337,374-555
atggccattgcattggcacgggatgcaggaaccgatcagatgcgtgccaaccggggccggcaaccgatggtagccttgtgcgcactcttggcaggacgggccggtgtatggctctgcaaaatatgaacatgaatgattacggtagatttttgacgtgcatactgtagaaagtgaattacagaaactgaggaaaacacattgtaatttaccaggacattcacacagttccacagatgatgcagttggacgaagaaggccagactcatcctgggaaatgattttacaaatttaaaattaattttactggatttttctatctttagatcgaaaagataagaaattataaaataagttaatttaattttaaaaaattgaaaacattcaaaaaatatgttattggacttttttttgtttttttttgcataatgccattatctttgtctccttcttatcatcactttaaaattttgattcggttaatttttgaagagtaatggtggccaaattttgttaaatttactaaaaaaaaacattttaaaaggcagaaaattcaaa

SEQ ID NO: 59938 - DNA, 322 bp, Heterodera glycines
  Genomic contig location: Contig_ID=SeqID_29439; Location=59..380; Strand=-
  SCN-specific regions: Sequence locations=1-198,227-322
atggctatctcttttttctcatttttttaccgcaaaattggtaccaacagtatcggatttttggccataatcggaatcggcgatttaatcggaatcggattttgtctggctcggcacatccctggtacaaacagacactgatgaacgtaatgaaaagagtttggcctttgcccttgagtgttcccctcaaaaaggtgcaaaaataaaaagataatataaaattattgttttaccatttttagacccgaattggagctgcgaatgttctgcaacacctcgcattctttacacaaaagagtggaacggaggactttacgcataa

SEQ ID NO: 59939 - DNA, 464 bp, Heterodera glycines
  Genomic contig location: Contig_ID=SeqID_29439; Location=536..999; Strand=+
  SCN-specific regions: Sequence locations=1-464
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtacaaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaattttgcggtaaaaaaatgagaa

SEQ ID NO: 59940 - DNA, 1171 bp, Heterodera glycines
  misc_feature (1141)..(1141): n is a, c, g, or t
  Genomic contig location: Contig_ID=SeqID_29440; Location=20..1190; Strand=-
  SCN-specific regions: Sequence locations=1-1067,1089-1141,1168-1171
  Gene Ontology: Cellular component=COPI vesicle coat; Biological process=ER to Golgi transport
atgggttcgattcccagtagcgtttgctttgtttgtttttttctaaatccattcgcattccaacattcttaaacaaccccgtggcatcggttttatcgcagtcaaattcacttaatttttaggtgtcccctcaactgttaataaattggcgagtggtgcgctgctgctcatcgcttcaatcattcatcttggcaagtcgggcttgtgcaaacagccgatcactgaggacgacttggaccgtttgtcgaccactgttcgactgattgttgaccaatggccgaaagcggtggatgtgtttttgagagagtgccgtgcttcgttggaaagcatgctcaaggccaagggggacgtggaccggcacgaacgcgacacaaaagcgccgaagaagaaaattgtgcaggcaagcggaaggaggcaacgattaaataaaatcaaatttaaacaaattcagcccgacaagacaattatgttcacgcagctgtccacacgcgtgtcagaaaacgtgacggacacaaatttgtttgatctttcgctttcccaagcgcttggtactgcacccaaaacgaccaaatacacctttgccagctccaaactgggaaaagtgattcagttagccggcttttcggatcccgtctatgccgaggcgtacgtcaacgtcaaccaatatgacattgtattggacgtactcgtggtcaaccagactagcgacaccttgcaaaatttgtcattggaactctcgaccgttggcgaccttaaattgtgacagaatatcatcttgttcgctaaaattgagacaatttaagggtggacaaaccctcgccgattactcttgcacctaacgacttcactaacatcaaagtccatctttcataatccacacagtctttaaacataattaaggccaccgtaaaagtgtcatccaccgaaaatggagtcattttctccaccattgcttatgatgtgcgagggtcgacctcggatcgaaattgtgtgtaccttgaggacattcacattgacataatggtgagtggagcaaatgcataattccaatctagtactttgcttaccactcacttcctaccatttcccatttcaggattacattgtgccgggcacttgcacagacacagaatttcggaanatgtgggccgaatttgaatgggagaaacag

SEQ ID NO: 59941 - DNA, 2888 bp, Heterodera glycines
  Genomic contig location: Contig_ID=SeqID_5989; Location=958..3845; Strand=-
  SCN-specific regions: Sequence locations=1-249,274-487,509-781,805 -1380,1406-1496,1518-1603,1746-2066,2093-2373,2396-2424,2446 -2487,2510-2588,2612-2669,2692-2707,2736-2857,2880-2888
atgggccaaatgggagaaggaagcgattggatggaactttatggaccagtggaaccggatcgacatttgagatgggtcagtgaatgatgcttcttatgcagatatccaaacttattgcttttcgatttttaggcctcttgacgcagtgatcaatccaagtgatcagaagcagaaatgactggacgatttgttgagaaatgatccatttaattgatgtggattggataatgaatttgagcccatctgatgtatataaaattgttgttttgttgcagtgatcacaaattgtattatatgtatatatcaggggtgggacaactctcgccaactctcgccatttttggtactctcgcctctcgtctctcgttttgggacgagaggcgagagttgaaaatatacccctaaagattgaacttttgaccagtcagaaaaatattcaaatttacgcgaaaaacgccataataattctctttctctgcttcctctatgttttaaaattagagaacaattattttttgataaatggtcagtaatttaattaacttttacaggttgttagaaggagtatgtcgaaaatatggaattatttcaaaaaggaaatcggaatcgctttctgcaaaaattgtgactacaaaacgaattttccgcccaaaacaccaacgacgacattggccactcatttgaagcacaaacactcagaattatacaaggaatttacagaaaaaacgggggcagccaaagagcagcaacagacttttggcataaaacggtcacacggaacataatacaaaacaacattttttacttttagggctttttcgtcttctgcaggcgcattgacatcgacgagtcttgatttaactgtcgatgaggaaatcgaagagattacattggccaaaaagctcgatgaacagccgaagatcgatcgaatttggacaagaagtccatgggaaatgggcggggaaagagcaagcagtgtgcataaaagaaagacaagtcacacccctggtatatatgcctttaggataaattaagcgatttcctgaaattacaggctcattcttttaacctaatgataaagtcggtggtcacttttcctccaatcaatgggtttaaattaccatgcaagaaacgatgatgcaaaaaatttgataatcaatactagagatcggaattttgcgaaaatacggataagtatcagtattacgtacttggcaccgatacggattaagtacttacggactaaaaatacggaaaatccgtagtccgtaaaaatccgtatccagaaaaaatacggatccgtatacgtataagtattttttaaattttttgataaaaattggtttaataaatacaaatcttgaatattaaagctagaggattttttataacaaatttattatcaattctaagcaacaaaattcaagataacaaaaaattggcaacaaatggaagtgagggtaaaatattggtacttgttaattatctgcgttcagattaaaaaaaaaattttttttggaaacagggagggggggggggggggatccggcgcagggctgcacgaaatttcgtgtcgttttcgtgtcgtcccctttttcggcactttttgagtttcgttttcgtgtttcgttttcgtccgctaaagtttttcgtttcgttttcggttttcaaatttttgtttttcgtttcgtgtttcgttttcggtttttaaaattttggattttcgtttcgttttcgttttcgttcgagcaaaattttacgaaaaagacgaaaatatttacacccataagaatgacttttttagtaaaaaaaggcaatttcattgaactcttgtagtttagtggagcaaactgcagattttagttgtaggtttattatgtgttcgataattttgaaaaatttacaaaatggaaaaaaatgaaaaagaatttcgtaaaatttaaacgaaatgcaatttaataacgtaaaggttttgagtttttgcacaaaattttgcttttttccaatttagtaattttcccatatttccagtgctttttcgattttcatcgaaaattttacggaatagaccctcaaatttcaaaattttggcgaattgactgcacaaaatttaaaaaattactccatttcaccttaaaaacgccaaaaaaaaatagtccgtaatacgtatcataatttatacggatcagtatcagtattacgtacttgacatcgatacggattacgtacttacgtactaaaaatacggaaaatccttagtacgtaaaaatacgtatcggccaaaaaaaatacgtattacggactacggatccgtaaaagtacgtatacggatccggtccgtatccgatctctactaaatagggtttgtaattatatgcacataaaatcttaaaatatgcgcatgaaatatgcaccaaaaattgcaaaatatgcatataaaaagtgaaaaatatgcacataattttttcaaattaagggtaaaattttccaaaatttcttcaaatttgttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccattttttgagaaaatttatttattcaatatttttcgtgaaaattttgctaaaaaattattttttttagaaaattttccggtttttgaggtcaaaaaggccaatttgtctgttgggggccgatctattagaggtttttttggaaaaacgccaaaatatgcacataaaatatgcacgaaatgccaaaatatgcacaaatatgcaaaatatgcatatagaaatccattctag

SEQ ID NO: 59942 - DNA, 400 bp, Heterodera glycines
  Genomic contig location: Contig_ID=SeqID_5989; Location=5891..6290; Strand=-
  SCN-specific regions: Sequence locations=1-3,25-152,174-226,248-400
cagaaactcatcaatcagtggacaacgaaaaactttgggcctttgattgatggaagagaaaaatgtgctctaaatgctctttaaattatcatttttcattaataatttgagcgaaatgatccacgggagagtgattgtgtaaaaaaggattcaaaaaatctgtaaattttcttcgttgcgatatcataaaaatttttttggtttataatagaaatcaaaaaatctttttattcggaatttttgctgatttctcttcgattttcaacacttttcaattcttctcaaaatgattacgctattcacatgtaaaatcaatggccaaggtgactttatcctcgtctttgttgtacaagcctttgctcgggtccatcaattccttaatttgccatttaaaaataaa

SEQ ID NO: 59943 - DNA, 546 bp, Heterodera glycines
  Genomic contig location: Contig_ID=SeqID_29442; Location=196..741; Strand=+
  SCN-specific regions: Sequence locations=1-241,263-279,308-440,462 -473,507-546
atggccaaactgatggagcatttcaaaaaaggaacaaagtgccaaaaggtaattaacagtgccacatgacctaattaaggtaattaaggttcacttataactcattaatactgcttattccaagaatttatctacacttattacgcactttgttaaaaaggttacaccaatgacagaagaattgaaaatgatgccaattaccgcaatgattccataaatcagtgcacaaccaattagtgaccagctgggatggacatctttgaagaccaaataaaactgaaatttagttataataaaataatttttaccaattaattaccgtatcattgccttaattttccaaattggccataattaaggatcgaaaacaatcgtttttataaatttttaattcaactttttttagtaccaaaagaatgttatgaaaaaaattgctgaacatggaatttctcatcaaaatttatatttccatgaatttttgtttaaatttatttaattaattttttgagataatacaacgaatgacaaagtgctgaatttggttga

SEQ ID NO: 59944 - DNA, 389 bp, Heterodera glycines
  Genomic contig location: Contig_ID=SeqID_29446; Location=14..402; Strand=-
  SCN-specific regions: Sequence locations=1-389
atggcgcagcccgtcgaaaaaaagaaaaaatattcttccgtcgaccggcacctcatttcttctgctattggtgaaagacaacaacaattttttaggaaaatgtgagccaaatttggcatttttcatgacattaagcaattgaatgtatttgttctgaatttcagttggatttgcaatgacgtgtggatggacattctcccatcttttgaccgtcctcaacttggactcaaattggcattgctttccgaccgtttcgatgttttggtggacaaacatttcgatgcaaaaagcgaattgacaatttggagagcaatcgaaattcgcaaggacaaaggaccaagtggagacgataatggaccaaaagcgaaactattggcgctatatggaaa

SEQ ID NO: 59945 - DNA, 488 bp, Heterodera glycines
  Genomic contig location: Contig_ID=SeqID_29447; Location=125..612; Strand=-
  SCN-specific regions: Sequence locations=1-34,56-285,311-329,351-488
atgctgggcaatatccgacgagtgatgagggaggagttggaacgagttggtggtgcacgtggcattgggtgagtcggagaaacttttacgaaagtgcagagggagggttcggtaggcaaaattttttttttcaaaaccgcttttgcggggcgctttttccaaaaaagtgggatggaaaacaggaggggggggggggggtggtgccttaattttcccaaaaaaaattttcaacagaagtttgtttaaaaaaatgtttatgaaattttttcgtaagaaaatgccaggaaaaaatttttttaaataaaaaattgagtgtggattgctaccagatactcatggaaaatgaacaattagcggaaaaataaaaaataaaatttgcttgcatttttagcgctgattacgtgcacaagtcagtgcacctggcaataatgaaggcattgttgcacaaaaacatgggtctggagcgaaaattacgtgaaatggactcg

SEQ ID NO: 59946 - DNA, 725 bp, Heterodera glycines
  Genomic contig location: Contig_ID=SeqID_29448; Location=493..1217; Strand=-
  SCN-specific regions: Sequence locations=1-644,711-725
atgttttcaaataagcgcaaatgttctttcaatcccgattgggaaaagcaatataattttgtaaaaagaagccggaaagggaatggctttttttattgttccttttgtcaaaaggacttcaatgtcgaatcaatgggagtttcagccatcaagtcgcacactgaaaacagagtccataagcaaacggatgaagaaagacggaaaaacacaacaattgagagtttttctcgatcaaaattggcacttaactcaattgatcgtcaagttgcaacggctgagggtcatttttaatcttttttagtgtaaaaatttgtttttaggaacttttgctttgtatccgaagactcaaggatatgtataacagaaacgggacaaaatatcgccgcgacaaaatttcgccgccgaaatatcgccgagacaaaatatcgccgccgaaatatcgctgcgacaaaatatcgccgccgaaatatcgccaagacaaaatatcgccgccgaaatatcgctgcgacaaaatatcgccgccgaaatatcgctgcgacaaaatatcgccgccgaaataccgccgcgacaaaatttcgccgccgaaataccgccgcgacaaaatttcgccgcctaaatatcgccgcgacaaaatatcgccgccgaaattttttaaaaatttttttcaaacagaaatttttaaaaaaaaattcttagaaaaatttttttaagaaaagttcaataaa

SEQ ID NO: 59947 - DNA, 1603 bp, Heterodera glycines
  Genomic contig location: Contig_ID=SeqID_29449; Location=425..2027; Strand=-
  SCN-specific regions: Sequence locations=1-16,44-191,213-262,284 -458,501-528,552-587,615-947,986-996,1018-1201,1224-1347,1381 -1395,1455-1603
atgatcaaagaggaaccggaagaggaggaggagggagagttcgggtacccggagcaggagaatctgccaggtaaataagcggggttcaaaatcttttaaggatttgggagcaccgtttttctgctttttaccacagggaaactacttttcgggccacattaaaacccttcatttttagatgaagcggcagaaaatgggttggtaccccaacatggcccggcggctttggctccgttcgtggcgcaaaattgggacgccatgccaccacaaccgcaacaacaaatggcaatggcgtttgcgcagccgttcctgccgccgatgggaatgccgccgccgatgggaatgccgccgccaatgggatttcccccgccggttccgttcgtccccctgttcgcaaatccgccgctaccaatgccgtacccaccaccaccgattccgcaggtacttaagtcattcgcaaaatgctaaaatttcagaattacagaaaaaaaggaatttttctggggggggcggaatatgcatttcttgtaaataaaaatattaaattttttcagcaatttagagacaaatggggttctttttgggcaaataatacttttttcaaatatttttaagccgattccaattcctccggctcgtccgctgtatggggctttcaacgcaccacaaatgagaccgccaccgttgatcaacatgccgtttgctccggtgagtttatatttttacgaacctaaattataaacgattacattattaaattaagcctggccaaagaggtcattttcttcaacaaattggccgccagccgcgttggcgtgaaccatgtccataaataaaaaatcaaaaaacgataataaaaacaataatatttaagtggaattacgtgaccccaatggtcaaaaacgtcgacgtgagctgttggaaattgtgcccgaagaatttggtacaaaaaataattcatttttttgaaataaattataatttagttgtccgtcttccaccaccaccggagccgccaaatttacgacgatggcattaccatcatgatgagccaccccaccgagtgttggtgcataatgccgatgttaaaagaccaactggacccataaccggaaatatggagagaatggaccttttttttacattttttctaaaatggtttttttcagtttgagaaaacacaatttatgtttttgatcataagaaattttagttttttctctaaatcttctcaaaaataattttcgttccattctctccccggttacaggtcagattcagcgatagatttgggtttttcttttttcatatgttaatttattcattttgcatttaattgttttaggtataaataaacattttaatttgatagtttaaaaaagggtttcattgtccaaaaatatttaaattcttaattttaatttgcaaatttagttttattatagattaaaaatggatgaaaaaagatttttaaaagtacctaaagaaaaaagacagttgagaaaaaaaaaaattatttttcgaaaacaaataatataccagacggaagttattacacagaaatttcaaatacgataaaagagaatagaaaatttggaataaa

SEQ ID NO: 59948 - DNA, 369 bp, Heterodera glycines
  Genomic contig location: Contig_ID=SeqID_29450; Location=495..863; Strand=+
  SCN-specific regions: Sequence locations=1-369
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcggtgctctaattaaccgggataaaaacatccgaatcaattaaatagcttctgagataataaggtttatataaaatttcaattaaaa

SEQ ID NO: 59949 - DNA, 753 bp, Heterodera glycines
  Genomic contig location: Contig_ID=SeqID_29451; Location=535..1287; Strand=-
  SCN-specific regions: Sequence locations=1-36,67-223,247-334,356 -423,445-561,584-637,659-753
atggcagatttaaacaatggcacagtaagccaaaagaaaaaataattattgtttttaatttattttcagttttatttggcatacaaaaatgccaagccaagttgggcactgatcagctgcgcatttatatttggaatcatcgcagcatttggaatcattttcaatgtttccgttatatttgtaacaattaggacaaagtttgaaaaaaaagctgaataattcctaaatttttaatttaaatttttagacaattccgtggcaccgttaattaccttttggcactttgttccttttttgaactgcttcaccaacaagggcattttctatttgtgtacaccacattttctggccaaaatttcattccgtatcgcttggcaacaaagattgaactgatttcaatgcttggaatttgtaagaaatcggaaaatataaatttttatttatccgaaattttctaaaactgaaatttaggtggcatttatccgacaatgcttttcacgggcattgaccgactgattggagtgatttttgatgaaaagttagatataaatattgttataaaacttttaatttccatttttaaggcaccgtaagaccaaaatccgactgtatttggctacgataacaattgtttgggttgctttttgtttcgacttgtgcaaatcgttgtaccaaagcattgaattgattggtgatcagatggtcactggctgtttaatcgatattattaaagtttcgaaatttttttattaa

SEQ ID NO: 59950 - DNA, 515 bp, Heterodera glycines
  Genomic contig location: Contig_ID=SeqID_5990; Location=12..526; Strand=-
  SCN-specific regions: Sequence locations=1-123,150-260,362-425,452-515
atggagcatcaaacatttatgaagtggtcaggacaaggtttaagctattactttcaaaaatgaaattaaaataagagtataatttaattgcaaaaattaacaaaagcttagaaactcattcagataaataaattttaaaacaattttaccaaaaacacaaatatatttagccagataaaaaataatacgtccaaatatgttttcataataaaacccaaataaaagccttagtaaaattaaaaaaattggaatacaagtgctaattttataataaaatacgtaaattaaatatttttacccaatttaattatttttttaaacgaaaagttcaaattagattatttatatatttttttaaattgcagaaaatgagaaacatcacactggttcaagaataactgcacaatgataagctgtaagaaaaattgagaatattaaattaatataaagtattgaattgatttatgttaatattgaaatctttgaaagcaattcattttagattgaaaaataaa

SEQ ID NO: 59951 - DNA, 2007 bp, Heterodera glycines
  Genomic contig location: Contig_ID=SeqID_5992; Location=650..2656; Strand=+
  SCN-specific regions: Sequence locations=1-111,142-581,614-632,655 -679,703-955,977-1011,1040-1147,1169-1169,1192-1195,1217-1217,1239 -1264,1286-1552,1574-1770,1792-1839,1861-2007
atggtaaagaaatatgaaaaatattctattccatggggaactgaacccaagcgaaaaataatgaaagtcagaaggttagccactagacaacatttgaattcgaataaatgctataaatgaaataaaataatttaattttttcctcaaaaatttccacttcttcaccatttcctactcttttctcacctagacacccattcataccagtgtaaatttttaccggcggtaccggtactagacaaaccggtaccggtaccaaaaaaaccggtaattaccggccagtaccggtaccggtaccaaaaaaccggtaattaccggccagtaccggtaccggtaccaaaaaaaccggtaattaccggccagtaccggtaccggtaccgtgcaactcagttttcaatgaaattcaaatgaccccactttttaagtagcgctaattattttatatttttccttgttctacaaaattttaaggcgctagttaaaaagaggacctttttgaaaattttttcacttttttttggtcaatttttttttcgtttattttgatgcagaattcgcttttttaccagatggtatgcttcattatttaataaatagaaaaaaaaatattaaagcaaatttggcgctagttaaaaagtgacagattttgaattttatcaaaaatcataagggcgacccttttgttttacaaaaattttttgtgatacaaaatcgtgaatatacttttattcgccataattgtgctgttaattagagacaggcgcaggacaggatcctgcgcaggattttgcaggatcccagtccgcaatcctgcatattttggaaaatacaggatttacaggatttgctggattaatcctgccggatcctgtcctgtaaaaaattttgaattccaatcctgcaacaggacccgcaaatttgatttttatgcaggattcagcaggatcctgcattgattttttgaaaatttttaaaaatagaatgccaaatattcagaaactttcttttttcaaaaatttttttcttaataaaaatttttcgtttaaaaacttatccttattcgaagccacccaatttggcaaatcggtctttttaaacgcattaaagaagattcagtcgattgcttggagtgtaagcaaaaaaacgttattaatttttcatcttcatcattttttggtttaaaaatatattgaatacttttttatactttgaaagacttttttattaatacagaattttttgaaatttcctaaaatccgcaatcctgcgcagggtcctgcagattttaaatgcaggatttgctggattaatcctgccggatcctgtcctgtaaaaaattttgaattccaatcctgcaacaggatccgcaaatttgaaatttccggtctctactgttaatgcttaatattcatcattatgtgtaaataaacaaaacaaaacaaaaattgaccaaaaaaagagaaaaaattttcaaaaaggtcctcttttttaactagcgcaatatcttctaaatattcattcggtatatataattttgaaatagcaatttttagagaattttggtgataaaatcacacaaaactttttcatctttagtttaaattcgtgaaatgacaaaaaattcaaataaccgccttttttacgccaatttttaaatggcgggaacatttttattcaaatattttttgtttttcaaattttcttcattttctttgctcattttccgcctacgcctaatgaaatgacttaattcaatttgaaaacttcatattttaacaaaaaatatttttaggcctatttttctacaataaaattgcaaaatgtccagcacttcgtccactgctggtggtgatggaggagaaggggaaagtgaacgcaccgcaagtccaactccgctcgtcccgctcaacgaatttgaacggaatacgcttcgaagcgcttcccagcaggagggcagcggtccgtccccctttttgggctttaagcatccaattaatcggcttttag

SEQ ID NO: 59952 - DNA, 966 bp, Heterodera glycines
  Genomic contig location: Contig_ID=SeqID_5993; Location=104..1069; Strand=+
  SCN-specific regions: Sequence locations=1-7,31-254,277-497,519-966
  Gene Ontology: Mol. function=ATP dependent DNA helicase activity; Cellular component=cytoplasm; Biological process=nuclear organization and biogenesis
atatcaaccaattggtcaccacccaaggcatggtcacgcgcatttcgccgctcatcccacaaatggtcgaaggctatttccaatgctcattctgcaactatccggtccaatttttttgagagttgctcgggctaggtgaactgttcactctcaacaccaaccgggattttctgagggggcaggttttggggcaaaaattagtcttcatgttttactgagattactggctattgctgctgttgtaggaggtgcgtaaggtggacatgggcgtggtggaggagccgatcaactgcatcaactgcaataaccaaggctgcttccaactcatccacaaccgatccactttcatggacaagcaggtgatcaagctgcaggagataccaggtgggcgagaaagggcagtgttttggtgtcaattaacaatcaacaaattcaatactcactctcataatccaccaataaagagttcgagcagtacatcgacccgaataccaaaaatgagccaaaattaaattttaaatgacccatttagccccgaaaaattaccatgagaattcaaccccaataaattggctcgcacttttcaattttttttttgagttcaaagtcaacgccgtttggccgttacaaaaaaagcttaattattgacaggcgacatgccggccgggcaaacccagcacacagtcacgctgttcgtgcacggtgcgctggtggagagtgttcacccgggcgatcggatcaccgtcaccggcatctaccgggccagtccggtccggctgaacccggtgcagcgcgcggtgcacgccatcttccggacgagcatggacgtgatacacttccgcaaaatgtgccaggaccgactccatgatgtcggagacggcactttcttgacggaggagcgggtggcaaaaatcaaggcactcgcccagtgcgaggacgtgattgaacgactgatgcaggcaattg

SEQ ID NO: 59953 - DNA, 511 bp, Heterodera glycines
  Genomic contig location: Contig_ID=SeqID_29452; Location=350..860; Strand=-
  SCN-specific regions: Sequence locations=1-140,162-165,187-448,470-511
atgtctataactcaaaataaagttcatattcgtgatcagcgacccaaattacgtaagaaaatatgttttttttaaattttagagcaaaaaaatgtgtccattaaatttccaaaatggtatccctttggattttggctccaaaagcagttttaattttataactctttttaaaaatgtgctaaaattatgaaataaattcctacttgtagagaaaaaaattgcggattttatcaatatttttttataccctactgcctttattggaatgagttatgaatttttatgtgaaaaatcgaatttttcatctttttcaggaataacatttttcatattaattgtagaaatgcacaataaaaaccataaaattctcccgatttttctgcattttttgatcatttaattttcacatttgacccatttcaaatggagttattaatttttgaaaatccccccaaatttcccctgggcgaaaaatgaaaaattcaaacacacccaaatttggtcaaataaa

SEQ ID NO: 59954 - DNA, 1157 bp, Heterodera glycines
  Genomic contig location: Contig_ID=SeqID_29456; Location=128..1284; Strand=-
  SCN-specific regions: Sequence locations=1-808,839-1157
  Gene Ontology: Mol. function=phosphofructokinase activity; Cellular component=6-phosphofructokinase complex; Biological process=glucose metabolism
atgtcaatttctgacgttgccaagaggccgtccccagtgcgcatggagggctctctcattgagccgggatgtttcactggtcgaacaatggctgtttttacaagtggcggtgattcgtgcggtgagtcccgcttccttcgctgcctttttttgaacggcactctttaaggaatgaacagtgcggtgcgttccgttgtccgtaccggactttactttggttgtcgcgtgtttttcatcaaagagggttaccaggtcagacggaccgagcgacttttgggcggcgaacatccgaatgtttagggaatggtggacggaggagaaaacattgtggaggcgcattggaattcagtttccgacataatccaaagcggcggtaccataattggttcggcgcgttgcaaagagttcagggaacacgatggccgtctcaaagtgagtacattcgctgctctttttattcggttgcttttcggcttgcaaaaatctcgtcgcaaattccattactcatttggtatgcattggcggggacgggtcgttgaccggcgccaccatttttcgtgacgaatggccagcactgcttaaagaattggtgtcgaatggccaaatcagtgaggagcaggccaagctttgcccttatgtccaggttatgtttgctttcggtcataacatcctccttaaaattaaagatcgtcggcctcgttggttcaattgacaacgatttttgtggcactgatatgacaattggcacggacagcgcattgcagcgaattgttgaggtgcttactattgaaatggaatgcaatctccgacatctctttcttccttcccttttcttttcaggccgtcgatgcggtcgtttcaaccgcgcaaagtcaccagcgcgcctttgtgattgaagtgatgggtcgccactgcggttatttggcgttggttgccgctttggcttgtgaggccgattattgtttcattccggaatggccacaacccaaaaaatgggaagaggtcggcccaccgattcatccgcccatcaattcattcgtttttaggttctttgtgcaaaattgaccaattctcgcgaactcaaccagcgactgaatattatcattgtggcggagggtgccatcgacgaggaaggcaaagtcatcaccagcgaaatg

SEQ ID NO: 59955 - DNA, 388 bp, Heterodera glycines
  Genomic contig location: Contig_ID=SeqID_29458; Location=295..682; Strand=+
  SCN-specific regions: Sequence locations=1-273,295-388
atgacattctatgcttctcttgttggatacacgggaagaaataatagttagtccttttgttgaatttttagaaattctatccgtcaaatcgacttttggaattttaatgagtaaatcaggaaccgtaaatgacattctctgcttctcttgtttttttagaaattctatccgtccaatcggcttttggaattttaatgagtaaatcaggaaccgtaaatgacattctatgcttctcttgtttgatacacgggaagaaataatagttagtccttttgttgaatttttagaaattttatccgtcaaatcggcttttggaattttaatgagtaaatcaggaaccgtaaatgacattctatgcttctcttgttggatacacgggaagaaataa

SEQ ID NO: 59956 - DNA, 276 bp, Heterodera glycines
  Genomic contig location: Contig_ID=SeqID_29458; Location=767..1042; Strand=+
  SCN-specific regions: Sequence locations=1-57,79-218,240-276
atgacattctatgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataatagttagtccttttgttgaatttttagaaattctatccgtccaatcggcttttggaattttaaagagtaaatcaggaaccgtaaatgacattctatgcttctag

SEQ ID NO: 59957 - DNA, 545 bp, Heterodera glycines
  misc_feature (150)..(150): n is a, c, g, or t
  misc_feature (366)..(366): n is a, c, g, or t
  misc_feature (514)..(514): n is a, c, g, or t
  misc_feature (516)..(516): n is a, c, g, or t
  misc_feature (518)..(518): n is a, c, g, or t
  misc_feature (522)..(522): n is a, c, g, or t
  Genomic contig location: Contig_ID=SeqID_29461; Location=909..1453; Strand=-
  SCN-specific regions: Sequence locations=1-29,63-266,288-327,355 -355,409-545
atgctcagatttggtcaattcagtgatgaaaataaatttcacgcaattaaagaagaaattaagaaaaaagataaatattcggcaaaagtctcgtataaaactgagcaaaaaattgcgaaaaaattagaacaaatcgccaatatattttanatggaaaaaagaatttaatttaatgaaaagaaagaaaaaccgaatgaattattatgaaaagaaaaagagagaatttgttgaacgaattgacgagttaagaatatgtcctaaaaaggaaaacataaagaatttgccaaagaattgggcatagacaaaaaacattattcctatggaaaaaggaatttggcattgaaattggtaaaagtaattaattanaattttaaattaaaatttaattttaaatttttagttaaatatgcgtattcgaatgaagaaaaaaatgaacatttgatataaattaaagaggaaaactcggtctctaaaagtgaaagaaattgctgaccttttgaaaattggaattgtnantntatnaaaatggaaaaaagtaaaataaa

SEQ ID NO: 59958 - DNA, 206 bp, Heterodera glycines
  Genomic contig location: Contig_ID=SeqID_29461; Location=1475..1680; Strand=-
  SCN-specific regions: Sequence locations=1-3,29-206
atgccttttcttatttttgtttttgtgctctcattcataataattcaactaaaaaagctttatcagtaaatttatgtcaaaagaatagaaaactttggccaacttttgctgaaatttttagccaaaaatgggataaagaaaaaattgaatttgaaaatgaaattgatcaaaacgcaaattatcgtaaaagtgataaaatgaattaa

SEQ ID NO: 59959 - DNA, 1033 bp, Heterodera glycines
  Genomic contig location: Contig_ID=SeqID_29462; Location=317..1349; Strand=-
  SCN-specific regions: Sequence locations=1-149,209-377,399-420,453 -530,574-665,821-949,971-1033
atgaatgggtgggaagagaaaggcacaaattgggcaaaaaaatggcaaattgagagaggtgagggaggagggagggggcgggcggggggtggaggtgagcgatggcaaatgacggatgatggcatcattccatctctaaagctgcattcaattaaatttaatatttttttttattttaaaaaataaaatgaataaaaatataattttacatgcttttttaagtgcctaattgtgtattaaactaaattagtaattaaacgtaaatttttacgcattttttgccgttctaaaatgcagatgtgcaaaattgttttttctatatttctttttattttaatttttcaccaaatttcaccaatcgaattcggcgagttgggagaagaaaaagaagcagttcaagcagaagatgaagcttttttgaatgaaaatgaaagtaaattacaacaaaatttaaacaatcttaaaaatttttttagattccgagtcaattcaagaaacaatatttatggaagagaatgacactgaccgttatgaagatgattacgacaatgatgatgatggtaatgacgatgaattagattatgagtatgaggatattgctgtcactgataagacggcatttttcggacattttgactcaattaaatcagacaatgaaacatttgaggagacagaggaagagcagcagaatgaaagcgttgaagagagagaagagcaatttgagggacaaagatggaagttacgggagaggaaggagaaagaagaggcgggaaaagatggagagaagcaggagaaagaggagggaaaatgcgagaaggggtggctcaattaccgtaatgagttgtgcttctacggacgccgcacagagaaggacttttacgcgggggttgaggaatgtgcccaaatgaaagtaaatggcggatggaaagcagcagcaggaatgccaatttgtgtaattttgctttttaggcaaatttcgcttccttccacagtgtggacgagttcaccttcatcactttccactgggacttga

SEQ ID NO: 59960 - DNA, 97 bp, Heterodera glycines
  Genomic contig location: Contig_ID=SeqID_29463; Location=514..610; Strand=+
  SCN-specific regions: Sequence locations=1-97
aaattagtcaaaatacatgtcagattcgtgattagcgacctttaaaaccccggataaaaaattatcatggttttttatcttaaaaaaattttgcaaa

SEQ ID NO: 59961 - DNA, 1734 bp, Heterodera glycines
  Genomic contig location: Contig_ID=SeqID_29465; Location=254..1987; Strand=-
  SCN-specific regions: Sequence locations=1-88,110-676,719-724,747 -915,1056-1058,1425-1445,1578-1663,1685-1734
cgttggaagcgcgaattggacaagcgaatggcgcaacggaaagcggcggagaagcgggcggcggaaacgctcgcggaacaagaaaagcggaaaaaggaggagaaaagagcggacgcggaaaaagtgcgcggaagcaattttgaatagcgcttctctcgagagtctgtcttggtcccgagctttgacccccataaaaattctgattttgggttttgaatttgactgattctcttgtcccagaaaatttctctaactcttacctcgggggtatacttagtgtcatatgcctcaatctcgagatatcctcaagaaaagcaattaaaagtttgttttttttattctgatttttaattttctctcagacttttgagcattggaaacgcacggaggcacaacgcgtgcgccgtcaacgcgagcgggcccaaagcgcggtgcagcaacgcgaagcggacgagcggcgacggaaggaggcgaatcggacgaaggcggacagcgcgtttggggaatggcgagttttttggaaaaaaatattttaaattcatacaaatggataatcgtgatacccgagacagaaaattttgccaaaactcgagaccccaaacaaatccgagacttttcccgaaacgtcgatgaattgcaagatgttttaattaaataaataatctagttttctctctaattttgaaatttattttttaatttaatatatatttaatttgggctttatttgggcatttttaaaaatttttagtctcacaaaatgtgcgccaaagagagagggagcgaatggagcacgagcacgcggaacagacggaacacgagcagaaggaggagacggaaaagcggaagaaagaagtggcgcaagaggcgtacgaattgtggacgcggatgaaggcaaaatttaggaggaaaatgaaaaaaattttaaattaaaatctaatttattatttaaattaaaaaaagatttaaattgtattctaatttattatttaaattaccaataaaaatgaattcaaattggaattcaataaattattaaattttaaataaaaaatgatttaaatgaaattaaatgaaattaaattaatcattaaaaaatgatttaaattgaaatttaattaattattattaattttcaataaaaaaatgaattaaattgaaattattattaaaattttcaataaaaaatgattttaaattgggattcaattaatatgaattttttaaaataaattaatttaataataaaaaagaaaataaatcatttagatacaaataaaataaattttatattgtttatttgaagaatcttttaaatattgtaaattgaaataaaaataaaaattgagaaaaatatttttcaattaaattctttttttcttaaacctttttatatttttcatttatgaaaaatataaaaatatgttttattggagaaaaatcacttttataaaaaaaaattttatattgttattttaaagaatatttttaaatattgaaaaggatttaaatttatagaaaaacatttataaataaaaattatttttttttgttttaaaatttaattatttatttttcacattttttcaggccgaggaacggcgatacacccaaagtttggcctaccgaattttggactttgaacgaaaagcgtcccagcggtggtgctccgccccgtggttgcccaccagtccatcgacgaccacaaaaatttgtcggcctcccccgggaaag

SEQ ID NO: 59962 - DNA, 1204 bp, Heterodera glycines
  Genomic contig location: Contig_ID=SeqID_29466; Location=81..1284; Strand=+
  SCN-specific regions: Sequence locations=1-320,342-598,623-829,851 -1165,1187-1204
atgcaaacagtttcagaagagaagccgaaaacggtcacttttgcaatgcaaactgatcaaaccgatctggtcaattcggagatgcagacggagacagcagagaagccgaagattaccaacaagttaatcactacagaggcgcagactgaacctgaagagaagcccaaaacatttgcttttggattgcaaactgatcaaaccggtttgatcgattcggagatgcaaacactgtctgaagagaaaccgaagatgaccaacgacgaggttcttgaactcaatgtctcggttagtttattttaaaaatgtttatttggtcttcatatattttcttgttgtcattttattctttgagactaattttatttttcgatgttgcagaaattgcctatggatgctgattcgtcatttctcagtaatcaagggcggagttcccctttgttggacgaatcattgcgccgtaaatacaatgaaaagtgtgaagaaatggcagaattacgttatgtaatttatctttttcttaaaatcttttctaaacattttctacaggcatatgagtttcaacagtcaatcatttctaatcaactggacgaaattgcgcggctaaagcaacaacaacaactacgaaatggcgttcaaaaaaatgggtgagcgaagaaatagattcttacactgacaatgagtacgtttaaaagcgtgttacttttttgaattaaatgatgctttccgattacaatacaagtcattgttcagaagtccgtcctcgactcgtcacccaaccattactgctgcttcgccgtcgtccgttttccctagcggtgctctgcccaccatttcgggtcgaccacgcgctgcaaggcgaacttattgcgaacattgcgaaatgtttgacgcacacgactcgtcagagtgtccaaaagaagaggcaaaaagagcagaacgacgcgaccatgaggcactttcaccgcagaagtgggacgaacgggaacgcaccttctggcattaatattgacgatgcatttagacccaccctttttctctttatttttgtccattcgtttgtatgatcttttgactttaaacccgtgtgcctttttctcttttttttgtctcattgagtttaattattttcatcagctgcctttcatattcttggttcggtttcctctttgacttttctttttacattaaaaatcgtaaaaactaa

SEQ ID NO: 59963 - DNA, 133 bp, Heterodera glycines
  misc_feature (116)..(116): n is a, c, g, or t
  Genomic contig location: Contig_ID=SeqID_29466; Location=1442..1574; Strand=+
  SCN-specific regions: Sequence locations=1-72,99-133
gactgaatctcaaaaatgaacggttctctgacaaatggcaacaaagtcgaccgcggcgtcaccattcttttgggcgcgcaatggggcgacgaaggcaaaggcaaagtgttggattntctcatcggacatcaca

SEQ ID NO: 59964 - DNA, 1455 bp, Heterodera glycines
  Genomic contig location: Contig_ID=SeqID_29467; Location=303..1757; Strand=+
  SCN-specific regions: Sequence locations=1-311,333-500,522-593,615 -620,643-697,719-825,864-880,905-958,980-1119,1143-1185,1217-1455
  Gene Ontology: Mol. function=dephospho-CoA kinase activity; Cellular component=intracellular; Biological process=coenzyme A biosynthesis
ttgttgagccgggcaaaaaggcatacaatcggctgagggctgagtttggcgacagttttttcgacgatgaaaacggcggagttttgcgacgagacaaattggccgagttggtgttcaccaatgttgaagtatagtttaatgaatttcaccaaagatttttttgaaattaaaggcttacaaactaaaaatttagaaattttgaaaaattcgcaaaattttaacccaaaattagtgccaattttgaaattaaatgtgcaaaaaatgtaatcccagaaaaggaaacggttgaacgcgatcacacacggcgaagtcatcaaagaaatgatcaaacgcattctgtgggaggcggtccatctgcggaaattcatctttttggacattccgttgctttacgagaccaaaatggaccgatttgtgcagaaaacaattgtcgtggcatggtaaacagaattttcacaagcttcagcaactttaagtgccccctttttttcgaaaaaacgattttcaaaatgtaatttttagtaattaaaaatcggaaattttaccacccatttccaatcgttacggcattgtaaaaacaaacagtttttttcccaaatttttgatttttgaaaattacaaaaaatatccaacttctaagatttgatgacccacaaaagatgagacttttctttaaaagatgggataatttcttacggttttcccaaagttttttgggattagagtggacatccgctgaagaaaatttgaatttttttaatcaaattttgttttaaaattggaaatttttcaggaattcctctcatacttttttcaatgcaaattttcacaaaaaatttgatttccaaatttgattttaattttaaaaaaactcggagattttaacattaatttttctcaaattcttgtgttatgacaatttttttccccattcccttcaaaaaaagggattgccaataaaaataaataagccaaaattaagcaatgacgacactcagttgtggcgcgtggcgttgcgcgacgaattggccaccgacgaagcggagaaacggatcagagcacaaatgccaatggaagaaaaggcacggaaagcctcatttgtcattgacaacaatggtaaattttgcggcttttttcttaaatccgatatttatccagatttcttggccacggtcaatagcactcataattttttttatttattttttatttaaaacaacaaattttaaagacgaatttttgctagaaagactttgaaaaatttgttaatttttcatttttttttcgtttaaatttcaaaaaagtgtgtacgaattgccaaataataatgacaccctttggcgccaaaactgtaaaattattgttttacgtaataattgaagcacatttttaaggcagtcttgaggaaacggagcaacaattggatgccgttgtcgaactgcttgagtccagctg

SEQ ID NO: 59965 - DNA, 420 bp, Heterodera glycines
  Genomic contig location: Contig_ID=SeqID_5997; Location=1234..1653; Strand=+
  SCN-specific regions: Sequence locations=1-54,76-420
atggaagtcgatgaggaagacgacgacaaaacgtttgactgggacgtcctgtgtgctgaggatcaggatgatcacgaattttgtgccgtgctccgcgtgtctgaactcgtcccggcgctagggaatgccgaacttggcacaatggccgtgaaaacccctctacacgctcttttggcggtgtttttgctgaaagcgggaacagtcaagtcaatgaccgcagcgcgaagtctggtcaaagcgataattgaaggcgagccaaaagaagaaattcgcttatttgtggccaaaaagggagattttgtggcgaccggacagtacccaacggagaaagatcaaaagaaggctttggaatgcttcttcgaaaagtgtttggtggccagacgcgccttggagaaagcaaatttgagaagattggcatga

SEQ ID NO: 59966 - DNA, 312 bp, Heterodera glycines
  Genomic contig location: Contig_ID=SeqID_5997; Location=1727..2038; Strand=+
  SCN-specific regions: Sequence locations=1-312
atgggcgttagaacaattgagggcaaaaatcgtgcacaagcctcaaaactgatggcacacccgcgtatcataatcggtgatcagtctgctcaccaattggcggaaatcctggaccaaacggcagtgattgggcccaaaaatggaacattggcggaaacagtgcgcactctgaagccagtggtactgtcgagcaaagtgaaggcagctctgattattgccggacgcgactctcttctgagagtagaaactgtcgaaatgatgatggaacagtacgaaatgatcgcgaatctgtgcgccgttttgcacatgtga

SEQ ID NO: 59967 - DNA, 436 bp, Heterodera glycines
  Genomic contig location: Contig_ID=SeqID_5997; Location=2273..2708; Strand=-
  SCN-specific regions: Sequence locations=1-436
atggtcaaaagtcaactgatcactacatccccatcacaacaaaaaaggcgtccctgccgttcgatcgaaaggtgtggtgattcgagcagaactataacgttttaattgcggtgattcgacgacgatccacggttcggccagaagacgcggttgtctccactgctgtacgggtggtggtgatctcggtgggctcttcctccgaacgtgtggcgtcgatggtcacccagaccaatcgagcccgaaccacggcgatgctgatcacgataaccgatcgaaccaatggtgtggcgccgatggtcccccagaccaatcgagcccgaactcgaagtgctcggctgtcggtggtcacccagaccaaccgaagcagcgacgtgaactgccgaccgaattgtccgaattttcaatttttgatcacccgggaagtctgactgagtga

SEQ ID NO: 59968 - DNA, 515 bp, Heterodera glycines
  Genomic contig location: Contig_ID=SeqID_5997; Location=3476..3990; Strand=-
  SCN-specific regions: Sequence locations=1-13,42-83,106-316,340-515
atgaaactccacctattattagttttaattatatttttaatcatcgaaattgatcaaattaaaacggaaaagaaaaaattgcaacagaaatcatttgatgaaatatttggagaaaaacgggaagaaaaagaagaagaaaggcgaaatgaactcaaaaaaagagaaataattgcaaaattttataaaataaaagagaaaatcaagcaaaaaggaagaaaatactcaacaaaagaatgggaaaaaattgaattaaaaatagcgaaaaaattggggacaaatcgaacgacaatttataaatggatcaaggaattggggcttaaaaaaaaattattttaaataccctaaattttgaaatttttcttagtgaaaataagtgaaaacagtcaattcaaggattgggagggaatcattaaaaactgaacaatgttggaactgggctcccagtatgcctaaattttcgattttagaggccttgtaaaactccttggggttttgctagggtgaaaaacaataaa

SEQ ID NO: 59969 - DNA, 1397 bp, Heterodera glycines
  misc_feature (1376)..(1376): n is a, c, g, or t
  Genomic contig location: Contig_ID=SeqID_5998; Location=151..1547; Strand=-
  SCN-specific regions: Sequence locations=1-49,71-95,118-136,158 -274,361-462,568-610,639-665,687-705,854-913,935-959,982-1000,1022 -1278,1300-1397
atggggacatatcgcaaaaatatttatgaatggattaaagaattggggcttcaaaaacaaataaagaaaagctataaatcaaaaacggatgaagaaaagttagaaattgtacaaaaattcattgaaatggcaaatgagcttaaagagaaaagaaaatattcgaccaaagaatggaaacaaaattatgccgaaatttgtaagaaaattggagttagtcaaagaataattgagaaatggaagaaacaatttgctatacgcagtataaaattattcgttattttttcttcaattttattccattcttttcttgagtattttcttcctttttacttatttttttcttttattttataatatttttcaatggggaccattttaataaaatgtgaattaatggaaaaaaaacatttaaaaactaatcattattttacttattattgccaataatttgttcagtagaacaaaatttattaaaatctaaaaattttttatttacattaaattatttttttatatttgtaaaagcagaagatttagatttatattatttataaaaataaaaaattaccaaatttattttgagaatttaagaagaaaatgaaactccacctattattagttttaattatatttttaatcatcgaaattgatcaaattaaaacggaaaagaaaaaattacaacagaaatcatttgaagaaatatttggagaaaaatgggaagaaaaagaagaagaaaaacgaaatgaactcaaaaaaagagaaataattgcaaaattttataaaataaaagagaaaataaagcaaaaaggaagaaaatacccaagaaaagaatggaataaaattgaaagaaaaattgcgaaaaaaatggggacatatcgcaaaaatatttatgaatggattaaagaattggggcttcaaaaacaaataaagaaaagctataaatcaaaaacggatgaagaaaagttagaaattgtacaaaaattcattgaaatggcaaatgagcttaaagagaaaagaaaatattcgaccaaagaatggaaacaaaattatgccgaaatttgtaagaaaattggagttagtcaaagaataattgagaaatggaagaaacaatttgctatacgcagtataaaattaacggaaaaagaaaaaatggaaaaaatgaaaatttattgggaaataaaaagagaaaatccgaaaatgagtgacaaggaaattgcaaaaatgatgaaaattgatagaaagaacatttcaaaatggaagaaactgtttggataaaagaatcattgaaaattgaaaggatgattataagaaaaattggataaatttgccgaaaaaattatcagaaaaactatgtcaatttctagtttttttttcanattttttgtatttgtattaaa

SEQ ID NO: 59970 - DNA, 1064 bp, Heterodera glycines
  Genomic contig location: Contig_ID=SeqID_29472; Location=1..1064; Strand=-
  SCN-specific regions: Sequence locations=1-282,311-311,336-397,436 -616,822-1064
ttcaatcggctagtgctttaaggttttgtgttttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgctttttttttcattattccaatcgaccacgttaattcattctctatacatttagtgtcttatttcatgaaattata

SEQ ID NO: 59971 - DNA, 1330 bp, Heterodera glycines
  Genomic contig location: Contig_ID=SeqID_29473; Location=67..1396; Strand=+
  SCN-specific regions: Sequence locations=1-78,100-520,544-644,666 -755,781-1330
atgtgttacacggtttcaactcagaattctttttcaataactgatttctccacaattaaggcagatactgaacatcccgctgctgctgctgttgtggacaactttgagacgctcactctccgcttcttcgacctgatcaacgatggcaacatccaacaattgcgtgtgctgatcgattcgctggatgccgacgagctgaacattttgctgtggtggacggttgatccagtggagcgcgacaacacccgatcacgatcagctctttggactgccttcttacgccaacacatccaaattgttgatctcttggtagtgaatgaacaattttatccgtcggcactaatttttgtatgtcattttcagttggagaagggcgccgatccggatgagccagtggctgaccaagtgaacaacataaacacgagtgagtgggtgtggtgttgatgatgatgaaatcgtttttacaatgcatctaatttggtccctggatttggctcggaattggtcgaaacggataccggaaaataattatatttttgctttccctgaaaataatggtgtttccccatttgtgcagatatgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaattttgaaaaaatgcgtaatttttccccgtcttttttccccccacagtcacatttcttgtcgagaatggtgccaacatcaatctgcagaatggtgatggggcaacagcactgatgtacgcgtgttacacgggaaatgtagggaaaaatttccattggtgaaatgttttcctacatttttccatttgaattcaggtggacattgtgcgcttgttgctgacacatggtgcaaatgtcgagcaaatggatttcgaaggtgggggattactgttacagtacccaaaaataccatgccacaaattttgtctctaattttcaggatactttccgcttattgacgcagccgttggcggcagtttggaggtgtgccgtctgctggtggaagagtgggccgcagatgtcaaccaacaaaccatccaagagcgatacactccagtgatttgcgctgccagtaaaggacatttggccatcggtgggagagaattgtggcaaagtgccaaaaatgtaatctccctaattttcagtgaatttcctcgtcgaacatggcgccgaccttcaacatgttgacgtggacggacacaatgctttgatgtag

SEQ ID NO: 59972 - DNA, 55 bp, Heterodera glycines
  Genomic contig location: Contig_ID=SeqID_29478; Location=779..833; Strand=+
  SCN-specific regions: Sequence locations=1-55
atggacaaagacagtgaagtgagtgggattggcaagggacaaatggacaaagaca

SEQ ID NO: 59973 - DNA, 843 bp, Heterodera glycines
  Genomic contig location: Contig_ID=SeqID_29479; Location=142..984; Strand=+
  SCN-specific regions: Sequence locations=1-110,136-156,194-525,547 -564,586-843
atgcaaacgatttttcttctctcaagctgctttgatggtcatcgtccgcagatgtgcaacttgattaaacgttgcgatgaatgtaacagaacttttcaagtggatagaaaaaatccccacaaatgttacagcaactattgtgcgcgatgcaaggtattttttctctatttatttattaataactcctccaaaaaacacaggtataccatgagaaggaaggcgcgtgcttcatcaaacccattgtggtgcctgacgaaaagccaaaataccgtatggtctgctgggacacagagacccgattggagcaactgcaacaggcgggacaacagcgacacaaggtcaactacctgtcagcacgaattacctgtacggagtgctgtgattctgaaaatggtatgcgactcaattgtaaaatttgtttgacaacctacggagcgatggaacgaacaaaggattggagcgaatcggaaggacatgagccaatttcggcatttgtcgagtggattttgaaggcttgggacaacaaataccaaacatttatttgggtgagtttgtgatcgtttttaacatctttgttatgcaaaaataattataggcacacaatgcctcgaggtttgatggccattttgtgctaaaatacctcggcgagacaaagcgacgacctgaggtcatcatgaatggcctcaaaatttttgagtttcgtcttcaacattctcggcgccactcaaaactcacatggcgagactcgtgcctactgatgccaattcgtctggaagaaatgccgaaaacattcaatctcaactgtgccgataaaccattcttcccctacgctttcaaccgaag

SEQ ID NO: 59974 - DNA, 703 bp, Heterodera glycines
  Genomic contig location: Contig_ID=SeqID_29481; Location=185..887; Strand=-
  SCN-specific regions: Sequence locations=1-86,108-250,272-703
aatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaac

SEQ ID NO: 59975 - DNA, 1935 bp, Heterodera glycines
  Genomic contig location: Contig_ID=SeqID_6000; Location=211..2145; Strand=+
  SCN-specific regions: Sequence locations=1-156,178-356,382-581,611 -619,641-860,884-1052,1074-1297,1319-1485,1507-1566,1722-1727,1749 -1818,1924-1935
atggaaccgaagttcgcctcaattctgtcggaattgcattctctgaacaaatccgtggaggaactgaaacggacggtggcgacggtgcacactccgccacaacggcgcggactcatttcagtcccggggatggtgggctcaaccggaagcagtggcagcagcacaaccaagcagacaatgctgaacggttgccaaaactacgcaaaggcgccagtttccaccggtggcagcgcaacgccaacaaaaattgcgttccgtccctacccaatgaacaacggctcacttcggtatcagcagcacaacaacgccaaggcgccggcagaaaataccgtcaatttggaaattggcagacaaacggcacaacagcagcagcaacatcaggtggggaagagcaaagacggacactggccaaattgtggccaattttgctgcttttacccgatgctttttctttagcgcgttcggctaattaacacgcgcaatgactttgccgggggcactgatcactttccgcctgcttcatcttctgctgctgacaatgtgatgaaattcccgcctctcaaaaacgacttcaaattgatgcctttgacttcttcttcttcttcgacaaattgcggcgaaaatgccctcctcaaaatgccattctcgtcctcctcaattccgtgggccaccacgaagccatcgacgcatgtgttggagccgccaaaattgaccaaaatgggcacggttgggctgaaaaacgggcggaggagcgttcggaagtcggtgcacgcgtacagacagcggaggaaggaattgtcatatcggcacatgaaagagatcggactgaccgtaagcgaagctgagggaacgaagcaccgaaacaaaaaacaatctcaccaaacagttggtcatcaacggagtgccaaagtccattttccattgccgcgtcactgacataacaaacgccgtgcagacgaagcgaagggaattggcccagcagggccaaagagtggtcagtgccatcaaaagcatccatcactttgccatgtcattttgcttttgcagttctaccggggccgggacgtgaccgacgcgctgtaccgcgtggagtgttcccgcgtgatggtcaacggccgtcgctgtggccaaatgatcgcggactctctgtggccgcggggcttcttccgccaacgcatgcttatgccaatccttcgcggggttagccatcgcacgaaaaggcgcaccgacggaacgatgagagaggcggtggccaacgaccaattcgaagtgttcaaaggtcgaaaatgccgagggaaaagaaatgagtggaaaatattattccgtttgagaggctttgcttcggttgggcggctttttgatggacgagccggacagatacaaatggatggaaacggcacgggagggggtgaaccaacgggggctggacgaattggcaaactcaaagagggcgcacttcgaatttgagggcggtccgctattcggggacgaaattgtgggcggggaggagcagcaacagattggcattgacaacgaaacggcacaggtgggtgaggagagagtgttagagagatggaaaaagagagagagagaaggaggaacgagagagagagaaacgagtggaaatagagagagagcaaaacgagtggaatgagtgagagaaaggggacggggtgaatgaaagagagcgagagaatgagagggagagagagagagagagaatcagattttttattgcagcttctcacgtccaaactgttcgcttcttcgtattcggaattaccggcaaatttattattggctgaaaatggccaatatgatgaggacgacgaagagatggaagaggaaaacggagaaaatggggagagagcggagggggaggacggacaaagcccagtggaagaagatgaagaggcggaggagctgaatttgtaa

SEQ ID NO: 59976 - DNA, 2953 bp, Heterodera glycines
  Genomic contig location: Contig_ID=SeqID_6001; Location=1..2953; Strand=-
  SCN-specific regions: Sequence locations=1-130,310-341,364-531,703 -750,780-809,834-1048,1074-1114,1136-1216,1238-2129,2151-2310,2415 -2555,2588-2953
  Gene Ontology: Mol. function=metallopeptidase activity; Cellular component=extracellular; Biological process=skeletal development
aaaagcatttgaataagagcataataagaataataatattgagtaagcgaaaggtcagtgtttttgcttaaaacagaaacactcggcatttaattgcattcacttgcagtgctagcggacccatcctggtcccctcctccgggttccccccggcttccccccccattactccctgccccaggcttttcccattccctccccccggctttgccccctcctcctccctaccccaagcttttcccattccctacccccaagcttttcccttttctctctcttcctccctccctctctcaacttcctcttccctattagatcactttattcctcttttcgagtaccccttctccccctccccattctgtccatgcccaattttttttattgtcgatcgctcgaagcaatgaaagcttcttctccacaaatttgccgacgattcagccaaagtaacaggaaccagtaggaaaagcagcggaggaagaagacgtgcgcagcaatcgcacctttccaatccatcggacaatgctaatgggagaagaagcaggggaagacgaaggagaaaaggcaaaacattaataataattaataataagcacaaaaggggagacaacggaacagcaaaggacaaaaacagaagagcaaaagcagaagaagcagaacaacatcaatcagaggaagaagcagcagaagaaggggaagaagcatcattaacaccacccccccccccctcattaactaattgctgctaatgggcaaaggaggaggaagaggaggaaaagcgactgctgcaacgcgtggacgaaagtgaaagcgaaacagcagcagaagggaaaaagcccaaggaacggtgggaggagaagaagccgaagcgtggccgtactcccccgcccctttcccgtcaaagcgacgaaacgccaacccacccgaaccaaacaacgcagaaagtgacacgcgaacccttgaaatttcgcataaattatcaagaacagcgtcactttcctaactttgggacgaaacggtgtcaaatcgggtgaatgaaatgtgccaaaatgggaaaagaatgccaaaatcagtgccatcatcaaaaaaggcgaacacagcacacaacagcagatggatgctcccatttcttttaggcaagtgcgacaaaacgaaatggcatttttgggattggcattttgtttgactgggacaaatgtggggcaatgcttaagaaaactcatatttctttcatactgtatgaccgtaaggaatgtttttagtcatttttccgttgggaagtgccaatttcaacagtctttccatcagcagtttaaacgaaatggactttacaaatgcagaaaaactgtcaagaggtaaaagttttttgcggaaaaaatttaaaaaaaatacaaaagaatttgcctagaggaactgaacagagaactgagccaagcggaaaaggtaaagcgaaatggacaaatgagcagctgaaacgcacgcacttcagagatggatttaccagtcggacattcggtcgacgcgacggagcaaaagcggacaaagagacaaacggaacggagtgagcagagcggccaaactgtggccaaacgcacgcatcccttatgtgatcagcacacattacagcccacacgagagggcactgctggccaaggcagtcaaacaggcaggaaaatgggcaaagggaagaagcctaaaggggaaggagtagcttaatgggcaaatgggggagaaatggccaaataaggacaagcctaagggtgatggatagcttaatgggcaaatgggaagaagccgaagggggatggggaaataaatgggcaaatgtgggaggaatggccaaataggggaatgggctgaattgaagaagccttaggaggaggtgtggacgaatgggaaattctttttgcccctattacagtaccacgaccgtacctgcgttcgctttttgcctcgttccgcttcagataaggcttaattgcccatttgctttttcgtttacaaaaatgccatccgttttaaacagtgattatctcttcatcggcaaagttgacggctgcttctccgaagtcggtcgcaccagcggagtccaagtcctttcgctggacaatgggtaattaatcggcaattaaatgggcaattaaaccaaaaagagtaattaattccaaccatttcagttgcatggattactctacaataattcacgaggtaataaaaccattcaatgggaaaatgacttttgagtttgttatccctttccaatagataatgcatgtcgttggcttttaccacgaacacggtccatttttgttaattttcattaattaatcagctaataattaaatgatagtcatattcattaattagttggctaatatgaaatgatagtgtttaattatcataattattaattattcagagcgatgggaccgcgacttttacattgacataatatggcaaaacatcgacaaaagtaatttatacttaatgttgcgtttccaaaatgtcggagtttcgaagtgtcaacattaaaatttatgcgaatttttagaagcaataattttattaaattattaaaaattaaattgggaaaatcacttttatttactctggtcattttgttgaggtgcccttgaccaattcggcaaaattgacttgaccaaaacgagttattacggtcagccgtacgactacaaatccatcctccattacgttcgtttgacctttgatttgtgtcttgaatttggcaaataaatgaaaattaggacagtttggcattcagcaagaacggattcccgacgatgttgccaaaaaaaggaggtaaaaaacaagggcacccctccccattcattccgacccctccccccaatgttttgcggccacaatcggaaacgccaaggacttcagtgagatgtgagactttgtagcggaacttttgaggagtgaaccaaaa

SEQ ID NO: 59977 - DNA, 830 bp, Heterodera glycines
  Genomic contig location: Contig_ID=SeqID_6002; Location=416..1245; Strand=-
  SCN-specific regions: Sequence locations=1-587,622-728,760-774,796-830
atgcattttccgccgaccattcataacgcccaaattcgccacggtccgctgaagccgccgaatatgagccgaagcccaacacagccggacacaagccttggcaaggtgtacttggagtgtgtggccagcttttcggagccgacaaaggccaaatggctattcggagagagcgaactgagcaaaacggacggacggtttgagttcagccaggaacagcaggacacgaacagggacaagttcatctgcgagatcaaagtcagtgggagggacgaagtgagcgacggattggccacggatttcagaatttggacaaatcgctgaccggagtctacaagttggtgttgatcagtgcggaaggccgtgagaacatcgccacgttcaatctgcccctggtgggcatcgaaaaatgcaattggactaatgtggccgcttctctgacaatggacccaatggtcgtgcgagaagtgccactccaacctctggtcccgatcagataaagcgcaagaatggcggaactcgaaccgatcgatcgacggaaaaaatcaatcaaatcgatcgatcgttccccggtgatttaaaaaataatcctctcaaatgtttccttttccaattttattctttaaaaatttcttcgttcatttcattacgtctcaatttctgcatagtttttttctctttttggagattctctttcctttaaattgcataattttttatggcaaagcgtaaatttaactttgttttaaatattttattttacctcatcccttccgcttctcttcttattttttctctaatttctggcgtaatgccacttcttcaagaataaa

SEQ ID NO: 59978 - DNA, 322 bp, Heterodera glycines
  Genomic contig location: Contig_ID=SeqID_6002; Location=2085..2406; Strand=-
  SCN-specific regions: Sequence locations=1-16,38-45,67-201,223-322
ctggcgaaaccctcggcagaatggaattggtccttttcacggcgaatttcttccacaaattccatgtgccactcattgaatttgaatggaaagaccacttttccttttaaggtttatccttgtgatcctttaaatccgccgaaatttgaaaagcgacaaacattcgctgtcaaattggcggattacaaatgcaaagtgacgaaaagaaagtgagaaaagagcaaatggaagtgccaatttggacattattaagcacatccatttaactttttgctgttgaaattgccaaacattcgcttaattaattaaacaaacattccgt

SEQ ID NO: 59979 - DNA, 772 bp, Heterodera glycines
  misc_feature (704)..(704): n is a, c, g, or t
  Genomic contig location: Contig_ID=SeqID_29485; Location=83..854; Strand=+
  SCN-specific regions: Sequence locations=1-292,314-364,386-545,594-772
atggcattggcagtttcttggcattttgccaagtccttttgttcgtggtgttgccgcgcaagccggaccaacgggcgcccatcctgcgactgatcagttttgtgcgcaactcgtgctgcagttgctgcgccgacaacacgttggacctggagtccgctgcaggtgcaagccttaaaaatttatccttgtattttcaatttcaaggacgtccttaaaaaactcaaaatattaacagcatttttgcgatctaaacgggtttgatttctccttgaaaaaggaagcataaaacctattaaatttagaattaaaaattcgtccttgaatattgaataatggaatttaatttttttcccaaaataatgccaaaaaacaacaaatttttcagtggtgacagcggacaagaagtgcagtgccattgacaccattggcattcatcggatgtccagcagaatgagcaacaaacaccgttggtccagccgcatgatcaccaatgttgtgggcgagatggaaaatgtcatccaaaaagtgcacggagaccagtatggaaataaataattttcaaatttgaattaatttaattaaaatttatttatgccaactgtcctgggtttaattaaacttattaaaattatctaaccttcaaaattcaaaaaaaaaaaaaaagaaaattcaggactcttaaaaatattggttaatttcattgngttcagcgtttaaattcaaatgctaaatttttacggcaacataaaatcctcattttgccacagtttca

SEQ ID NO: 59980 - DNA, 153 bp, Heterodera glycines
  Genomic contig location: Contig_ID=SeqID_29488; Location=752..904; Strand=-
  SCN-specific regions: Sequence locations=1-153
aaaatcgagcttccaaaactctacaataagtctgctgggcacttttctctcagatcaaacgccgacgcggtattagcctggtactgaagtgtactttttgagcacgcttcagttgccattttctgcaggccagggggtggctctattaataaa

SEQ ID NO: 59981 - DNA, 85 bp, Heterodera glycines
  Genomic contig location: Contig_ID=SeqID_29489; Location=705..789; Strand=-
  SCN-specific regions: Sequence locations=1-85
ttcgcccctatttcgcgaattttttgcccctatttaggtccctaaattggaatttttcgcccctaaaaatccacaccctactgat

SEQ ID NO: 59982 - DNA, 1005 bp, Heterodera glycines
  Genomic contig location: Contig_ID=SeqID_6003; Location=1054..2058; Strand=-
  SCN-specific regions: Sequence locations=1-397,419-647,669-769,804 -1005
atgattttgcttttgaacaaaagtaaatttgagtctaagaaaaaggcgaaggtgaaaatcgtggacgagtccgattggtctgccgaattccctttggacatggctggcagcagtgggcgagttatttgcaaaggcatcgccgaaggacagcgcgagtttgaatttgaggcacaatctgaaaacatttgtttgttttaatgcctttctccgttcagatgactgtcgatgtccaattgggtcagtccggcctcactaaagtggtgaccatgcagaaagagaaacgcaaaacgttggtggcacgttatgccaacacggaggaggaatcggtgcaattcacagaggcatacgaaggcttttgtcaaatccggaacaacgtaatgcttccgtcgttccgaaattttaattttttccatattttagttgatcggcctttacgttatcgtctctctgtccgacgaatcgtccgtcattcacatggagaattttgtgcccggaatggtgccggcgattctgatgaacgacaccaaatacccaattcgctaccgacagacgggccacggacagtggcaaattgtcaaggctaaccaaatggcaccatttgcgtggaccgactcgctgaatggtgctgtttctgtcctttaaatggctttttatttttcaaataatccttatggtaccacagccgaaatcagtggtcaaaaatggttgcttttttatttagaactaaaatgtccatttctttccgtgtccaatttttaaattgtgaacagagtcattttctttttaatttcccatttaaataatatttaactctatggaaattgggggcacaaatgttgcatttgttctttttttagagccaaagccattcctggagtgtgcatttgtgatgagtcaatcggaacatacgaacattgtccaaatcaaactgctggaggcgttggtgcaagaatttgcgattcgcattgaccgaacattgctcaacgaactttgtgtgaaaataaa

SEQ ID NO: 59983 - DNA, 62 bp, Heterodera glycines
  Genomic contig location: Contig_ID=SeqID_6003; Location=2087..2148; Strand=+
  SCN-specific regions: Sequence locations=1-62
ttttacgcgtcccatcacattttacgcgtcccaacaacagtttacgcgtcccatgacatttt

SEQ ID NO: 59984 - DNA, 2605 bp, Heterodera glycines
  misc_feature (2487)..(2487): n is a, c, g, or t
  Genomic contig location: Contig_ID=SeqID_6004; Location=37..2641; Strand=-
  SCN-specific regions: Sequence locations=1-44,149-501,523-892,914 -999,1021-1126,1156-1208,1230-1995,2023-2227,2249-2289,2314-2605
atgcacggcatcttcgaggctgccgaaggaggcggacatgacgaagaaggaggagatgacgaagaaggaggaggagacggagcaggaggaggagacggagcaggagaaggaggaggagacggagcaggagacggaggaggagacggagcagtcgccaacgaccagtgcccgtcagtgggaacagttgccggacaaatgccgtgcctatttggagttcatacaaaatcaactgggcgtacccgtcgaatacatcggagttgggaagggacgggagcagctgattgtgcgcacgaataacggagggtgatagagaaagagagaagtcataattattgtttgtaaatttattttcgaagcatccaatctgccattctaataaaagtgtgcctcattcaattctataaatgatatatcatttgacgtctctcggtctgtaaatgccgaattcgaaagaattttttagacaaaagatgggtaaactccaaatgaggggaaccgttttagattttgttgaacattatatgttttacccactcgacggttcagtctcgaaggcatttagcctacccatttttgttccttgaaaaggatccctcgtttggttttcgaaccccactttgactttttcgacccttctctaaatagtgctctttttgtaatatacacagcggcccaattttgggctctcagtgcaaataggtttattatttatttagtaatcagaacgccaaaactttgcaaaacttaaaatttttttgggattttcccttgtaaaaatagaagagccgatctcgagttaaaaactagacagctaaaaaataaactgtgattcgatagtagagggggacaaaatatgggcctatacaaaatttcaaaaaaagttacccacaggaaaaaattttttccatggcaaacatttcaatactttaattcttttttagccaagtgctcaatttaaggccaaatcaaataaaactaacaatattctctagaattttcccttcaaaatgagcataaattggttttatttgatctagtattgacaaagttataggctaaaaaatttcataaaaattatcgatgctgtacgtaactaactcttatgaaaataattttttttgacacgaaaacttttttaataaaaaatatttctgccttcttctttaaaagaagaaattgaaattaacacacaacatagggaggacttgaacctgggaccccccttttggtgactaactcacagaccactccgacgaaaagtccaacttatttgcgcttggagcccaaaattgactcgccgtgtgcatatatcgccaaagaaagaattttgtcaatatataggtagaaaggaacagttcaaattaaatctttccgggccttgggtacacaccgtttcagtttttgcctcccagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgggccaaccaacttggacaatcatggtatcattcgaaagctcttgatgaggagaagctttttctaagcaaatgctaagcgatttggtgtaccagagaaaagttatgaggctttaaaattttgtttttcttataacttttgagtttgacctattttaatattaacttgacctatcattagatgcagaatatttttctctatcgatatgcaaaatttgaagcggatttaacaagcagaaaaaaagttaaacaggatgaagtaaattcagtttttctctaataacagagacaaaaaaatagtacgccaaaatgagagatgcatttttctctggcactctctatttattggtacacatctcgttttttgaaacggtgtgggtacttgtttagtttacgggatagatttcacaaacatttttaactgcctataaatgtacatattttattcttttcttctcatttcccctcctaaatacgtgcaccttttcttttgcttgtggtctttgttttccaacgacatggcacgttatgccaacacggaggaggaatcggtgcaattcacagaggcatacgaggtttcatgagaaagtgtaaagaaaatttgaatttttttctgtcgggacaccaattccgaaggattccggcattccgccgatggaaataattacaaaataaaagaaaatatccctggggaaagtatttgttcattgggctttcttttaatgcatttgctttgttgttttgtttgttaaaccctctcactttctcagattgacattgtcgcgcgatgccataacggatcaaaactcgtaaaccaaaaaacgaaattattgaacaccgatcaatttgcagaaaacgtggcaccattcaacccggcagcattggtccctatccgttcgtcacttcgtccaattccaccgtcggcgngtgcatcaccggccttggcattccgccgacagccgtccgtcgcgtcatcggcgtggtcaaagcctaccaaacgcgtgtccgctccgggtcatttccgactgaactgcttgacgccgat

SEQ ID NO: 59985 - DNA, 357 bp, Heterodera glycines
  Genomic contig location: Contig_ID=SeqID_29492; Location=127..483; Strand=-
  SCN-specific regions: Sequence locations=1-3,25-357
atggaacaacaacaaaagcagccaaaggaaatgccaagtcccagcggtgcctccgccgccgcccctccgttgcccaaactttcggttcattccggcaatggcaaattgcgtggcggtggagttcgcgcagtgcgcgaacagtcggtcagttcagtgccattggacgcaacacgtgccacaatatatctgttccccgccgaaggcgctgcagcgactattctcgcggttggagcgtcgcttgggcctggcgatggccctttgcatggccaccattttgtgcgcgttggccatcaacggactgttccacgacaagtccgcgccacaatggtgcaactcatcggcacaattgagcaggaa

SEQ ID NO: 59986 - DNA, 420 bp, Heterodera glycines
  Genomic contig location: Contig_ID=SeqID_29493; Location=542..961; Strand=-
  SCN-specific regions: Sequence locations=1-420
atggcgaatttttctcctccttctgacaacactgccccaaaaaaatttctgtccgaccttgaccaactacaaatccccaaagaaatcgactcagacaactccattcccgactacgccaagttgcttattaagcagcttcattcccttttaagcaccgcctccgtcctaattcattcacaggctgcggctgtcgacgcggtcgaggaggaacgacgactgagaactgtcgttgtgacaaatatgcccgaaagcaaatcggacaaagcggcggagagagcccgggaggaccgtgccgttgtggacgaaattttgaatgccacggacgtcgaccaagcaccaattgtcttccgcgtcggcaaacgaatggatggacgaccgcgcccgctcaaaatggaattcccgaccaaacacgcagcgtga

SEQ ID NO: 59987 - DNA, 503 bp, Heterodera glycines
  Genomic contig location: Contig_ID=SeqID_29495; Location=16..518; Strand=-
  SCN-specific regions: Sequence locations=1-31,53-133,155-257,286 -396,418-426,448-503
caaaagttttttacaacaatatattgccaatctaatttcttgcagattgaaagccatccattgcctgccggttctcggcacagcaaagcactaatagggtgtttgactcacttcaaaaaataattccttacccaaaagttttttacaaccacttattgccaatctaatttcttgcagattaaagccatccattgcctgccggttctcggcacagcaaagcactaatacggtgtttgactcacttcaaaaaataattcattacccaaaagttttttacaaccacttattgccaatataatttcttgcagatttaaagctatccattgcctgccggttctcggcacagcaaagcactaatagggtgtttgactcacttcaaaaaataattccatacccaaaagttttttacaaccacttattgccaatctaatttcttgcagattgaaagctatccattgcctgccggttctcggcacagcaaagcactaatagggtgttgactc

SEQ ID NO: 59988 - DNA, 675 bp, Heterodera glycines
  Genomic contig location: Contig_ID=SeqID_29496; Location=619..1293; Strand=+
  SCN-specific regions: Sequence locations=1-675
atgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcatccaattcattctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggt

SEQ ID NO: 59989 - DNA, 1675 bp, Heterodera glycines
  Genomic contig location: Contig_ID=SeqID_29497; Location=163..1837; Strand=-
  SCN-specific regions: Sequence locations=1-323,346-417,439-581,603 -618,640-683,705-708,730-790,859-926,975-1054,1076-1195,1310 -1324,1396-1501,1528-1675
  Gene Ontology: Mol. function=heterogeneous nuclear ribonucleoprotein; Cellular component=nucleolus; Biological process=mRNA splicing
ctcaattacgcaccttcttccgctgctgcactcgttgccgctgcaactgctgcaacgcctgaaaccaactgcaacaactcaggcacgcaaaagcttcaccagcaaatggcattgtccgcgccgttatgtgcagcacagcaaaaccatgtcacaaccgcattggaggtgaccccaacggcaactgagctgctgagcaccaacggcactaccacgccaagtacaaatggtgttggccatggcagcagcaacggcaatggcaccactgctttggccccaaaagaattgtgcggcactgattttctcagatttgctgaacctcatcttcatcatcaacagcagcagcaggtgtttaacgtttcagctcaaagttaatatgggactgctcaggggcaatgatttttttttgttgaatttcggaattaaatatttaaataatttcgttttatacatttctattaaacggcgggcctcataaacacagtgaacaatcccccaaaaatgtaatgtgccaattttattgtatgaagcgggctcaaaaaatatcattgaaacttatagctacatctttttacatattaaattaaaataaatgactttatttttagttcgactctaatggtgccgtggcattgcaatgtttcgatgggtcaagcctctcccaaagttatcaagatttgtcggcgggtgttcaggcacagcccaactcaattttggtccttttaaataatattcatattacgccattttgttcccatttcagcgcataatcatcgattacatgctttacccgtaaatttttatttttttattaaaattattttaattttttaaaatttcttcattttaagtgtcacattggatgctttgttcctaattttttctcgctacggaaaagttctacgcattatcacattcaataaaaacagtaaaaaataaaataaatttttatttttatataaattattttaaattatctattctttttagatttattccaagcattaattcagctcagtgaagcaagctcagcacagaatgcaagtgcgttgcttaatttttaatctaaaaaatatactaattgttttccataaaatcaggaaactcattggacggtctcaatatatacaacgggtgttgtacggtaagcattatttctaattatttcaatttttcttacataaatgattttttcgtgaaaataaataattgttatatttttattaaaataaattaaatttataatcccgattaaactgaaatttttattaacatatatattgaaagcaaataaattatttaattattttttgactcggaaggaatcaaataattataataaattaaactctcttttttattttaaaaatatttatcatttttattacaaaatttttagttgcacattgaatattcaaagctgaacactttgaatgtcaagtaagtaacccattaattatgcccattttttcttaaaaagccatttttcatccttaacagatggaacaatgacaagagcagagattacacaaatcccaacttgccggctggcgatttgacttatgagcaaaaattgcagctgagtgagtcatctaccgggtgtcgatttttaaaatttaattacctaatgtattttctctggtttccattgacaaattctcctatggttggaatttaa

SEQ ID NO: 59990 - DNA, 804 bp, Heterodera glycines
  Genomic contig location: Contig_ID=SeqID_29498; Location=12..815; Strand=-
  SCN-specific regions: Sequence locations=1-134,156-804
atgcctgttctccgaacgccaccactaacccggacgagggcactcaaccagggaatcattgttgaccgcgatggaaacgcatttagggctgaaaattttggagtttcggggggcaggccgatctcgcccttagcgaacaacgaaaatcagcgactggacgacaatcatgaaaatgttttagcagagactgatattcgtcgtcgcctgctttacggaggaatggaacaaagcgcacctgaggaacaattggagtacgacgaaatggaaaacggcgacgaacaaaatgtcaacggtatggtccaacaaaatttggaaaatggagttgaagctggggatagagggagttttggaaacgatgcattggacgcgcatggattgcgagccttttcaacaccgcttaacgaacaaaacctaagcgccctgcagcgagacctaagaatgcaactcccggaaaatttgagcgtcatcgaaaaccaaattagggttatgaatttcatgcaaaatcaaatgccgaatcaagtcgggcaaaatttccctgcattaaatcatccacaagcggtcaatccaattgcttgtcctcgacccaatggccaattgtacgaaaacgcaccggttaattttgagcggcagagagaacagcagataaggctcacacagcaaccggttgttgaaggccaacaaccacacgttggcggattcctccgccacatgcctatgcacagagacacaacagttaccaggacgaaggatttgagtttcaccaaggacagcaacgcccaaatttcaaccaagacctgcctataa

SEQ ID NO: 59991 - DNA, 467 bp, Heterodera glycines
  Genomic contig location: Contig_ID=SeqID_6005; Location=36..502; Strand=-
  SCN-specific regions: Sequence locations=1-41,63-467
atgatgaagaagactttgccgattaatgatgaaatgatttcggaaagaatagaagcggaaagggaacgacttcagcaggacaaattgcgaaaacgctatgcatatgaagcaatttgtgctttgaccgacactgtgaacgaatcggaactgcaacgacatgtgagggaaacggaaagcatttataggggggggggggggggtaaaattaaatgttaatgtttaatctttaaaaactgtcgtttgcgtaaacgaacttatagctgtgtgattgtctgcagtaattgctctctttctttttcaagctgtccgttttggatccaacttcctggtgtgaagtggtcgaggaacgttttctgggccgtttgtgcggttttcccctttgtgccaaaacaatcactgtcgacttccgcaaaaagcatacaattgtgaggcggttgaatgaatccacaagaaaggaacacaaaatg

SEQ ID NO: 59992 - DNA, 2019 bp, Heterodera glycines
  Genomic contig location: Contig_ID=SeqID_6005; Location=1949..3967; Strand=+
  SCN-specific regions: Sequence locations=1-151,173-359,385-556,578 -988,1010-1729,1755-2019
  Gene Ontology: Mol. function=transporter activity; Cellular component= integral to membrane; Biological process=transport
atggtggagagtagttggcagctttctctgatcactcttttactcattcccatacttgccgtgttcatcaaagtgtacagcgtttattacgatgtgagggaagaaaagcgacgccaattcagtgcaattacttttagaatatcgccgaacgttcccaaatgtccaaagcgaatgccaatcgaatcgcggaggaaacgatcagcagcatgcgaagtgtccgcgcgttcgcagccgagcggcgggagcggcaaagatttgaagccgaattggacgccactcttcgggtggacagagtgcgcttttgaaccatttattgtactatatatatgtaaatgctgaatgaccaactgtcctttcgtccttatttattactttatttttcaattttagaccaaatccttcgctttggtcggttcccattggttgaacgaattcgccaacaatctcattttggttgggttgattagttgcgtttcctttgcattttcccaattttcggtggctgtgcttttatttggcggttatttggtgctgaagaagaaaatgacaaacgaacaaatatttgcttttcttctctatcagctgaaacttggcgggaacttttaccaattgagcaggtcatttagagagagaatacgaatattcttttccttaggctttgtgaacttatcgcctaaaaatggccattttgtgatattttttgggtataaattatacagattctcaaaaaacaaaacaaaattttccattaaaaaagtttttctttttcgtttagtgttgcaaatcggctgatggaaagtatcggtgcttcccgtaaagtctttgattatttgtcgcggcaaccaatgaattcttttgaaattggcaaagtgcggcccacacccgtgacgggcactttggaatttcgttgtgtgactttcgtttatccgacacggccgaacattttcgttttgaaggtgcctcctaatgaatgtgtccatgttttgaacaacgaacttttcagaatgtttcgtttattgttcgccccggtgaaatggtcgctttggtgggcccaagcggtgcggggaaatcgacggttttttctctattggaacgtttttacgagccaacgcaaggccaaattttgctcgatggcattccaataacgcgatgggaacatatttattaccaccataaggtccttttcaaggagggtttaattttgcctttcaattttaggtttcactggtgccgcaagaaccgattttgtacagctgttcaatccgcgacaacattctttacggtttcgacaatccttcggcggaagatgaagatggcggtgatgcggcggttaatgccgcgaaaatggccaacattcaagaatatgtggcgcatgagacggagaagggcttcgccacgaaatgcggcgagaagggcatccagctaagcggtgatattggcattctgaatcaaatcctataattgtttcgtttttttggcgaaggggttggggtgcattcagtttgtattcacaatttttcgatttttaaagatgtatttttttaattcgccaaaaattcgatccttaggagtgtttttttattttgcatttttgtgaaaatttccaaaaaatgccgaaatttgctataaaatgtcaaaatatgcatttatatgcagtaaaagccttcaccaaatcaaaaaaattaacgtaaaaccaatttcaggattatggaaaaactcgggattagccaaaaatttaaaggaaatatttatttctgtttccctttaaggcggtcaaaagcagcgaattgccatcgctcgcgcattggtgagacaaccgaaagtccttttgctggacgaggcgacttccgcgttggatgcgcgcaacgaacagctgataagggagtcgttgtccgcttgtgcgaagggtcgcaccgttctgatgatcgctcatcgcctttccaccgtaagacgtgccgaccgtattttggtgatggaacatggccaaattgtgcaggtccgaaataggaaacggttgtt

SEQ ID NO: 59993 - DNA, 474 bp, Heterodera glycines
  Genomic contig location: Contig_ID=SeqID_6007; Location=882..1355; Strand=+
  SCN-specific regions: Sequence locations=1-233,256-474
atgttcgttttcagttggtccgtgcttctctcggctgtgccctgttcgccagtttgggcagcaccgggcaggggtcggttttggcattggtcggcacaatcagtgagcgattcaatttgcagattactctcagtttttgtggtcgaaaacctaaacaaaggtgagcacattctccccatccaacattgttttttgttaatacattcgttttttttcttcaaaggacccattgaaaatatcattcaaaatttcaacatttccacgatgataacagtctgtcatttgcaacttcaagctcggataaccaaaagtcgaatggaattgcaagcgggtccaatcgaagcactttttgagaaaaattttggtatttgtataattttatcgctgacaatattttttccatcaattaggaaaagttacaacgattggaaacaaagtcgtccatacgctgaagtctttgcttcagccctttga

SEQ ID NO: 59994 - DNA, 938 bp, Heterodera glycines
  Genomic contig location: Contig_ID=SeqID_29502; Location=777..1714; Strand=-
  SCN-specific regions: Sequence locations=1-4,33-167,197-313,351 -411,433-716,738-783,806-938
atgtcaacaggaataataataataatatgccacaacgatgaagaccagccgaaagtttttgtgggaccaattcctcagggataaattccctaaaatccagaacattgccgtttattgtgactatccattgctgatttattcaagcggaattttcggaggaggtatgcaatatattttattgtataattttttaaaagttgttatggctttgcagttgccatgttcactaagccaattctgttcagtggtgtttatttgtcgtggtttttcaacccatacgttggctatacggacgattttggacaaattgtgcaaattttaattaattttagttaatttttaaaattatagtattacaacaccatggataatgtgaataattgcatcgtcatttttggcctatccacagtttatttgttgttttctgcatttctaagttggaaaatgtacaaaatgacagaaaatcagcaaacgtttcaaccatcgtggacacaaaaaatagcaaaaaaaaactattaataaaaaatactttgttttattttctccatttttcatcattaaaaccacaacactattttagaatataaaacaataatttgaaataattttaagcagtttttaattaatattcagacgtttctccaggtgattattataagggacgaaaaaaatggcaacaaaaacaaataatttagttataaatactttattaattctccatttttaatcagtaaaaacccttgccccctttttagaaaaataacattaattttgagtaattccaaatatttttaaaataaatattcagacgtttctccaagtgattatcataagtttgatacattcaattaccgccgtaatttacgccttaatgcaatatgtcagaatcggtgaaatttacatcatcgttggcacttatgcatggctttttacgaatg

SEQ ID NO: 59995 - DNA, 1147 bp, Heterodera glycines
  Genomic contig location: Contig_ID=SeqID_29503; Location=402..1548; Strand=-
  SCN-specific regions: Sequence locations=1-1147
atgtacgagatgaaagtgcggaagcagaaaaagcggaaccccaacgtcatcttccgtgattctttcaacctgatgccatgttcgctggcagcattggtcccttcctatggacttgatgtggaggacaagccgttcttccctcatctcgccaatagaccggagaactacggcatagaaatccacccgacacctgatgaatatttggctaatggaatgatgcccgggaagaggcgccaattcgacgagtggtacgccgagcaccgtcatgagccttttaggctcgatgaggcgcttgccaggtaatttcttttattattgatttttcagttattgcacaaacgatgttgaaatactgatggcagctcttgtcgcattccgccgtgaattcttcgagatttcgcgacgacaggagtacatcgatggaatcgacaacaaggaaaaccatgacggcatcgacgtgttgcgcgagtgcatgaccatcgcaggagcttgtatgcggcattttcgaactaatcatctgccctctgaacatctggccatcgtccctgagcgcggctatgacaacgcgcagaaccaaagcctattggcacttcgattcttccactggtattcggaggagcatggggtggaagtacagaatgcccattcggctggaggagagaagcggatcggtccttattccctggacgggtggattgaggccgaaggacgcgcaattgaagttaacggtattgattatatttctccttccgataaaaatcgataattttaaggttgcacttggcatggttgtaagaagtgctatccgaatgacaacatgttgctgcctaacggaaagacagcgggacaagtacgggagcgcgagccaagcggatggaataccttcgggcccgagtgaatcgtgtggacgtatatagggagtgcaaaattacgtcaatgctggagaggagcaaagccatgaggaagtgctttgcaaattacgtggacgacggacccctggtaatccgcgacgcgtttatgggaggacggaccggaccgatgaaacttctgcgcaaggcggggccgggggagaggatctcctactatgactttacgtcgctctacccatacataaagtttgttgtttttctttatattgccaaataaa

SEQ ID NO: 59996 - DNA, 592 bp, Heterodera glycines
  misc_feature (500)..(500): n is a, c, g, or t
  misc_feature (529)..(529): n is a, c, g, or t
  Genomic contig location: Contig_ID=SeqID_29504; Location=737..1328; Strand=+
  SCN-specific regions: Sequence locations=1-155,237-353,394-424,446 -476,562-592
atgtacttcttcgaaaatgcagactattatgaaaacaggcgtttgtcttgcgtttggtcagaaggatgggaagcgaatgagtgctgcgggaaaaattaccaacttgtgatcatggacaaaaaatacgtaaaaaatgtaaagattttgaaagttagaattaattaattttatttttattaaaattcatggcataattatacttaaatattaataaaaagttttatataatatttttaggatcttcggaacataaagccagaagtaagtaaacaataatgctttttgagcatataaataaaaaagtaacgaaatttgaaataatttttatttaaatggaatttccttgaaaaaacaaatttaacattaataaaaatttgatataaaatttttttaggagtcttggataccacattcagtaagtaaacaataatgcattttgttttaagaataaaaaaaataatgattctgaaatttggtttaatttattttatttttactanattcattagatttaaaagaataactttanacattaatgaatattttttatataatattttaggttcttcggacaccatattcagtaagataa

SEQ ID NO: 59997 - DNA, 443 bp, Heterodera glycines
  Genomic contig location: Contig_ID=SeqID_29506; Location=53..495; Strand=+
  SCN-specific regions: Sequence locations=1-279,301-320,348-443
  Gene Ontology: Mol. function=aminoacylase activity; Cellular component=cytosol; Biological process=amino acid metabolism
gaaatgcgctttttccaaggagattttcatcggtggaacggacgcgcgttttctgagagaggcaattaactaattggaattaattgcaattgcaacttttcccttttcagaagggcatcccggcaattggcttctcaccgatgaataacacgcccattctgttgcacgaccacaacgaatttctcaacgaaggcgtttttctgcgcggagtgaaaatttacaccaaaatgatcccacggctcgccaatttgccgtcattttgagcgaagtgccggcagaacaaagaaaagaaggaatcaaaatgatttctcctctaggccaataaattaattatatttattttaattcacttaaggaattcctttgccaattttattgcctttgttttttaatttatttcattttgaccaaatttatattcaaattgaaaccgaatttatgat

SEQ ID NO: 59998 - DNA, 863 bp, Heterodera glycines
  Genomic contig location: Contig_ID=SeqID_29507; Location=161..1023; Strand=-
  SCN-specific regions: Sequence locations=1-86,109-863
aatttggtgcgctttagagcactttctgaaaaaaatatttatgaaacaaaaaaatcgattttttcaagtgtccgtttggggtactcaaacatttatggggagcaaaatccaacgcagaattaagtacaggctatagggaagctactcccgaaggatcggtctccccattaatctgggcgcatcgttcggggggactgccccgaaaacaaaaaaaatcgattttttcaggtgtccgtttggggtactcaacaaattatggggagcaaaaatccaacgcagaataaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaac

SEQ ID NO: 59999 - DNA, 1023 bp, Heterodera glycines
  misc_feature (1015)..(1015): n is a, c, g, or t
  Genomic contig location: Contig_ID=SeqID_29508; Location=293..1315; Strand=+
  SCN-specific regions: Sequence locations=1-236,278-335,357-649,671 -729,751-966,988-1023
  Gene Ontology: Biological process=cell cycle
atgacatcatcgagcagcagaaatggcatcaaaaaaattgcaattcgtaaatttcaacgtaatttttgcattctttttttatttctttcataatatttcaaccgttttcaggtcgcaatgatccgtctgtatctaattttgacacaaattggtcagttttggaggactccgttaagaaaattcaggagagagaaagtgttacggttacttgcgtcgaattgtacaatgtaagtgttgttaaattcaaatatttattatcataaattaaagaaaaattgcatatttcgggatttactaattgtttgtcataatagttagctccaaccccatttaaaatttaattttcactttacatgttgctatttggtttatattttagaatctttgtgcatttaatccaagccctatattaagtacccttaattttattagttttgtttttgccaattgctgatatttaactctttcattttcaaatttcgcagatggtcgagcatttgtgccaaatgaattatgccggtgagatttacgcccgacttcaattgctcattggaaaatttgccgaggctgagtcggctagccttttggacaacagtctgaatgtttccaacgaagccttcttggccgcactcaatcgcctttgggaggccttctgccagcagttggtccgtttttggacggagaaacttctgattgtattattttacccttctcagactctcaccagaagtgtgtttctgtatttggaccggacttatagggtccaatccacttcatccgtttcaatttggttggtttccgcttttgccaactttttacatccaaaaggttcagggatgcaggattggatgcatttcggaggcatattttggagaggtgtggcatttgttccaggacagtgagtggcattttgcaactcatcgagcaggacagacgcggaattcaagtcgagtttaaaaaaaaataaaattggttatttatttcactgttttcagacaaataaccaattgcttanatctctga

SEQ ID NO: 60000 - DNA, 433 bp, Heterodera glycines
  Genomic contig location: Contig_ID=SeqID_29509; Location=192..624; Strand=+
  SCN-specific regions: Sequence locations=1-254,276-433
atgctcgactgtttcgctcgttctgtgggtcgtgccctgtccaatgcttcttcctccaacgaattcttcaacgtttcgcccgatgattgcctgcgcttctgctctacggagcgggcctgcaacaccgttgtctaccacaagcacttctccacctgccaattgtattcgggcgcggaggagggcgacacggcacgcgaagtgagcgccaaagggcacgatttgtacgtgaagaaggaatgtgaggagaaccgccgggagcaggagagagatgaagcggagaatacggcaccgaagggcggcaaactgtgagcagaagccaagaaggaaggcacagcaccattcaaaaagccaatggcacaaatggcgattttggcactttttcaactattgataataatatattttatggaacatttgtttcttcttttcacca

SEQ ID NO: 60001 - DNA, 1020 bp, Heterodera glycines
  Genomic contig location: Contig_ID=SeqID_29510; Location=377..1396; Strand=-
  SCN-specific regions: Sequence locations=1-1020
atgtcgcggtacaataatttgctccaatttgcgagtgtttcggcaggaaataagccatgccctgctggtggaccaatggcagtaattctcaatggagaatttcatcgccgcattagcagcatgcaagcaggaacaacccagattcctggctttggtcagttgtacattctggatccagtcgaagccatggagcagcgacggaaaaatcccacctttactggtgaaaaaatcacaaacgatgaagagtttgtgcagggtcatcagcttaatgaggcgacccttgaaattttggaacaagttatccaagaaaatcacccagctgcgtctgcttacaagcaggctcgtgaacagctccaagagttgttaaaacaacaaaggactgaagaactccgattcttcagaatgactttgctggatgagcgctctgctccgggtggtatgaaagacccaaagttgcatccccaccagataatcaccccctcaacgggtgaagggatgttcgcgattcatgcggatcccactggtgccccggcaccaaaaggaatatgggttgaaaacaagcaagggcagttgaacgaaattgccccgttcagtccatggactgatagcttgacctatccattaattaagcctaagggcgacgatggatataaaattggaattccatatgctaaacccgcacaaaggaagcggaaaagcgataattctgatgatatgtttgacacagaagcaatgtccgatgatgacatgtgcgagaccaagtcaattgcattgtcagataccggatctgaaacatcgacgcagtcagtgaccagtcgctatgacaaatcaaaaagatttgtctccctgcgcgattattgcaaatatcatctcgcaataagggatgaaaatttggagtggcaataccatcacattctttcatgtggcggtggtcttggacagcgctgggtcttagaccaagcgtccaaaattgactggcaaattgccacttttttgcgccgtccagacatggacctgcgc

SEQ ID NO: 60002 - DNA, 88 bp, Heterodera glycines
  misc_feature (20)..(20): n is a, c, g, or t
  Genomic contig location: Contig_ID=SeqID_29511; Location=1..88; Strand=-
  SCN-specific regions: Sequence locations=1-88
aaaattccctcaaaaataanaggtcgattgcgcaccgccctcctatcatgctcgagagcatttgtatgtgtataaaatttatcaaaaa

SEQ ID NO: 60003 - DNA, 548 bp, Heterodera glycines
  Genomic contig location: Contig_ID=SeqID_6008; Location=131..678; Strand=+
  SCN-specific regions: Sequence locations=1-147,169-384,406-548
atgcgatacgaatggggaccggtaaattggacaccggaaaattggacaccagaaaaaaaattttgtttttttcggttgcgggattccgactcctgaaatgttgtgcaaagttttgaaaaattttgcggaagttattttcgaatttttatatccagtaaaaatttctttaagggcaccgaatacatattttccatatatttatacatttcagtccattttttatccaaatttcggcatttcatggaaatatttttttttggaaacaactcttaatttaaggaaagttttcgtccaatgtgtgattattcatctgatatccatcatttcaattccattttatcagtgtaagtttatgatatgcgtttcaagataatttttcgccaaatatttaagatgttttcttcaacacttcttatttgttcgttacttgtcttttttatttggcaattgtaattcgtctggcatggattaagggttaattaaggatttaatttcctaaaagattggcacatctcatttttgatagagaatttgcaaatttttgaaaa

SEQ ID NO: 60004 - DNA, 1210 bp, Heterodera glycines
  misc_feature (1115)..(1115): n is a, c, g, or t
  Genomic contig location: Contig_ID=SeqID_6008; Location=1097..2306; Strand=+
  SCN-specific regions: Sequence locations=1-239,261-265,293-364,387 -416,438-911,935-1210
atgccgccactgatgcggcgacggcacaaaatcctttggacaaggaaagtgcgcgaatcactgtgctatgcattgctgtccaaatccatggcatatgttttgtgttacttggtaatctcaccattacgccatggtacacgatgttgacgatatgtacaaattacgacccaatcttgcaacaattgtattacccaatcaatgcgttcacatcgttgttttacatatcagacgaggcaatcaatttacaatttaattatttggaatcaaaaaaatttaaaaattaattaaatatcattagggtgcgatttttttgtttttaacggattttttttgcggttttattccgctgttagagaactgcttgaaaaacacaaataaataaatgaattaatgaaatgctgttagcatcatcggcattgaaaaaaggtttctttgcatgacatagaatttgttatttttggacaccaaatttgaatcgtctaattataaatttaattactttattgacactgagacaaattttcgaattagcccacactgacaatatattttttggttcaacctagcaccgttaaaacattaattaaaactaaattaattcgcccgtcaattgtccaaaattatttttgcagctctttttgttggccgtctgtatggacatgcgtgtgcaatttgcgcaaatgattcggaaaatgtttgtgccgtttcggaggcgtggaactcaaacaatgacagttcaaactgtacaggccaatttcaatagccgaatgcggcacaatgccaatgcgaattagtctcgacatacactctcgaatcattccaggacttgactgatttgctaacaaatgtcttggaaaattgttttatagcaatttaacatttcatcgagaaacaattacttatttcgagcatttaatattgttttttaaaaagagaacaatgaatgaaacaatgtaaaaatttgtatttaattggtcaatattattctacgcttttcaatattagctgacctaattaaaatttttcaagtttgtgttaatttgtggaaccataagctgtagttaatttctgacctttgtcggctacccatttattcgtcaaaaacatatttttanattttcttgaaaatgtttttgatttaatatttattcaccataaaatatatttacataaatttgaatgtttttttccaccttttattcatttttca

SEQ ID NO: 60005 - DNA, 1055 bp, Heterodera glycines
  Genomic contig location: Contig_ID=SeqID_6009; Location=903..1957; Strand=-
  SCN-specific regions: Sequence locations=1-678,701-764,786-904,949 -952,1024-1055
atgtaccgtatgcaacatcaaattgacgccaaaagaaacaggtcaacgctacaacatgatggccatctttacaaatttgctaagacaagtaccgacgggacgattaaattttggcgatgtgagttcaaagacagcggtgtggacaagtgcaaaggacggatttggacttcacttcgagatgaattcatccgcatggcgacaactcacacatgtgaacggaatacaagtcacgtcgttgcgcaaaaagtcacgactgccatcaaaaggcgttctgttgagaaagctccctctgtaattcgtgcggtttctactcaaagcattagttcgcctgcactttcagaagtgccgtcaaaaaaggcaacaaatttggtaaatcttttcaatcataaaatttgttaaaagatctttcgcttagatgataaaccgaacaagacatctagtagatgcgccaccagctgtgccattgaatcttgaacaacttcaaataccgcaaagttaccagttttacgaaaaaacgatgtacaagaacgttttttattctgctaagctaacttttgatgctgatcaaaaaagtcttttacagcaacttgatcagatcactcctttatagtgaccgggacaccacgaaacacattgaaaatctgggaaatttccgaaaagaatccctagagggttgtgaaaatttttctgtaaaatttcagtaggacagtcagaaagagcaaaaattctctaccaattgccttttaaatagtgagtctacgactagagaaaggcaaataataatagatcgaccaaatcaattaattatcagtgtttattttaatttgaatgcatttattgatcaaattcaattttatttttttatttttgcataaattggattacattactgtgtaagcttatcttttacatttaaaaaataattgacgaattttgtttttctccaaattacatataaaaataattaatgtaataatttgtttttgcttttgaaaaaataatttttgaatttaatttaaaaaacggaatttttcatcgaagaaatgaaaaataaa

SEQ ID NO: 60006 - DNA, 713 bp, Heterodera glycines
  Genomic contig location: Contig_ID=SeqID_29513; Location=112..824; Strand=-
  SCN-specific regions: Sequence locations=1-176,200-496,670-713
atggccgggcagacaaagggcggcgccggcatttcgcccgcggcattggaggacgaacgccgccgacggcacgcagcggaacaacagctgaggatggaacagttgcgggcggacgagacggagcagcaattgcgtgacatggaaggtaataaagcgggacataggggagggaatggaaatttaaatttaaattaaaattcaaacccaaagagtcgagaaagagaccgacaaattacccctaaggtcgagaccgaaaccccgaaaaactcagagacatttccgattcattttccttttttaattgctaatttgtaagaaagagcgcatggagaaaaacgcgcacttttggtggaaaacgcggaattgcagcgacgactggacgaactgacgccaaaattggcagaacaggaggccaaaatgatggcattggaagagcaaagggacgaagcgaatgtgcgactgaaagcgacgctcaaacaaatgaacgcactgcaggcaatcaattaattaatgaaccaattaacaactaattaggcaatacatatatcaatgagcaattaatcaaagcgattaggcaaggcactcaatcaacaaagactaaatcactttataattaaaaagtaggccaatcaggcaattaattcaatgactcattaatcaggcaattaaagtaataatgatctattaactaaggcaattaggcactcaataaa

SEQ ID NO: 60007 - DNA, 285 bp, Heterodera glycines
  Genomic contig location: Contig_ID=SeqID_29514; Location=120..404; Strand=-
  SCN-specific regions: Sequence locations=1-236,258-285
atgtattcaaaaaagtaaaaatattctgccaaatcgttaatgcgatacataattttcaaaatcacaaattcttgtcaagaaaaaaataaataaattttggagatgaatttttgaaaattttttcatttattaggggtgtattttttgataaaaattttaggtcgattcttaagggtgtatttttcgtttttattgcatttttgttaacaaattttggcaaaacgccaaaataggcaaaaataggctttttcaaaattttttaggattttaggcgctaaaaataaa

SEQ ID NO: 60008 - DNA, 588 bp, Heterodera glycines
  misc_feature (580)..(580): n is a, c, g, or t
  Genomic contig location: Contig_ID=SeqID_29515; Location=908..1495; Strand=+
  SCN-specific regions: Sequence locations=1-588
tcactgtcgcccaaagttggcacttttgtttgcgggaagaaatgctcaaaaataaggtaatgaaatggatggcttcttcttctgctgatattactataccatcttcaggttggcccgttttcttctcaaatggtgtactgcttgaagttgttgctgctgcgcgctttctgagtcctgccggatgccaaactccgcgtcaaagtcgggaaatttagggaatatgggcttcgccgttgccattggccgatggttttctgccccgctgggccgacggagttgatcctgtactaaaaattggtatttaaaggtgaaattcggaatttcgagctgtttccgcttgcctccttgggccaattgcggtggggccaaatagcggaagcaaatgtgcgtgctgttgctgacgttgaactcgttgcagcactgcacttcgccatcggaaggagcctgccaaaaaatgtgcatcgaattactcaattcgctcgcaaatggcaccaaagattggcacacgaaacgccttttgattctaatgaatgcatttcatcatccccaaaaaaattctacaaatagaaattactcccanaaaaattc

SEQ ID NO: 60009 - DNA, 145 bp, Heterodera glycines; identical to SEQ ID NO: 53679
  Genomic contig location: Contig_ID=SeqID_29516; Location=1264..1408; Strand=+
  SCN-specific regions: Sequence locations=1-33,55-145

SEQ ID NO: 60010 - DNA, 897 bp, Heterodera glycines
  Genomic contig location: Contig_ID=SeqID_29521; Location=41..937; Strand=-
  SCN-specific regions: Sequence locations=1-142,164-516,538-897
atgatggtcgaagttagcacaaaaacaacggaccaaaggatcaacagtgaacagcttcatgtcggacaattcaccgctgcaaaaggacagactaacaacagaattgaaggtgatacttcattattgaggaaaagcacactgaaagaaaaagcaaaaggggagaaaaagcaatcgaatgatcaaaataatgaaagggaagtgatcgctgataagaaaatgggggcgataaagcagccgagcgatcggataagcgattggacgagaagcaatcggaacgaagaagcatcaagcggcaaaaaaatgccgaacggacgaatcctttggaccaaaattctaccagttcagacttccgcacgcaacaaatctctcccaaattctgctgataaggaaaacattctgccgacaacggatgggcgatcactcagaaatttgtcgggtgatcggccatcttcatccaaacaattgccgacggatgagcaaaagaaatcggacggacagaagaaggacggcccggggggacaacagcggacatctgacatgaggacaaaagcgggaaacagcgaactttcgcaacggattctccaattgctgaaaaatttgcgaattgccaaagaggcggtggcaaattatgggacggaacgaagacggagaagaaagcgatcagccgaaaagattgctgatcagaaacagggccggagaataacggaaaacggccaagaaatgatcagtgatcagaaaagtgatcagtcattggctgatcagggccaggcaccgttgccgggtcagcagaaagcggcaattacgggacaggattttcgggagcgccctggggaagagaagccaccggatgagaagaaagcggaagaaaaagggatagaagaggaagcaaaattcgtg

SEQ ID NO: 60011 - DNA, 59 bp, Heterodera glycines
  Genomic contig location: Contig_ID=SeqID_729; Location=1173..1231; Strand=-
  SCN-specific regions: Sequence locations=1-59
tatatatgttatataggttttgagtttcgtttcaaaaaacaaaatctcccggccgaagg

SEQ ID NO: 60012 - DNA, 522 bp, Heterodera glycines
  Genomic contig location: Contig_ID=SeqID_730; Location=61..582; Strand=-
  SCN-specific regions: Sequence locations=1-522
atgattgtacctcttctaatcacttttgttcaaattttaatcactgttgtacctcttctaatcactgttgtacctcttctaatcactgttgtacctcttctaatcacttgtacctcttctaatcactggtgtacctcttctaatcattgttgtacctcttctaatcactgctgtacctcttctaatcattgttgtacctcttctaatcactttgtacctcttctgatcactgttgtacctcttctaatcacttttgtaactcttttatcacttttgtacctcttcatcaaatttgtacctcttctaatcactgttgtaactcttctaatcactgttgcacctcttctaatcacttttgtacgttttttaatcacttttgtacgttttttaatcacttttgtacctcttttatcacttttgtacctcttcatcaaatttgtacctcttctaatcactgttgtaactcttctaatcactgttgcacctcttttaatcactgttgtacctcttttaatcactttt

SEQ ID NO: 60013 - DNA, 3702 bp, Heterodera glycines
  misc_feature (3690)..(3690): n is a, c, g, or t
  Genomic contig location: Contig_ID=SeqID_731; Location=40..3741; Strand=-
  SCN-specific regions: Sequence locations=1-13,37-732,754-1821,1843 -2365,2387-2527,2549-2656,2681-3118,3141-3702
atggatcctttgaataaaaactttcaacatgacagatgtcagcttattaaaaatgtaatttccatggttgttggtgttgatattgatgttataaatatagctgataaaaatgtatcacaacagcctgattttaatagctgtggatactacatttgtttatttgccgaatcatggattttcaatgatcactcacttattcttgaacccattcatattatttcagagaaaaaaagaattttgtggcatgtgaatgcattatgcagttcagataatgtcgaattccgttcccgttataatcaagtgaataatgaaatattaatgtctgacctttctcgtggatcctctctttcaaaacctttaaattattcggactgctctgattctgattcttcaaaatgtagtggcaaccgaagaggtcgcccaaagaaaaggagtggcggaccaggtcgccttaaaaagccggatagcatcaatttgtctatgaacgttggaaatatgaactcaaatactgaaaatattaatcaagcccaagaaaatcaatctataatttctaatgaattattgaccttattgaattccggttctattgatatccctggctcgcaacctatagcccctggacgtgtatgtattcagtcaataaataaagatctcattaaagaggcgtggtctatacctaacgaaatgttcagtgatgatttagtctattgttttcaacgttatctttcatcaaaaatagttgacaaaatagttacagttgttaatccacaatacacagacttacaaaattttcatgttggccctcatgctttcccatataatgtgatggataactgctttaattattcagagaactatgacattttgttgatgactattttctttaatggtcattttgctttaataatttttgaccgatgtgaccgagataacttgatttgtctatttattgattctttgccgcattatgatagactttttgatcctcaataccctggctatgatgtgagaagaattgaaataattaaaaacggaatttgtgaattgacacctggtctttctcatgatgatgtggtaattaggacattaagtccatcagaatttacaccccaacatgacggaattaattgtggcgtatttgttctgctttattctgaggcctacttaaatcattgttcactgaaattcccaaatttaaacattaacttggagaggcggagaattttgtggcatttggcgcacctgataaataatgatgacgtagaatatattggaagaaatttgacaaatggacctcaaaatcctcaacgattgcctttgtataatgtggagtcgaatattgaacagacatgtccgagggatggagatggagcctttatttgcgtagaacctgatattgatagaacccctgatgttattttgaggccaccttctacaagtaatttgagtactgctacccgtcgatcgctccgtcttcaaaaaagtgttagtaatgaagtatcttccgatgataacatagatactattccaaaaatgcctcataatgatataaccaggcgttgccataccaaacaccagggaattccttgcgcagatgtacgtgccaggcacaccactgattattatgattcgggaaatctcggagataaaatttgtgcttattgtaatgctcttttactgaatagcgaggccgaaaaaaagaatggaaaattttcatcaagtcattgttgtaatcatggttctgttgttttgcctccttacgaagaatatcccccaacattaaaacgctacttgtcagggcaagacccagaggctaaggaatttttgtctaatgaaaatgtttataattcattgttagcatttgcgtccgtttcggttggataccgtgagtcatcacttgatggaaatgtttgctatttgttaaatggtgaattcactcgtcaaataggctcaactttacccggaaaattttctccatccttttcgcaattatacattcttgaccctgttacagccttcatgcaaaggactcagaacatagcgtatggtggtgatcgagtaaacgaaaccacaataaaaaagcttgattttattattcgaaaatataaccctcttgcccaagagttggtaaacttccataaacaatatcagaatactctaaaagagaaaggcccagaggctgtacttaatttccgtttaacgctcgtcgaggctcgagatgcaccggcaagtgttcgagacgtttctattcattcgagacaagccaatttacccgatgaggggaattcattgtttgccgtttgggctgaaagtgaacagccaccctttttgaaagggatatggattaccaatgacgaaggaaaacttaaaaaattccctccacatcatccactcacagattctctttgctaccctttgatgtttccacatggtgatgatggctttcaccttaaaattccatacaatccgttaaataagcccgaaaagaatgaggccatggagattgatgtcgaatctgatgagaacactggtgattcagatgctgatgcatcagatgatgacaatgagtccgttgccagttcggttgattctgttgacaaacgcggtccgcggcagtttttatctattaggtcgtatatccgctatcgtatggcgttaagaaaacacaaaaacattcacaacatttggagttccggtggcggactaagtcagaaatttacacttgattacgcggcgcgaattgatacgaatgttgcaaattatttacgtcgtcccgaattaaatttgcgtagtacacttccagaaaatgcccttcgctggctttcacgtaatgctggtcttagctccacagaagacttggggagtattgttatgttccgcagatcagagccaggcacacgagcgtatttccaacacaaattttatgatgctaccacaataatgtcacgctttaaaaaaccaggcaacgcttcattctttctcactttcacaaccaatccgcgttggcgtgaaatttcccgtaattttctccataaaggtcagaaaaccgtagatcggcccgatttaatatgtcgtatttatgaggataaacttagccatttacattatttgatagatcagaaaaatattttgggaaaaatgattggtcaagaatgccgtgagttccaaaagaaatacggcggtcctcatgcccatcgtgtttatcacacaagtttgcttgccatccctgagaatgttgataatataatatgggcgcatatacctgaagaaccagcaaaaaatgataaatcagattgggcaaatttcattcgtaaagtacgtgaattattaccgaaatttcaattccatgactgcggtccacattgtcttaataataaaggaaaatgcaagaagggattccccaagccgtttagtaagtttaccatccttcatgatgaccgtccagcgatctattttcgtccgagcccggaagatggcgggcaaaccttatccgtaaagcgaggcaaagcgcaagtcatttataataattctcgtatttcctcctataacccatatatcttggttcattttgagacccaccataacctggaatacgcatatgggcaaagcacaaatttaaaatatctctataaatatccattcaaaggcccaagtttttcgtacgttaagaccaatgaaagcaatggaaangataagtattga

SEQ ID NO: 60014 - DNA, 1770 bp, Heterodera glycines
  Genomic contig location: Contig_ID=SeqID_732; Location=48..1817; Strand=-
  SCN-specific regions: Sequence locations=1-508,531-602,625-754,778 -1479,1501-1770
atgccttcaaagcaatggaatgaaaagaacaagcggaagaagcggagcgtggaacgacctttgtcctcattatggacctcggaccatagtgaagcttcttcccctgtttcagactttgttttaagcacaccacaaaattcaaactctcgtaagagaggaagaccaccaaagaatatacacacaccattagccaattcctttgaaaaggttcatttgaatacacctcaaagttcttggaaaaaacaaaacatttgtcctgattctcccgttcctaaaaaagataaatcgtttggttgtccattgaatgaatcacttgaagagatagattttgctaatttaacaagccttgaatttattcagcgaattgatgagtccgcaaaaattgcccgctgggcaaatttgaatgttcctgatgttaattctggtcaaaatgtgattgaaaaggcattttataatttggattcttggttaaatcatgagctaacgtttgcatatctctgtcttattgcaataaaatccactcgccgaacagtggtcgtcgactccgtactgactgaccctgatattcatgttaaaaggaataaacgcacacttaaaagagcgtgttttaattttgacccaaatattccaacagaaataatcgtttttccgttattctttcaaaatcattgggcacttgccatctatgaccaagagattggcacttatttcattgattctctgaagcaagatccttcccgaatggatcctttgaataaaaactttcaacatgacagatgtcagcttattaaaaatgtaatttccatggttgttggtgttgatattgatgttataaatatagctgataaaaatgtatcacaacagcctgattttaatagctgtggatactacatttgtttatttgccgaatcatggattttcaatgatcactcacttattcttgaacccattcatattatttcagagaaaaaaagaattttgtggcatgtgaatgcattatgcagttcagataatgtcgaattccgttcccgttataatcaagtgaataatgaaatattaatgtctgacctttcgcgtggatcctctctttcaaaacctttaaattattcggactgctctgattctgttagtgattcttcaaaatgtagtggcaaccgaagaggtcgcccaaagaaaaggagtggcggaccaggtcgccttaaaaagccggatagcatcaatttgtctatgaacgttggaaatatgaactcaaatactgaaaatattaatcaagcccaagaaaatcaatctataatttctaatgaattattgaccttattgaattccggttctattgatatccctggctcgcaacctatagcccctggacgtgtatgtattcagtcagtaaataaagatctcattaaagagacgtggtcttgtcctactgatatgttcagtgatgatttagtctattgttttcaacgttatcttgcatcaaaaatagttgacaaaatagttacagttgttaatccacaatacacagacttacaaaattttcatgttggccctcatgctttcccatataatgtgatggataactgctttaattattcagagaactatgacattttgttgatgactattttctttaatggtcattttgctctcataatttttgaccgatgtgaccgagataacttgatttgtctatttattgattctttgccgcattatgatagactttttgatcctcaataccctggctatgatgtgagaagaattgaataa

SEQ ID NO: 60015 - DNA, 357 bp, Heterodera glycines
  Genomic contig location: Contig_ID=SeqID_6012; Location=21..377; Strand=+
  SCN-specific regions: Sequence locations=1-192,214-357
atgattcgaatgtcacgggacgattcggacgcggtggaacaactccgaaaggtacggtgcatgtttacgcaatcagaaaaaaaaaatcgaaggtggatcgggactccaaaattttgtaaagtatgagaaaatagtccatttattttgcatcttcttgggtcgaaattttaatcgccccactgagaaatgacataatttttctattttttgcaggaaacgcgcaaattggaagaccaagttgggcagtacaaggccaaagttcgggagctgaagagcaaaatgaaagtgcaggaggaggagttcaacagaagatacaacgaaaaggcattgtttggattgttggcattgtgccgttga

SEQ ID NO: 60016 - DNA, 1454 bp, Heterodera glycines
  Genomic contig location: Contig_ID=SeqID_29523; Location=171..1624; Strand=+
  SCN-specific regions: Sequence locations=1-180,202-242,270-432,454 -469,491-620,684-968,990-1100,1122-1225,1247-1346,1390-1454
atgtccttctccacaattggatcatccacttcatcagcagcaattgcgccaatgattgatgaaaagggtgaactgttgaatcgccatgaagtgcaactgatctccaaaacgttgaattggtcggtggaaaatgatcagaaatttgaatttaatctgctcatcaaaattggattaagtagataatctaataaatttaaaatttttacaatggcatcattttctttttttctaaaatagtccagatattaataaaaattattattattattgccaaactcacaaaacaattcaaccaaatttattatgaatgcctttttattttaatagccgaaaaggtcacgaattttagcctgcctaatttattacagcgctttgaaagagcttgactttggcaacgaaattgttgttcggcttcttaatgacaagaggtaatggtaattaataattaatttcttttcttaattcaattttatttgtgtccattttatttttagatcgctgtttaaaagccttttggcacgatgtgccaaacaagctcatgacattgaggtctgttgaacaattacatttattttaaaaatttgaatctttttgttactaataatattgaattaagctagttttttttttaattttaaaattttatattatttatttatttttaaaatgaatgaaaaaaaattgatttttgatcagcaaccaaaaatagtttatagaagaaaaccaaaaataaatggattatcttttcacttcttaggccatattttatttgggtgaagtgaaatttaaattttccgatattataaattgaaaatcagataaaactctcgagagtcttgacgacaatttactcatgctcctaagatttaggtgtttgacccgaaaagtttggcacgtttttgtccaagagcagtgcgagttggtgacggcgtgacaagattttttgaaaatgtgagtaatgtcaccctaaaattatttacattattttttgccaatcccagttggccattgagctcgagaagggtcacgccattgctgatctcgagcagaaagtggctgaactgtgccgtgccaatggccaactccattaccgtatgaaagtgtggttccaagccgagaattggctgtgcgtcaaacgatcggtagtcgacacggtaattgttgcacacaccaaacagttcgacacattttgcggcggaggtgatctttacaatgaaaattctcattattttattattatgatgtacataaaaatggcaaaatcaaatgtgtcggaatgccaaaaagtggtggtgatcaattccaacacaaattgtccaccgaccagtcaaaatcattcactgattattcccattttttcctttacaataacagaaatgcaaataaataattggcaacttctgtgggaattgaacccaatcgaccacacaatccgtgggaagctctaccattaa

SEQ ID NO: 60017 - DNA, 71 bp, Heterodera glycines
  Genomic contig location: Contig_ID=SeqID_29525; Location=147..217; Strand=-
  SCN-specific regions: Sequence locations=1-71
gtttcaaatatcgtaagattgtttgatagggccagacaagagaaggcaacagttggtaccaattttgcggt

SEQ ID NO: 60018 - DNA, 465 bp, Heterodera glycines
  Genomic contig location: Contig_ID=SeqID_29525; Location=509..973; Strand=-
  SCN-specific regions: Sequence locations=1-465
gtttcaatatcgtaagattgtttgataggcccagacaagagaaaggcaactgttggtaccaattctgcggtaaaaaatgagaaaaaagagataaccatttttggtcaagaattttttttgtttgcgtttcaaatatcgtaagattgtttgatagggccagacaagagaaggcaacagttggtaccaattttgcggtaaaaaaatgagaaaaaagagatagccattttttggtcaagaattttttttttgtttgcgtttcaaatatcgtaagattgtttgataggagacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaa

SEQ ID NO: 60019 - DNA, 897 bp, Heterodera glycines
  Genomic contig location: Contig_ID=SeqID_29527; Location=32..928; Strand=-
  SCN-specific regions: Sequence locations=1-143,179-207,237-573,618 -799,821-897
  Gene Ontology: Mol. function=transcription co-activator activity; Cellular component=nucleus; Biological process=transcription from Pol II promoter
atgaatggccaacgacttggtgatgtgtggattttggatttggaatcgatgaattggtcaaatccgctaccgcaaggctttggaccattgccgcgttcactgcacaccgcaaatttgattgaaaatcggtgcgtttggacgcgtttattaataaattagaattttgtttttattttttgttgcttttttacgggtctcttcatttccccttttttgggattttccaaagttttcttatgtgggaaacagacttatttttttttacaaattttcagcatgttcatttttggcggttgggtaccaaatgattctgacgacaactcggagcgtccaaataaggggtggaaatgcaccaacacattggcggtgttgaatttgagcacactccgttgggaacattccctcggccctccaacgcccgtgacagcaacaacatattccactggtaagttgcttatctcggttcggagcagcaggtggtttccctgccgccatcattcttccccaatatcagccccacacgaaattttttttttaataagttcatgaaaaaatgagagaaattttttggcgattttttagaaaaaaattaaaaataaataaaatttaaaaataatcgcttgattagtggtttttcaaaattttatggtgagaataattaattataagtttttagcaaaaaagtttccaaaaaagttttcgtgcaaataattggaagtccaaattgatttggcatgtgtggacaaacgtgttagcatttgttttacctttttttcaaaattttaattttagacttctggccaactgcccgtgctgggcattgttcggcggtgatcaacaagcgcatttacatttggtcgggtcgtgatggttacaaaaaactgcagaacagtcaag

SEQ ID NO: 60020 - DNA, 567 bp, Heterodera glycines
  Genomic contig location: Contig_ID=SeqID_29531; Location=279..845; Strand=+
  SCN-specific regions: Sequence locations=1-128,158-347,369-395,418 -445,467-567
atgagcatggaactgaacaatctttcggcactttactcggccaaatgtcttgaaaattccaaattggacgaagaaatgcagaaaatgctcagagagcgtgagcagaaaagtaccaatacaaagtgggctttttatttattttttaatattttattttgaattttgctttcagcaatttggatgccatcaacaaacgccttcagagggaattgcgtcagaaggagcaaagcatcgatgacctcagacagcaaattgcatggcttgaaaagaagctgaaaatgagcggaattgaagtctcggagcagggtaagccgcacaacaaaagcacttcgccacaatttatttaccaatatttttaaattcaaatggtgacgggctgtccgcggtcaccagccatttttattatataatttatttgtgcacgctgagcaattttgtttccgcttttcacttcattcccttttctattcgatttcagagctatgcgacttcttcaaacggttagtggcgataacacattacaactcgtcaaacactttccatgcttttgcttttattattatttaa

SEQ ID NO: 60021 - DNA, 722 bp, Heterodera glycines
  Genomic contig location: Contig_ID=SeqID_6013; Location=719..1440; Strand=-
  SCN-specific regions: Sequence locations=1-380,403-722
atgcaggacaatggcgtcattgtccctatcgaacatcgctatttgctcaaaagtgcccctccgcgtgctctcgcgttactctccaaagggtttgtttctcgatgctttgtttattaattgcgagcttttgctaagaaatgacccggagaatggtccgtgggaagtgacaagcaaaaaacacgacgctcttttcgctgccttaaattattgcagtgcgcgggagattcggcaagggttgtggcagagttacgtcacaagatccgtgagaacaattaacaaatgaacgcatcgatggggaaacgtgagacttttgcaggcattcagttcgcaaatgttgaacaactcacaaaacatcgaggaattgcggcataacacgttgattctttgttttgttactttatcaatcggggtccattaagtgagggctttgccaaagcgcttggcttttcgtcgactgcgcaccaccgaatttcttccaaaatggccgggagtccccaaactgtccgcgtctttgtcgacgagtatcttttacccctctccattttttctaaatttctttcccttttagactttccaggcgctttcgtcccgtgtttttctcccgactcgaaggcgcttggaaaacgtatgccgaagaacaggaagaaagggtgatttccgatttggaagcctttgatctcttttacatttgtcgtaaagaggcagaacataaccaaaagtga

SEQ ID NO: 60022 - DNA, 756 bp, Heterodera glycines
  Genomic contig location: Contig_ID=SeqID_6013; Location=1856..2611; Strand=-
  SCN-specific regions: Sequence locations=1-224,246-252,276-756
atgggtgatgcaaaaccgaaagccgcacaatcaaacgggatattttattacgtgagtgtgataataatgaccaatccatcactgcttgtctcactgtttactttagtcttccaaatgttccggatgaaaatgcagaaaataacgctcttttggaaagtattgaacataattcaaaatggcccccactgcaaagtgccacacgtacgtttgcttttttattttcctatttaaatattttaattttagcagatgagttttatgaaggaaccgtgaaactaatcctggaatatggcgccagtgtttgggaacatttggacttacttgacgaaggtaatgattaaatttcgacatataacaaaacaaaatgcttgaaatacctactccataaaagatgcgaagaaaacggcaaaaggagacccaaacgtacaaaggcgtacattcgacaacacagtcagttcactaatagacgaggaatacgacgttcagtatgctgtaagcctcagcttattttttagtaaagttttacaaaaagtaacttattcagctgaacacactcctcgtgaaaatgttcactgattggcccgaatgccatccttccctgttcagggaagacctttatgtaattcttagtccagcattttttctgatttttatattctaagcaagttcaaaacaccttccaaagggaattgagtgaacgatggactgagcccacttgggtcgaagctgtaaaggtgaattggttttgaaaataaa

SEQ ID NO: 60023 - DNA, 1183 bp, Heterodera glycines
  Genomic contig location: Contig_ID=SeqID_6014; Location=1408..2590; Strand=-
  SCN-specific regions: Sequence locations=1-264,286-399,422-522,544 -577,600-640,662-812,846-863,885-1183
aagcaaacttacaaaaatacattttgaaatgccatttataaatctttggaccaaccttcccgaactcaaattggacaacgaattcagacgaacattcctcgcgacagtggccaattcaatgcaaaagccagtggaatcgacagcactaattgtccagtcgggaccaaactgttgccaaatcggaagtgaccctgccgaaccagcgatgattctgcaagtaaaaagaaaataaaaaaaggggtgaaaagtcactcagcgattttaattgattgtttgttgtttattataagatcaaatcaattggctgtgtcagcgcagatgaaaatgtaattcactgtaagaacatcagcgaattcgtccaaagtcgccttgggattccgcccgaccgcgtgatgattcactttcagtctttggagaagcacgaagtcgggaaaggaggaacgacggtggaaaagatgtgccagtaaattaaagaaggaaatggatggcatgttcaatcaccgacttggcaatgttaagaaatggaattaaaagcaaaacctttataattggaaattgaaacaagcaacaatgaattttgtttggatgctttccgtcagtaaattctcaagaaaagggaaagattaattcaagagaacatccaaaaagagaacacggcaacaaaggaaatgaatcaagaaaatgatggatcattcgttaaacttcttccgcttggaaagtcctccggccgcgggtgtgccttcgaatggtctcttgaacccaccaccaccgccccgttggccacggaaattacccccttggccccctgaagcgcctctgaagcctcctcctccacgtcctccgcctctaaatcctcctccacctataaattttgaaattttatattatagcctatcaatgtgtgtggttggaaataggcctgcatctaataggtcatgtatcataaaaagttcaaaaaattagcaatgattgagaaagaatttaatctccaccaattacaataatatcaacatgtgtaacttacgtagcccacccccttaccgaaaccaaaaaattttcaattattggcaaatttattaaaagcggttacaaaaagcgacaccattccattggaattggccaattctatttgtatgttaatatggtacctctccctccgctgcctgcgcctgaagcgttaaag

SEQ ID NO: 60024 - DNA, 54 bp, Heterodera glycines; identical to SEQ ID NO: 55479
  Genomic contig location: Contig_ID=SeqID_29532; Location=675..728; Strand=+
  SCN-specific regions: Sequence locations=1-54

SEQ ID NO: 60025 - DNA, 300 bp, Heterodera glycines
  Genomic contig location: Contig_ID=SeqID_29533; Location=423..722; Strand=+
  SCN-specific regions: Sequence locations=1-300
atgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtcatatcggcttttggaattttaatgagtaaatcagtaaccgtaaatgaaattctctgcttctcttgttggatacacgggaagaaataa

SEQ ID NO: 60026 - DNA, 186 bp, Heterodera glycines
  Genomic contig location: Contig_ID=SeqID_29534; Location=698..883; Strand=-
  SCN-specific regions: Sequence locations=1-186
ggcacccccacaaagtgtccaagccacgaaatgtccaaaagagtaaaaacccacgaaatgtccaaaatttttcaaaatttataaaaacaaaatgagtctaatttaggtttttagggttttcggggtcgctgaatacgaatataccctttatattaccccttgcctaacgttaggcccatctgaata

SEQ ID NO: 60027 - DNA, 406 bp, Heterodera glycines
  Genomic contig location: Contig_ID=SeqID_29535; Location=567..972; Strand=-
  SCN-specific regions: Sequence locations=1-215,237-406
tttcatcgattgatcagctggatgagaagcacattctcatcacatacctgcataagaaggactgggtgcatgagcacgcgtgctcaaacattggtgacaaattctcttcaaaattttttcagttaataaattacagtaatttctttgtggacaacttcagctgcgcggcttgtcctgcttaaggcaatgcaaaaggtggtcaggactgaccgatgtgagctactgtacacaggtacttgaacaaaaaaaatgtaagataatttcttaaatttaagacaccgacagtctcatccttgtgcatccggaagagcgttgcccactcaaaactggtccacacttgggtcagtttacggatgaataccccgaccatgacatcgtggagtactgtagtggaggatcaaaacag

SEQ ID NO: 60028 - DNA, 671 bp, Heterodera glycines
  Genomic contig location: Contig_ID=SeqID_29536; Location=326..996; Strand=+
  SCN-specific regions: Sequence locations=1-410,441-671
atgccaagcgtggcggcaaattctcttcaaatgttgcagcaacaggccgctgccgcgcaacaatattccgccgccaccggcacgccctcattcattagcagtgtcagcggtggcaaatgcggcgccgaataccagacggtttccgtttccgcgtccggtacgcagccgcaagcgagcggcaacaatgcgtccggagacccggcaaccgctagtggagccggctatccgtcgggcgcgtcggttggcattgttggcggcagtggcgccaacggcaccagcggcgttacgccgtacgcgcagttgctggccatgggtggtggcggtactggtgccatggttgacccggctacggctgcaaccgctacgcttatggcacaacagcaggcggccgctgccgcggcaattatggcacaacagcaacaacaccagcaacaacaacagaaccagcagatcaactgtatgttgttggatttgtgctggaattttgggctagaaagttttgttcggttctgatcgggcctctgtgagatggtgccaccaatcaatccttgatcgaatcagaccttttgaagatatttcatgctctgatcaattttttagcaatcattgttctgatcgggaactttaagcaattccatgatttgctcgggctttttcagaacttgatctga

SEQ ID NO: 60029 - DNA, 390 bp, Heterodera glycines
  Genomic contig location: Contig_ID=SeqID_29537; Location=220..609; Strand=-
  SCN-specific regions: Sequence locations=1-390
atgccaagtattttcgataacttcgctaaagcaaacggaggaagaggcccattaatgatgggtgaggcttcttcgaattgggtgagcactccattgatcgatgagaatgggctgcccgtggccaatgacacggcaagtaacagcacaagcggcactttttgggaagagatggagcaggaactgagaagccaaccgacggggcgagccgaacctatggcatttgaaatggcaccgtccgacggaatgagcggaggagcacaacaaatgacaatgagcaaggaggagaagtgccaaaggctgaagaccatccaggaggagttgctgttcaccttggcatcgcgcttcaatggatacgctaatttggatgatatcaaaagggatttcaagtaa

SEQ ID NO: 60030 - DNA, 770 bp, Heterodera glycines
  Genomic contig location: Contig_ID=SeqID_29538; Location=291..1060; Strand=-
  SCN-specific regions: Sequence locations=1-236,269-425,448-523,545 -597,619-638,660-770
tttgtatatcatcagctttggattcgccgtcaaacagcagataaaattggatggattaattcaaaatgaaaagggcatttactcatatgaaagtgatggcaaaatttggaccaacggaaaagaaaaaggaacaattgccaaatattcctacggtgttggtgataccgtaggaattggtgttcatttaagcactcgacagctctttttcaccaaaaatggatttcgtttgggttggcaaataaaaaataattaaacaaaattttaaattgcctatattttaattgatttttatgtttaaatcgttgataaaattcattacttttcaaagataccgctgctggttttttcgacgatccatcttttgctgatgattcttttcatccattcgtttctttgcgtgaaactgatgaccaaattgaggcaaattttgggcccaattttaagttcaatttggcaactctttgaagaagaaatattcagcagataaaattgttcttttaatcctgttgtgcttttcatcttcaattaaattttttttattaatcggaaattttcatttctcgggggtaattaattatatgaactaacacttaaaagatgaaaatttacaagaaaaacagttttttccaattatttgctaaaatacatgatgtagaaaaaatacaaatattaatttagcaataagagtattgtattaatacagtgtaagaatgaaatgctcaacagatatcaaattgatcatctggttgaactataacttttaaaataaa

SEQ ID NO: 60031 - DNA, 439 bp, Heterodera glycines
  Genomic contig location: Contig_ID=SeqID_29539; Location=314..752; Strand=-
  SCN-specific regions: Sequence locations=1-41,85-87,109-339,361-439
atggctattgaggacactgaaaatgatgccctttttgatcaactttggggaaatttaaaaacaaatcaacaaaaatcgggcggatttgaacaaataaaaatcaaagaggagcaagaaagagatggtgatcagcagcagaaaagggtgaagaataatgaacagatcggaaataaccaatcggaaaatgaaaattatgagggaaaatttgggaaaatatttataaaaattgagggagaaaaaagcgaagaaatgaaaaaagaaatttgtgaaaatccaattaaaaatgaacagcaaaatgaagaagaattgcagcaaagtgatgaacaaacaattggaaattcaaatcatttaataaacaaaggttaattttgccttccaaatttaatttgataatttttaacaaagtttcttttcagttatttacgaaaaagtcaactaa

SEQ ID NO: 60032 - DNA, 1092 bp, Heterodera glycines
  Genomic contig location: Contig_ID=SeqID_29543; Location=23..1114; Strand=-
  SCN-specific regions: Sequence locations=1-475,498-821,843-861,886 -1092
  Gene Ontology: Biological process=cell cycle
agtgctatgtcagtattcgagaaatccattcgtaaagtatttgtcgatacttataaggggtatcgatgatggtttccttgttgaagcaagacgacagtaagaaataatgtatttcacgctttctaaaatttaattaggaaaccaacgctgaaagatggtacaacggcgacaaccatttttttattggataaaacgctttactgtgctaatattggcgactcgaaggttaatgtttttagcgctaataaaaatgatgtattttaaaaattactgatcataaatcgcatgcattttcgactaaaaggaaacttaatccgtgtagctattcggaattgttctaaaaggatgtcaaattcgtgatcagcgattacgaagcctttgggaatacaccacaaactaagagaaaaacttgcaaaccaaaagcctttttataaaattgaaattgggtatctttttatattttttttaattggcatgattattttaaaacaattatttgtataataccattgtttaggctattgtttgtcgacacaaatctgaaaagagcacaaatattccgctgcaaatcactgtggaccacaaccctcttgtttttgacgaacgaatgcgtattcaaaagtccggcggaacagtcaagtcagtctcatccaaggaatgttcatcaaatttttgattattcccttagggatggccgagtttttggcattttagaggtgtctcgttcgattggtgacggtcaaatgaaggcacatggcgtaatttgcaccccggacatcaagaagttatcgttaaccccagacgatctgtaactcttccggtgtttatttgtattaatagttttctttattcgcattaagtttcatcattttggcttgtgatggcctttggaaggctttttcgcccgacgcagcgattgattttgtgatcggacagtacaaaatgcttgctaaaactgcggagttcaacgaggagaaggattctgttggactgtggacaaaaattgccgacgaaatgagtgcggcggctgtgcgaaagggatgtggtgataatgttactgtgctggtggtaattgtggctaatattgcgaaa

SEQ ID NO: 60033 - DNA, 192 bp, Heterodera glycines
  Genomic contig location: Contig_ID=SeqID_29544; Location=328..519; Strand=-
  SCN-specific regions: Sequence locations=1-192
atgagtcagcagccaaacgcaccccctccctacggttggcgatttcttcgcctttaaaaactaaaaaaatatgttttagacgacgctcagaaatacccggcctatcccaacccaaatgttccaactgatcaaggcaaggaattggatcaatcctctcaatggcaatttatgcttatgcccgactctgtttga

SEQ ID NO: 60034 - DNA, 1235 bp, Heterodera glycines
  Genomic contig location: Contig_ID=SeqID_29545; Location=147..1381; Strand=-
  SCN-specific regions: Sequence locations=1-125,156-315,337-539,563 -809,840-1155,1177-1235
atgaaaatcaatccgaaaaccggggtcaactttgaagttttttacgtaagtttatttcaaacaattcgtataaaaaaacaaccaaaaatcctcatgtattttggacaaaaaccacctatattttcaaaaaaataaataaataaataaaaataaatccattatccaagtaaatctcataaacgattttttttagtatggaaaacgtcaagattcggactacaaagcttatgcgttcaaagcaaaccaaccatatgaaatccatattgccgtttttgaaacggaataccaagtgaagctgaacgggcaaagcttcgaaaattttccaaacaaaatgccaatttggacaataaattttatgcgggtaaaattttttttgaaaaaaaaattgatgaaaatttttttcaatgttttccaggtgcaaggaaatgtttcattgttggccgagcctgaaataaatgtgccaaaagtaatttttgaaattgctgatggtctgggacgtcacaaatcccgcccgacgttagaccccgaaattttggatttccgacccaaatcccgatcccggtcattttctcgtcccgatcactgagtccgacaccaaaaattttgactgtgctaatcccgactttttttgtcgccccgacccgaaaaatttgacattgcgagcccaattcttgatcccgacatttttacagtcctgaatcttgatccgaaggcatttgccttagattttttgcttttaaatatgccttgaagcaattaattagggtgctgggtgattaattaattgtttattcgaaatgaacaaaatgaaaatttaaataatttttcatttaaattttcaggtcagccaaaaaggccaattttcatttgcattgtcaagtctttttaactacgatgaacagatcactttttttttcactgtgaacaatgctgccaatagtttccaaattaattttatgcacgaatcatcagagatccatccaatgagtcagttcgtttaaattaattaattactagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaa

SEQ ID NO: 60035 - DNA, 526 bp, Heterodera glycines
  Genomic contig location: Contig_ID=SeqID_29550; Location=314..839; Strand=-
  SCN-specific regions: Sequence locations=1-155,178-526
atgcaaatgttgagcacaattagcaaaacgagcggaccaacggccatgaacacctgcataaatgggtggcatggtcaagcaaagaagcccatttttgcgatggcatcgcttaccgtgtacatgtacgtgtagtaaatggagtaatacacgtgactcatgctttaaatggatgaattggtcattttcacattttagcgtccattttcagctcttttaccgaaattccgttggacaaatttggagactgtttatgttcagtccgtcccttgtctcgaagcagtcgattgagcgaagttcgaagaagtgcggaatgttgtaaaggacagccagacaagttgtgaccacaacgaacttttgcgcaattcttagggtcggagagaattaaatttagaaatttcaacggaatccgcacaaaagggcggacagtaggtactaccgtacctcactgtacagtacgactcgctgattggccctttcagtgcgacactgacgaagacatcaatggcagcaccgacgcagaaataaa

SEQ ID NO: 60036 - DNA, 1333 bp, Heterodera glycines
  Genomic contig location: Contig_ID=SeqID_29550; Location=30..1362; Strand=+
  SCN-specific regions: Sequence locations=1-39,61-633,656-1084,1107 -1164,1186-1301,1326-1333
ttgctggtcctcctcgtctacagccatctccaacaacgcttccactccatcagtgtttatctgatggcgttggctgtttcggattttctgatgatttgcactgcgatgtttttgtttgtgttggaggcgtggaggcatcacgggccaatgggtaagccaagggaaaggcggcgaccattggcatttttttcgtatttttcgttgctttttaggtttggcctatgcttacggaatcggcgcccccttcttcttcccgttggcctccattttccaaaccacttctgtttatttctgcgtcggtgctgccattgatgtcttcgtcagtgtcgcactgaaagggccaatcagcgagtcgtactgtacagtgaggtacggtagtacctactgtccgcccttttgtgcggattccgttgaaatttctaaatttaattctctccgaccctaagaattgcgcaaaagttcgttgtggtcacaacttgtctggctgtcctttacaacattccgcacttcttcgaacttcgctcaatcgactgcttcgagacaagggacggactgaacataaacagtctccaaatttgtccaacggaatttcggtaaaagagctgaaaatggacgctaaaatgtgaaaatgaccaattcatccatttaaagcatgagtcacgtgtattactccatttactacacgtacatgtacacggtaagcgatgccatcgcaaaaatgggcttctttgcttgaccatgccacccatttatgcaggtgttcatggccgttggtccgctcgttttgctaattgtgctcaacatttgcattgtggtcaatgtgctcagacgtccgcgcgacccaggtcaaaacagaacaatggcacttaaacatgcaaatggcactgccattaatttgatgcgatggaacatggacgaaggaagacattccgttcagattcggacatcgtttcgctgatcctcgtcgtttgtatgttcattttctgcaattttaccgcacttctcgtcaattttttggagctaacttttgctgaacagcttaaacatgtgcgttctcttatccatctttctgtacattttccgctttttccaggtgatcgtttatttggttgatctgagtaaccttctcgtggtgataaattgctccgccaatttctttgtctatctgatctttggccacagtttccagctgtacccatcacgggaaattttctttggaaaaatcgccgtccggcgcattggaggggaaatggccaacggcggagcacgtgccaatttgttggtaatggtggaaagtgaagaaaagagcaatggcagaagcaacaacaacgcc

SEQ ID NO: 60037 - DNA, 579 bp, Heterodera glycines
  Genomic contig location: Contig_ID=SeqID_29551; Location=106..684; Strand=-
  SCN-specific regions: Sequence locations=1-148,170-354,388-579
ggctgctctcctccagccgaaatatttcatattagagccgggaatcggcatttcggtaattagtcggaactttcgctctaattaaaaaattcttagcggaaaattctgaaaattttctcaaaaatatcccttagctattaggagttctaaggtattcgattattttaaacaaagataacggaaatcccgccgtttttaaataatctcaaaaaatcccggttggctggttcttgcatagttggtgtttcttttctaaccggttttttggcattctgtcgcgcgccggcgttttccttcaaaataaattataaggccaggagcaggaaaatttgcggattttctgagagtttttttaccaaacaaaaaaatatatgaaatttaaatgtttccaaaaaaaaattttcagaggctcgcgcaattgcgtcggcttggcttgctttgatgttggtttatttgctgttcagcggttggatttattccgtcatttaccgcgcttatgccacccaaaaggaggaggaagagcaagggattaaagctgacgaaattcatggacaccaaaattatgccggaggcgtttaa

SEQ ID NO: 60038 - DNA, 5590 bp, Heterodera glycines
  Genomic contig location: Contig_ID=SeqID_6018; Location=178..5767; Strand=-
  SCN-specific regions: Sequence locations=1-213,235-345,367-1381,1403 -1444,1466-1955,1992-2144,2166-2212,2246-3110,3136-4248,4270 -4537,4559-4590,4612-4673,4695-5009,5031-5119,5143-5197,5219-5590
atgatttgcatagaaattcgagtagaaaattttgcgccaagccaaccagctagccctcgaaattttctccaacccccacatacctcaactccgtctgtaaatattgaaaatcgacagcgattcggaccttttccgataatagttggtcaagctgagcgaatgcgacaaattgcaatgcagcaacctgttgctaacacagttttccgccctatcccactgagacccccgcagataaaccaaatagcagcaaatgctcagcgtagcattaacatggaatttttctccagtggtggtcatcgtattgatccaccaaacgcaccaattcaggcgggtagtcgtttcattcgaaaaattcctgcagaagcagaactctggcaaggagcagaggagaacattaattttgtatacccacaaaatcagcaaccaagacagccaaatgctttcccgttccaaggaaatgagcaaatttttcaaaaaccgattatgaatccctgcgaaaaacaatttgttatgcatacacaacccaattcaacggttctaagcaaccttgaatttaatctgatcttggaacgaatcccagatttaaatggaaatgagggcattgagatcgtaaggcgttttttcaaaaaatttgatgcctacacggacgaatggccaaattcaaaaagaattttggcgttggaaagcaaagtgtttaacaaagccgagagagcgcttgaagcagcaaaggcaactcagccataccgttatgaactcatccgtcgcgaaatgctgcagcagttagaagaaactgactcaaaaaatctcaacgcttttgacgaattaatgatgggcgtccgcagaaaattaaatgaaccgattgatgatttggccggaaggatttctgccttagttaaacgggcctaccctggccttacaaacaatctaagtgatgagtattcaattaagttcttaatccgggcgatgggtaatcccgatctcgctctaaatttggagctaattcgcactgtgggcatgacactcgatcacttcgtttcgttggctgctcgggctgaatcagcacaacgcgcagcaaaacgtttcgtcacaccgacgaatgacacatttcagcatcgggtacaaacgcagaaatggcgacaaaattctgttgtcaactcaaatttcggaacaggaacaagcgaaagattttcgcagacttacaataccaatcatcagtccaaagaaggtcaacatttccaatggaaatgttacaattgcggggaacccggccatttgtcacgcaattgcacgcgtccaaaagatttttcgcaaaatcaggacaccaataatcaacaaaatagaaattttgttgtgacgggagcaaatcggactcaaattcagaccccaaataataacaaaaacacattcaaaccaaattcatccaattttttaaagcacaattgtttggtggttcagcgggaagaagtcttcaacaaaacgcgggtaatcactaatcggcggcgactttttgcataagttggtcaaagaaaagcaagtgaaattggagtcgttggaaatttttaagtcaaaaactcaaatttttgatgttaacggaaaatttgttaagtgccttggaactgttaaattgccagttcatcgtcatgggttttcagacccggtgtccatttttcttcatatcacaaacgctccaattggattcggacttttgattggcaccaacgcattacaagatttaggattcaaactttatgatgaacgcaataaagctatggtcgaattcgaaaaaacagagtcgggaaaaagggattttctcacggtcatttacagaacgaccattgagccgaattcagttaaaaatttggagttaagcattgatagtcaattcgaaggagctgaaattgtcgcaacgccggacgaaaattccgtcgccgcaattcgtgttgaaccaacagtagggcttgcccaaaaaggaaaaattattgttccagtgacaaatttttcaatgtcagccattacacttttcgaaaactcaaaagttggaaaagtcgaactcgcaaaatcagtcgaagaagcagaaaatttcttaaacagccaaattatttgttccaaaaaaaacgatccaattgcggcctttcgactagacgcaatgaaatttttggaaattttacaaaccagaactggggacctccctgaagaacatatggaaaaactacaaaaatttggcaaaaaatttcctgaaatttttgcgctcagtgatgaagacctgaagcagactaatttggtcgaacatgaaattgaaaccgaaggaaaagcgccaataaagacaaaaacgcgacctgtcccatatgcttaccgcgaaaaaattgccgaaatgattcaaaattacttaggccgaggtctcattagaccttcaatgtcaccttgggccagcccaattgtgatagtcccaaaaagggatggaactctgcgattctgtgtcgattatagggggttgaactcaataacccgaaaagattgctttccgcttccaaacattgacaatacacttttaatgcttggcggacgtaaatttttcagtaccttagactttatgtcaggttactggcagatcaaaatggaagaaaattccatcgaaaaaactgccttcacaacagaatatggcctttatgaattcatggttatgccttttggcttaactaacgcagtggctaccttccaaaggttcatgtctcgtctttttgacggaatgattaaccaatttttgttcgtgtatatcgatgacattctaattgcctcagaatcattcgaagagcatttgatacacatcgaattagtcttttctcggattaaaactgccggtttaaaattaaaattggaaaaatgccatttttgtgcgaccgaactaccatttttgggtcacatccttacgagagaaggaataaaaatggacgcagataaactgaaaccagtgatcgaattgccaacgcccacaacaaaaaaagagcttcattctttgctaggatttttgacatactataggaaatttatacattcctttggtacaattgccgccccactttttaagctactgagcgaaaaagttgaattcaaaatgggagaaaaggaaaaggaagcactagaggaacttaaatcgaaaataattcgagatgttgtactttattttccggatttcaaagcagcagaaaatgacccgagcaggcagtttataattatgactgatgctagtaaaataggtattgcagcggttttatgccaaccggatcccgaaaagagaattagaccaatttactttgcctcacggcaatgcaaccatcacgaatctcgttacagtgctaccgaattagaggccttggctgttaaatttggtgtaaaaaaatttgcccaattcatcatcatgatcccaacaagagtgattacggatcataaagcacttatttggatgtttcagagtaaaaacgaaaccggaaattcccgagtcgaccgatggcttctcgaattaagctcccgcttcattctaaaagttgaattccaaccggggaagaaaaatgttatagccgatattctttctcgttctaaagcagctgaccaaattttggagccaaaagacaatcaagaaattgcattaattgggaaggtacgaacaaatgaagttccagattctatacaagatttcactgatcacaaagaaaaatgggaggaagagactaaaagcagtgaaatgcagccgatctatgaatttttggccaaaaaagtggttccaaatgaccctcaaattcgacaaagtgttatggataagtcccacagatatacaattttcgaaaaacttttgtatctctgtgaagatgatggaagaatgcgcctctttgttccaaaatccttccgtgaaaatttggtaaaggaacgacacgaaggaaaatgttcagggcatatgagcggcaaaaaattgtataaacagctttcggaattatatttttggcctaatatgctatcagattgtattcgctttcatctcgcctgtagaatatgcgcacatacccgaaatgcccgctcaaatgaaccaccactaaaagtagttcattcttctgaaccacttgaattagtttgtatggacattttagacatcggaccaagccaatcaaattttaaatacatttgcgtaatcatcgatcatttcactaaatatttggtcgccgaacctattccgaataagtcagcagactcagtcgcaaaaatatttgtggaaaaatttttagtgatttttggaacccccaaaaagatacattcagatagaggaaaggaatttgtaaatgcaacactaaaagggataagcaaaattcttggaactgaaatgtcatttacagcgggttacgacccacaaggaaacggactggtcgaaagagtgaatgggattataattgggatgttaaaaaggtcaacggctagcaattggacgtgggacgaacggttgccgtttactgttttcgcctacaatataacgccgactgaatctacaggcttttcccctttcttgttgatgtttggacgaccagcaataattgcatcggacaaaattacgcaaataaattttaatccgatatatacaattgatcacgaaaactattttcaattgttcttggaaaatctcttaaatattcaagacaaagccaaacaaaatttggaggaatacaggaaaaagagtaaagagtggtatgacgcaaagccccgagtgaaggcaaacaaatttgaaatatcggaaagggttatggtagcttttccgggaatgcaccgtaattcccgacacaaaaaattactatggacacatttcggcccttactttatcgtaaaaataaccgattcctcagcagaagtagtgccagtcgacaaaaagacggctaatcccatcactgtaccattggaaaggcttataaaagtccctaaatcgattccaaacatttcaacattgccacgagggaaaaatccctataaaaatatattaaatgcaatgattcttagcgtgtcggttcaaatggaatgccaaagaagggaagaatcgctagccgaaaataagcaatttgggacaattgctattaaaggcgacgaagagggaaaagaagagaaaaatgggggaaaagatagcgggattaataaatctttctcgatcaaagggacggaattccctttgaaaatttcaggtcaaatgaattcggacgccgggatcagttggaactcaatttgcaaccccaaagaagaggggcatgaattttgcagtgttttgaaattgggggagctggacccggtgcttggccagaccgggatcggagcaaccatcgtccaaacaccgctacaagcactcttggccattttcttgttgcgctccgggaccgtctcttcaaacaccgccgcccgaattttcgtggaattgattattaaaaacggaccaaaaaacgaaatggccgctttctccgagaaaaggggggattatgtggaaacaggcaaatttccacaggaggaggaccaatcgaaggcgctcgaaaaatggttggaatcatgttgtgcggcacgtgaagct

SEQ ID NO: 60039 - DNA, 1141 bp, Heterodera glycines
  Genomic contig location: Contig_ID=SeqID_29554; Location=156..1296; Strand=+
  SCN-specific regions: Sequence locations=1-20,42-184,213-623,645 -695,717-909,931-934,956-970,999-1141
atggaaaaagcagaagtgtcacaatgtttttcaaaatttgacaataagtttctcttcataattggtcacggtgatgaatatcgaaagtttaagcagactaatgaaagaaacggcgcaatttatatttattgcctgaaatgtgaaagttataggaagcaaaattctgatgggttgttagctttacatattttaatgattataaattatattaagtatcatcgcaagtgcaataataagagaaggtcaattagaccgaactcacaaaataattcataaccagcattgtaacggtgttccgcttgaacagcttactgctgaacaaattgatagaagccaaagaagagatttagcgcaatgttctacggatcctaaatctatatggcgagaagtattgtaaaattttaataaatcccaaatagaacattttagggatcagaccggtccagagaacatgatattgctgaggatattgggattgaagatacgactggaatatcatttaattacccgaattggcagacagtacggagtgcatataaccgtagaagaaaaaataatttaggggattcgttagacccctttaatgttcccgaaaggtttcaattgagtaaacgtggagcaatcaagttacttcttagaaaaaatatttctgaagaagacatgtaagtatgaatttcatggaatattaggtaagttgaaatattctaaggtggatgcgattcagagatagagaattaggcgtgatggtttttatatcggatacacaaaaaagagctgctagccattgcaaagttttagtatcagacggaacttttgaattggcacctttacagttccagcaaatttggacaattcatggattggtcagacttagattagatttatgtttaatagagaagtatttaagcttgagacagcaaatggtgctgaatggactccattacttctctctataatgaaaagacggtagtatatatttatttattcttttaataaatgaaattacagaactcaagcttcatatgaagcagtcctttcgcagttaaatgaaatatggggtgaagaaatttttgaaggaattgatagaattcatacagattaaaaacagctgaaatcaatgctttgacaaagcaatttggta

SEQ ID NO: 60040 - DNA, 504 bp, Heterodera glycines
  Genomic contig location: Contig_ID=SeqID_29557; Location=312..815; Strand=+
  SCN-specific regions: Sequence locations=1-504
atgacattccaatcactgaaaatcaggccaccagcattccaatactgggactcaacccaccaactttcattgggattccaatctctgggactcaacccaccagcatttcaagctctgagactcaattctcaggctttccaatcgctgggactcaacccaccaacatttcaatctctgggactcaaatctccggcattccaaacactgggactcaacccaccaactttcattggcattccaatctctggaaatcaagccaccagcattccaatctctggactcaacccaccagcatttcaatctctgggactcaattctccggcattccaaacaatgaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaa

SEQ ID NO: 60041 - DNA, 802 bp, Heterodera glycines
  Genomic contig location: Contig_ID=SeqID_29560; Location=624..1425; Strand=-
  SCN-specific regions: Sequence locations=1-604,626-802
acgaatacgtggtaaggccccctccccccgttggacgagagtgaaactcatggccaccctttgccattttgaagtcccgtagcggaaagcgcgtccacatttacaacaccgacgccgaaggtcggatggcaatggccgacccattggccgaggccaaagaaaaagtgaatttgccacgaaattccgaaagccaaagaaagagcaaacattggcaactttcactaggccatgaaagcgaagaacccacatttgttcaccatcgctacgctcactggccatttgatactcacttatggccattgctccgccgcgatggacaacggaccggcgagggcggcaaattacgcggaacaattgaggaaaacgggcgacgaattcggacaaccggtggaagtgtcgcgactgttcagtgaggcaagtgcagaaaaccaaatggtgggcactcgaaacgaatggagaaagagtctcaacaaacggtgccatggaaaatttagagcgaattgtttctttttatataatttggcacttattttgccaggacttcgactttcactctgcgaaatgcgaagcggccgatttgatgcaatcgaacgctttgccaagcgtgagaacgccacgagggcacatgggcccagcggcatttctgatgcgcgtctcgcgcatcgacgaggctgggcttgactcggcacagccgttgaaatacacccatttggacattggcgtatccatgggggagtacccaaacacttcgttcccttctcctctgctcgcacttattgcacagtaaattgacaactcgcaa

SEQ ID NO: 60042 - DNA, 773 bp, Heterodera glycines
  Genomic contig location: Contig_ID=SeqID_6023; Location=244..1016; Strand=-
  SCN-specific regions: Sequence locations=1-633,655-773
atggaaaatttggcattaatgggacaaatggtaaattattgggacaaatggtcgacaaaaaattaaaaccaatctgggtcattccatatatgttgtatccaatgtaaacaaaacaaattctaaatgtgtcgtcaaaaggtgtgtgccaaaatttgacccttcggagcgcgggacaaagccactcattacgcccgtgggggggggggaggggactaataagccgaggctaaacagcctcataaagcaccaccgcccattgaacaaagcgtgccggaaggagccggggggagggaggtgaagggcgaaaatggcctcgcaaatatttatcgcgcagattatgtgagggagggggcgacggtgtcggcagattcttttgatccctccccccgggggaggggcggcaatatttgccttcaatttgcaatgttactagccatccctgcccccccccccattttcacaccaatttcttcgcggggacaaatgccgaattttcgaacatttccggcagtggacagaaaaaatggataattattgttagacccagcaatgttaaatggcattaattaagtgttggcaaaatggcaatgccaagtttttaaagtgtagttttgccagtgaaaaagagtattgaattttaaaataaaattttttcagcgtcggcaaattagctctttctgttccaagttcaaactttaaaaaccaatattttatttattgcaaaaacatctaaaatttttgcattttataaaaaaatattgtttgaaaataaa

SEQ ID NO: 60043 - DNA, 440 bp, Heterodera glycines
  Genomic contig location: Contig_ID=SeqID_29563; Location=371..810; Strand=-
  SCN-specific regions: Sequence locations=1-1,24-161,191-323,357-440
aaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggggcgatttgaatgagaatagaaagagccaggttcgatgaagttttggtaagccaaaaaaatatccaaatatttaaaaatctataaaaaatttaaaaatgacaattcatgcgagattttctggaaataagcttaattgggcctagttaagctgtaaaaaaaatttggggcgatttgaatgaga

SEQ ID NO: 60044 - DNA, 1097 bp, Heterodera glycines
  Genomic contig location: Contig_ID=SeqID_29566; Location=341..1437; Strand=+
  SCN-specific regions: Sequence locations=1-293,345-357,393-716,739 -901,935-1097
atggttcccaaggtgttcaactgtaccattcgccgttcacttatgtgccgttggaccgggacgatgtggcggtgcaacggcagtcgctgagtcggctcgaatttgtggacattttgtacgccggatatgacagtaccacaaaaaatgtcaccccagcactgtatgtggagggcgtgccgccgttgatgaacggtatccgagtggagcgcagtgcatacgatggcatttacttttgggagccggaagtgagcataaaatatttacaactattatataagatatgttattcatacataatatttaaattttatcagtttaatatacaaatttataattatttaaaacctgggcctacagatatatatatatatatatatatatatatattatatttaccaaatacataacaaacgacaccgaagcaaatgagatttttaccataaaaattcagattttttttttgtctaaaaatgaataacgctacgcggggaaaattgagaatttttgccatttttaatagatttgcacaataaaagctaatttgatggattgttttgaaaaattttggaaaattttttgtgaaatttgcgtaagggagatattgggtagaataccaataagcaaaaacgaaaattttatccgccggtgatagattaagaaattttggcagatttagtaatatgttccaccaaaaaatgcctgcctatatgaatttaatcttttcattaatgatgaaataggaattcgtgcatcagctgtgcagatagatgaagctagaaaatttttgaatttttataatatttgctttaaaaatggcatttttctaaaaaaaatttctttgtcgagcgctcaaaattgaggaacaaaaaaaaaaaaactatatgaaaaggttgattcaacgaaattaaaaataaaaattctattttttttaaatgcctaaagaaacaatttaatgttttcaaaaaaaaaattttccccattttcagggtcccgttcttattgcgaactcaacaatttcacataatcgtggccatggaattgttattgagagcacattggatggacgagcattaggaaccaaagtcgaattgaggtag

SEQ ID NO: 60045 - DNA, 84 bp, Heterodera glycines
  Genomic contig location: Contig_ID=SeqID_29568; Location=541..624; Strand=+
  SCN-specific regions: Sequence locations=1-14,38-84
tacaaatcagttccattttccccatttattttggtcaacttgccacaatcatttcgatcagtgccatccccgcccatttattga

SEQ ID NO: 60046 - DNA, 270 bp, Heterodera glycines
  Genomic contig location: Contig_ID=SeqID_29570; Location=375..644; Strand=+
  SCN-specific regions: Sequence locations=1-270
atgataaaacaacacaaaaaagttatttttaccacttgtgcagttcgtgatactgcagattaaatcaccttcctggcaatcttttgcagtgaaattttggtaaatttgagtgttcgaaatcgatccttcataacatttaagaccttaaaataatgttatttatcaattaatattttctttcagaaaaaccttcggagttgtccatcatcatacaaaacagaaaaagaaacatagcaatcggaatagaatacattgagttctttagaaata

SEQ ID NO: 60047 - DNA, 462 bp, Heterodera glycines
  Genomic contig location: Contig_ID=SeqID_29571; Location=336..797; Strand=+
  SCN-specific regions: Sequence locations=1-209,231-245,267-333,379-462
atgcgcacccgtccgatctggcaagttatgcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtagtgctctgaagggcgtggggggggggggcgggggcccaccacgaggccgcgaagcggccgagtgagtaccttcggtgcaggaaaattattaaggaagagagttcattatttattttttttttgcataattaattcataaatatttttttcagaaaatgctctgaaacgcaccaaattttatttacatgttagtttaggcactctgatgctttttctatcaaaaagggagatga

SEQ ID NO: 60048 - DNA, 523 bp, Heterodera glycines
  Genomic contig location: Contig_ID=SeqID_29571; Location=1..523; Strand=-
  SCN-specific regions: Sequence locations=1-245,268-523
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcataacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattgacttgtaaataaaatttggtgcgctttagagcactttctgaaaaaatatttatgaaataaaaaaatcgatttattcaagtgtccgtttggggtactcacgcaattatggggagcaaaatccaacgcagaattaaagtacagactatagggaagctaatcccgaaagattcggtctccccataaatctgggcgcatcggttcggggggactg

SEQ ID NO: 60049 - DNA, 273 bp, Heterodera glycines
  Genomic contig location: Contig_ID=SeqID_29571; Location=904..1176; Strand=+
  SCN-specific regions: Sequence locations=1-87,113-273
atttataagcatttgtagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttcccctgcaaatttggtgagctttcgatcagtctagaacgttgggtgatcaaatgcaaaaaataatttaaaaaaa

SEQ ID NO: 60050 - DNA, 1030 bp, Heterodera glycines
  Genomic contig location: Contig_ID=SeqID_6024; Location=120..1149; Strand=-
  SCN-specific regions: Sequence locations=1-502,622-711,733-1030
atggtccaaatgaccgcttaccgcgtgcaaaattgtgatgggctgatcaacaaaagcggatgctacgatctggttcaatttggcttaagtgcccctcccccctaatctatttactaattaagaaattggccgatgtaatgaccggcttttggccttccgaaaacggttctttgccaccggatgagccaatttgcggcttcaggggtcaggtaatgaattgtaataatgacttttaagcattcatttcctgcttatcccctcaattcagcgttgctcttataccatcgaaattgccatcgctgtcacgattttggctttgattttgctaattcttttggcttggatgttacgccgttattggtcacttttgggaattggtcacggttgacttaactattttttggccatgtttagccaaactcgcgcgttgaacaaaatgtcgtggcgcttgttctgtgacgattttcgactaatcgacgaagaaacggccaaatcattggtaaattgatcaatcaattttaccgatcacagataattaatccacaatcaatcaccaattgctttactaaaaatcaattgctcaatcatccattgatcactaaatcaatcaattgataatcaccggttgattggagattctgattgatcagtgatcgatgattgccctttaaatcgataataattcactgaattttcttccgatttcgtcccttttttgtttcagttgtccctcgccagtggcaataccaaattgagcaatatgagcacaggtggaaaccgaaagcacgccattttgggagtgaatacccacgcgacgtatcgccgcttcgttcaaaagcaaccgctgaaattcctacgcgaagatttagtgctgttgaccgctgtcaaagatgcggtccacgacaatatcaatccgtttttgggtgagttggcgtttgccaatcttatagggctgttcgggagagagtcgagaagaatcgaagtcgagactctcgggcatctgaacattacaatttcgactgatgtttaa

SEQ ID NO: 60051 - DNA, 1225 bp, Heterodera glycines
  Genomic contig location: Contig_ID=SeqID_6025; Location=640..1864; Strand=+
  SCN-specific regions: Sequence locations=1-3,25-28,50-175,197-817,840- 997,1020-1196,1218-1225
atgcttcttcctctcctctccgcccttttgctgctgcttctgcctcctttccatcgcttccctttggcccaattcgcttccaaaccgcgtgagtaagccctttgcccgtttctgtcacccccgttcatctgaacaaaccatttcagcacctctctccccaaatcccaagcctaagtctcctcttgccgctgggcctttgttgctgaaagcatgctgtggcgacaattgtgaggagttccaacggcccgaggaggtacaaaaagatgacaataggcaattaccgtatccctttgcaattcagatgtacggtatcacttggtgggttctgttcacactgactttttttactcgggcaagaaaaattgccgttttaaagttgcggcaacgaaccaagcaaccaattcgaggaaatctgttgcgacaatgtgccgagaaggtaagtgccgacgagttcgactttggaagccgtgtcattgttaatccgtgccattatttccatttcctcaggcgtcgccagccctccagcttcatcgaccgctgctgcggcgaccaaacccttgcctatgaccagacttgctgccaaggcgtggtactcatataattatggcaaagcattgtttaaaagttgctgctaattgctcttagtccaggtgcacaacattccctcgggcgaatgctgcggacggatggcctacccgcggaacagcttcaacactttgtgctgcgaggagacgctgatcaccaacgtggacccgtcgctgatttgttgcggtaattacgctaattatactagtaaaagccaaaagaaagtgtcatcaattttaattatatttttaattggacattagcggatttttttgtgtgtccctttggcaggtaaaaatgcgtacgatggcggaaagagggaaatgtgctgtgggggtgccgtttatctgaaggaactgttcgacgggtgctgctccatatacgtgagacgagtctcagtagataatttagattttaaaagttttagggtaaaaatccgccggagtatcagcagttcagcagccgaacccaccaatgttgtgacaaacccatcgaacggttcggcacaatcaaatgctgctacctgaaggactcccagggccgcttcttcccgaagagttacgactcgtcaaaacagtgctgtgcctatccgtacaacaaaataacggcaaaaaatgcaaagggaaaatgcacggactga

SEQ ID NO: 60052 - DNA, 772 bp, Heterodera glycines
  Genomic contig location: Contig_ID=SeqID_6026; Location=1..772; Strand=-
  SCN-specific regions: Sequence locations=1-27,50-358,380-772
aaagaccgtccctgggtcgttaaaattaaaatatttttccaaatctgaatgagtcctcagactcttttttcaatttgttttacgatgagaaatttgttttgattttaagccaaaactaaaaatccaattttaacgcaaataacataattagcgatatgatcgcgatcagcagtaatgtgtcgctggtgtacataattccgctcgcaaatggcctgttcttaggtgttaccgtctcccccctttagccttacctcctcttacagtatccaatcggtcgccgcctgcggcgattcgtacgaaggggtcgctgttgcggccgcaatgtaccacaaagaggttcgaatgccattcgcagaacattccttacactttttcagaaagttagagcctttttgggtccgtattgtgccagtggtgagttggcaaatgatcagagacagattgggttgggtttgattggttgaacagagtttgaagcggtggccaaaatgtgctctttctggaacatccccgccatttcgtacatgccaacgacgacggcggtgtccgaccggaacatttacaaaacgttggcccgcacctcctcgaaaaacagcaattcgatcgcaagagcactgattagactggtggagcattacaattggaaaaaggcgagaaagcgaagaatgggggacggtagggggataagcaatcgattggattaaagccaattttaaacgatttttaatggttttttttattttagctggccattgtgacaaacacaggtaaa

SEQ ID NO: 60053 - DNA, 531 bp, Heterodera glycines
  Genomic contig location: Contig_ID=SeqID_29572; Location=513..1043; Strand=+
  SCN-specific regions: Sequence locations=1-322,344-455,477-531
atgacgatacctgatgaaacaatcattgcaccattcgatgtgttcaacaaaaaaactggaagacgtctattgctggatgattcccacgatcaaaatctgctgctaatttcatgcccaattaaacgggacaaaaaggcatggattaaatggagggaagaggctcttcaaggaagtgagaattacacgtggaatttaattgatctcaccgcgggggacgctgacattggcgaatggtgaaaaatcattttgtcaatgcataaatttttatttttaggaattgggcacaattccccgatttaatggcgaatatgcaaaagtgaaaggatggataaaaataattggagatttttatgatctattttttacatttcatttatcatttgatttttaaaaaatatattctgaaattgaattccttttctgaagttaaggcaattaagataaaatggttacgaacatttaaatatttcctatttaatacaaaattaggtcgataattcaaattcccggtttattaacaatcttaattaa

SEQ ID NO: 60054 - DNA, 657 bp, Heterodera glycines
  Genomic contig location: Contig_ID=SeqID_29574; Location=1..657; Strand=-
  SCN-specific regions: Sequence locations=1-56,83-185,208-209,235 -390,417-545,571-657
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaaataaaatagtgaagctttaaaattaataaaaattttaattcagattactggagtagcatctacagtgctttccttgcttttgatgctctcgcaaatctggtcgttctgaccagttataaaaaaaagt

SEQ ID NO: 60055 - DNA, 122 bp, Heterodera glycines
  misc_feature (23)..(24): n is a, c, g, or t
  Genomic contig location: Contig_ID=SeqID_29574; Location=813..934; Strand=-
  SCN-specific regions: Sequence locations=23-122
taaaaatttttaaaatatttatnntcatctcccttttgctataaaaagcatcagagagccttatttaacttttaattaacatttggtgcgtttcagagcacgttctaaaaaatatttatgaa

SEQ ID NO: 60056 - DNA, 158 bp, Heterodera glycines
  Genomic contig location: Contig_ID=SeqID_29578; Location=790..947; Strand=+
  SCN-specific regions: Sequence locations=1-77,100-158
atgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactccaatcaaagccaccgc

SEQ ID NO: 60057 - DNA, 279 bp, Heterodera glycines
  Genomic contig location: Contig_ID=SeqID_29579; Location=781..1059; Strand=+
  SCN-specific regions: Sequence locations=1-13,56-114,153-212,234-279
atgcgccacacggtttataaattgataattttttgaatttaaattaaatttatttgcagattctgacagcgaatctgatcactcagtacaaatttcaacaaatgttcctcatggttttttaattatttaatgtttaattaatttttttaattgcaatttaattgttccattttagaaagtgataacgattcggatcattccgtggatatttcttcaacaaatttggaaggattaataatttcaagtaaaaagcaatacaaatttaaatacatattaata

SEQ ID NO: 60058 - DNA, 904 bp, Heterodera glycines
  Genomic contig location: Contig_ID=SeqID_6029; Location=796..1699; Strand=-
  SCN-specific regions: Sequence locations=1-304,326-513,535-554,576 -671,695-788,811-904
atgtcgaccatcttttacagtctggctgtgtgctatttcgggcttttgtttctcggcgctggccacgctttgatgctgggtgtcaaagaccaccgaatgtattgcattttgctccaggcaaacatcaccggaatcgtacagtacactgacgaggtactgtagaactaactatgtactgtatacattggggaaatgatctcttccttttcactaaaaaccccgaatttttacaacaaaaattcgagattggatgctttcgagttaaaaaatttctttctcgggtttttgaaagattccgaatttgaaaagaaaaaattttggttttctttgaacaatttttaataatgcaaacaaacaggggaaaacatctccgagacagtgactaggaaattgcatataaatgatataccattggatagagcaggatcgacttctagtgtgaatttttaattttagcggtgcattttgcctgcttcaaaagttacagggcctcaaaaatcgaaattttgtgcttgagggctcattttcaactttcgtgtatattttttgcagccctgtttattaatgtaaaattcgaatctattgaccaaaaatattgtcaataagtaaaataatgaaaatttttcaattctatacattaaaaaagttaaactaagttaattcaatatttgtaattaattaattaactaattaacagctcgattatatgggctatgaagactattgaaaaaatgacaaaagtttatgatacacaatttagaaaaaagaagactacacgaaatttaaatggggatttgttatataaatattttaatggcattttacctgaaaaattctggccctgattcaatatttggaattattgtagattccaatcaaggcattttgccttaatgctaataaa

SEQ ID NO: 60059 - DNA, 851 bp, Heterodera glycines
  Genomic contig location: Contig_ID=SeqID_6029; Location=3456..4306; Strand=+
  SCN-specific regions: Sequence locations=1-190,249-312,348-482,511-851
tgtcatgtatttgctgttgcgtgccgatttgctcgacgtgttgcgctggccccttggcgcggtgttcacgcaaattgcacacgcggcaaccgcatgcatttggacgttccgcgaggacccggaggttgccgcttatatgaccgacatggacaacatgcacaaagtgacgctcaaggtgggaaaaatactcaaaatttaatgaattattttaaaatattataaatatttataatttttaattattttaagtggcttttcaaaaaaacttttttgccaaatatttgcaaaattaaataaacaaaagggtctaccttttaaattatttttttgttgaaaattttatatatcaagggtcaaaagtaatttttatttctgagaaattttaagccttcgaatttttatttctgaatttttaaaatccccgaaattgtgattttcgagaaaggttcacaattgcatcacttgtatctatttcatgattcataaaaaaaataaaagaataattaatttctaatgaattaagcagttttgtactaatttaaaaaaatgccatattttgcaattttgtgtcgggattttggtccattttttatgtctatctatcatttcgagatttaatattcaaataattcaaattctttacttgaaaaataagacattgttggtcaattagtttttcgatcatctctaaggtgccagatgagaaaacgcttttggaacatgccaaacggttggctgacgaaggcattgggcacagagtttggcacgaggatggcatggctgtttgtattgcggtgaagccgatgccgaaacaaaagctgaagccattccttggcaatttgcctttgtac

SEQ ID NO: 60060 - DNA, 1278 bp, Heterodera glycines
  Genomic contig location: Contig_ID=SeqID_6030; Location=1622..2899; Strand=+
  SCN-specific regions: Sequence locations=1-84,106-149,171-321,358 -415,462-684,724-805,827-846,868-982,1004-1020,1042-1073,1098-1278
atgaggagaaaaagattgaattcattgaacgaattggtgaaaagacagaaagaatttgtgaaggaattggtcatttccaaagacacatttataaaatggaaaaaagaattggtgccaaaatattgtaaaagtaagagaactttcactaaatattttatctaaattaatttaagtgagacttttagcaattccttaaattgtgtcgagttaatgatttttatgctagggatgggatattatgagtaagaagataaaattttcatatccgtagctgtagctagtttcataaatatttccgaattgcaaaaatgaatttgtggcatttaatatttataatattttttcatatttttaatagtgaaaccggcaaaatccaaccaaatttcgatgaaatattactgcgaacgatgggacaaaaatgaaagagaagcagaaatgagaaaaattgaacaaaatgaaaactcaggggccttatgctcgtctcgcggtttagagctaaaccacggttaacggcgttaaccgtggttaaaaatccttaaccggtatgctcgtccttccctttttaaccgtggttaaggctaaaacacggttgagttaaccatggtttactccatccttaaccacggttacgcaaattaaccgttgtttatttccaatcgatatgctcatctaaccgtggtttcgtaaattatttagtaatttaattgtaaaataaataaataagttttttctaggataatttacatgcagaatagaatctgacatttttgtataatatacaaattattacggaattaaaattaacgaaataaatgaaattgaaatggaataatatatccaaaaatcaatgaacattgatattttaaagatccccaatattgtatcccaagtgatggcgcatttctcgatccttttccagcttcaaaagctctatttcaagcttatgcttctcaattgccaaatccagtttggcactttctttcaaacactttaatctgtaaatcgcgtgcagttttgttgatgattatgttggaaatatttccacaattttctttttttggcagacatgtaatcagcagcagcagaagcagtagaaaagtttcgtattttgctactgatcacgccgcccgagtgatgacgaatcggtgtcaagtctgtaaatgatggcggaacagcagaagaagttgttgcagtagcagaataagtctccgatctagagcaaaagcttgagtcgagaattgcagtagatgatttggggcgttcccctatggccaatta

SEQ ID NO: 60061 - DNA, 582 bp, Heterodera glycines
  Genomic contig location: Contig_ID=SeqID_29585; Location=162..743; Strand=+
  SCN-specific regions: Sequence locations=1-582
gaaacaaaaaaaatcgattttttcaagtgtccgttggggtactcaaacaattatggggagcaaaattccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacag

SEQ ID NO: 60062 - DNA, 996 bp, Heterodera glycines
  Genomic contig location: Contig_ID=SeqID_29586; Location=331..1326; Strand=+
  SCN-specific regions: Sequence locations=1-142,170-340,363-658,683 -966,988-996
atgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaagaagaagccaaagaaggtgcggcgattaatatacaacaagaaaagaagctagaaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgaacggaacaacaggcagaggtatcatatgtattgaagaaaaaggaaggaaaattggaagaagaaaaaattgaaaccaaggatgataccaccattaatgaatttccaactacagaatatggaatagaagagagtgaaacggaggagacagagaaatggtcgccggatcaagctaaacaaaaaatattgaaaggaaacgaggagccgtttgagcagcccgatgaccaaaaagatgaagagacaattttggttatcggtaccgataaaaaaggagaagaatttccatctaaccaatatgagattgaagataattatccatcgtcatcatcatcatcatcatttattgcccaaaacgaagcatcggtaacgaccaaagatgaagaaggattgttaacggtccaaattaaaaaactaccaatgacaggggataatgagcaaaaaacaatacaaatggtaccatcagattttccttcatataatgacgatgatagcagagatactactgtcaatgaattgtcagaagaacagcttgcttatactgttcccgaagaagatatgccgaaatcggagccttatgatgtagatgagttcccagatctgcctgatcctcaaacgagtctgccaaggggagaggaggtgataaaaaaggagtaa

SEQ ID NO: 60063 - DNA, 117 bp, Heterodera glycines
  Genomic contig location: Contig_ID=SeqID_29587; Location=675..791; Strand=+
  SCN-specific regions: Sequence locations=1-117
cacgagggcaagcggatgaagcccgaactgcggtgccatgccgtgctctgtcgccgggcggacgagccccaacaaatgcaccaaacattgcgcagacatctccaatcggcactccaa

SEQ ID NO: 60064 - DNA, 546 bp, Heterodera glycines
  Genomic contig location: Contig_ID=SeqID_29588; Location=629..1174; Strand=-
  SCN-specific regions: Sequence locations=1-136,158-546
atgtcaatcaacgaaaatgcaatgaatgcggaaatgccaattgcaatggatgcacggttacgaaatggcgtgaatacatgggtaaaacatgttcaatatttaacctttcggggaaatttgttcagcagaaaataaaatttttattaaacatttgttaagcctgctccttatctggaaaatgctattccaaacgacgggctgaacaagcggattatgtttggcaactttttcaatctgaccattgggcccgcgttggaaacgagtgaccttttttaccacttccgcgtgttttgtgatgaagataaaatgaaaaatacgatactggaaattgacgaggagggcaaaacagtggagaaatggacagtttctgaagactacagtgactacaaattcaaaacgttcaccaaagggacgaggccgaccaaagttgtgttcaacagcgagcagatacagtgcgaccgctaccatatcaaagtgtgggcgacgcacgcggaatggatggacatggatcagacggcgatgacggtgggatcggtgtacaagtag

SEQ ID NO: 60065 - DNA, 789 bp, Heterodera glycines
  Genomic contig location: Contig_ID=SeqID_29589; Location=185..973; Strand=+
  SCN-specific regions: Sequence locations=1-20,42-156,179-536,558 -684,721-789
atgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcagacttattgtagagctcggtgagctcgatttttccaaattttaaaatttcgaaaattttcaaaatttttcgagctaggcctaaaaaacggttttcgggtttttgaattttaggattttttaacgaattttcccagaaaaacgaagaccacttccaaaacatagtttttcgagctctatcgactggtatttttttcggaaaaatttcggttttttcccggaaatagaaaaattttttggcctcagcgggacatttgagtcccgggcccataacttgtcagggcttggatttagccaaaaatcgtcttagaacatttttgtagagaattttaagctctatcgaacggtgtgctatatgcccggaaaatttcaaaaattttcgagctaggccccctagaaattttcagaatttttttttgggttgaaaatgggggtgaaattttttttctgggttattttggggtgctgagtacgattatgatgtctattttaagtttcataatttttggaattttttaaaattcgaaaattttttaaatttttttggtccttggaaatttggattaaaatttgaaaattcataactcggtgatggtttcatcgatttaactata

SEQ ID NO: 60066 - DNA, 77 bp, Heterodera glycines
  Genomic contig location: Contig_ID=SeqID_29589; Location=1959..2035; Strand=+
  SCN-specific regions: Sequence locations=1-77
gagaagcgtcctaatttccctacaaagtttgaaaacggtcgcgaagcgcccgtcctgaggccgcgaagaggccgaat

SEQ ID NO: 60067 - DNA, 960 bp, Heterodera glycines
  Genomic contig location: Contig_ID=SeqID_29591; Location=318..1277; Strand=+
  SCN-specific regions: Sequence locations=1-660,682-923,945-960
atgagcggagcgacggtcactttggtgagcaatttgagcggattggacgacgagcgggaggtgatggacggagtgggtgacatcgcggccggcttcaaagcgttggactgcgatttgctaattgtgtgagtgaaagagtggggggggggggggtaggggggcggggacggcacattttataatggaaccgcaatttggcacaaatgccatgtccttcagtggccccgacctctcattggatgagtcccaactcacaaaggcgcagcgactcggccattccttcgccatgaaattgctggccaaaacgggcggaactgcgtacaattttcagtacgttctccacatagggccggcccccaattgacgaattcgtaattttttgcttcagcgaaggtctctcccatctgaagctgttcatcccaaagtccgtccacccccggggcacgcccttcgcttttgagttgggcaaggacttcgcagtcaaagtgcaaatgtacgtgaagaatgacgacaaaccggcacttccgctcaaattcaaccaggtggcatggcagaaaagtgccgagtctgaccaggcccaggaggtgaattgggcacaattggattaaaacagatatttccgctgatcagctgcaaaaagtgcgccgttatgagaccatttcggacgcctccgccgccgccaagaccatcagattcgaccaaatcgaccaggcgacggacgccgccatcgctgcttttaatcaagcggcgcccgccgcacttccgtccggtcgcttcgttgaaaaggaacaaatcacgcgggcgttccgttacggcaccacactggtgccgtttggcgaagaagtggccaaactggtggactacgaaagggagggcaagcagctgcaactgttgcaatttgtgcgcaaggaaaacgtcagttttggagaaaaaccgggaaatggcaaaacagtgaattaa

SEQ ID NO: 60068 - DNA, 5167 bp, Heterodera glycines
  Genomic contig location: Contig_ID=SeqID_6031; Location=28..5194; Strand=+
  SCN-specific regions: Sequence locations=1-228,250-373,396-1281,1312 -1344,1366-1993,2015-2486,2510-2681,2703-3106,3128-3292,3315 -3346,3368-4473,4495-5037,5059-5167
atgaatgtttttgaattctccccgatggaaacacatgcaaattcggcacatataatctatcgagtcacacttctgcctcaatcatccacacttgtcgaattgtcaatggccaatggacaagaagacaaagaagtcactgtaataggaagaaatgatttggatgagcaactaagaattgagcctactttaacatcttgcaaaaacggacaaatcgctgtgccgatcacaaacttttcgtcaattccaattacactggaagcgaatgaaagtgtcgcattggtcgagcatgtcgatgaatggcacgaattggaacattcgtttttccctccgttcttcgtcagcagcgtcacacatgaaaatgaaaacatacgcactgaacaaatcaaagaaatcttacgaactcgtattggccgtattggcatgtctcagcaacacgaagcggacaaattggaacgtttaataattggtttcgaacaaatttttgcactcgatgacagcgaactgacacaaactgaaataactcagcatttcattaacaccggcgatgcctcaccaattcgaggccggatgcgtccactgccatttgcacatcgtaaaaaagtttcgtcaatgctccaggactatttaagcagaggattaattcgaccatcaaaatcgccatgggcaagtcccattgtccttgtgccgaaacgtgatggaagcttaagattttgtgttgattatcgagggattaattcggtcacagtgaaagacgcatacccgttgccgaacattgattacatccttctcgcactaggaggaaagaaatacttctcgactctcgacttcctttcgggctactggcaaatcagaatggacgaaaagtccgttgaaaagactgcgtttgttactgaattcgggttgcacgagtttaccgttcttccattcgggctttgtaatgccgttgcgacttaccaacggttcatgtctcggctttttgaggatctgattaatgactttgttttcgtctacattgatgatattttggttgcatcagagtcgtttgaacagcatttggaacatttagaaattgtgttcgagcggataaaagattccgagctgaaattgaaaattgaaaaatgtcgtttttctgcctccgaattgccatttctgggacatgtgttaactcgccgtggtttgaaaatgaatgccgataaagtaaggcctgtcattgaactgcctttaccgtcgaccaaaaagcaattgcattcatttctcgggttcatgacgtattatcggaaattcatctatggctttggagagattgctgcacctctgtttcacctcctaaaaaagaacacaccatttgttttgggagagaaggaaatattggtagtcgagaaattgaaagaaaaacttcttgaagatgcggttctctatttcccggacttcaaaagcgcaatgaatgatgctgaacgatgtttcatcatcctcaccgacgcgagtaaaattgggatttccgcagttttgtgccaagctgacgagaacagacgagtccgtccaatttacttcgcatcacgtcaatgcagtagacacgaaagtaattattgcccaacggagctggaagctcttgcggttcgatttggtgcctggaaattcgcacaatttattaccggaattccgaccaaaataatcaccgatcataaagcgcttccgccaatgtttcggagtaagaaacaaacaggaaactctcgagttgaccgctggttaatggaattgaacgcacgattcactctaactgtcgagtacagtcctgggaaatccaacattgttgctgatgttttatcacggtccggtgctttaataagtgaagtcactgagaattttgacatggattcagcttttgtctgtaaattaaaagagaatgaaggcgaaaaaaatctggaagtggatgagatcggagaaaaagagagaatcgattgggtcgaagcgacaaaggtcagcgaattcagcgaaatatacaacttcttgcaaaaacgaattttgccagacgaaatccggaagaaacaaaaaattttggatacttttcataaattttccataatggatggattgctgtattttataccatcgaaacctgaaggaccaaaacttttcgtccccagcaaattcaggcaaacttttattgatcagcgtcattcgggaatttgttcgggccatttcagtggaaaaaaactttttcgtcaattgtcggaaaagtacttttggccaaatatgttcggcgactgcgttaaaacctgtctgagttgtagaatttgtgcacacagcagaaaaccccgatcaaatgaaccgccactccggataatccagacgtccgaaccgttggaacttgtctgtgtcgatattttatcgatcggaatgtccgaaaacggtaatcggtatgtgcttgtctcaatcgatcacttcacaaaatacatcgtcgcaaccccaatcccggacaaaagcaaagacacagtctcaaaagcatttgtaaaagattttgtgttgctgttcggggcaccaaaaagattccatagtgaccaaggaaaggaattcgtcaacgaaactctaaaagaaattttcgccattctaggcgtcgaaaagaccacaactgctgggtacgacccacaagcaaatggagctgcggaacgggcaaatcaaactttgcttaatatgcttaaaaagtctacgtcctcgcactggagttgggatgaacgacttcctttcgttgtgttctcgtacaacactacaccgtctgaagtcactggattttcgccatttcaactgatgttcggaaaaattgcaaattttccaggggaaatagactttaaaaagtatggaaacccgttctacaccgtggacgaggaaacatatttacaagcatttaaagaacatttgcagttaattctcgaatatgcgcgtaaaaatgccgaaatttcacggacggaaacaaaaaaccggtacgattctcgcccaaatgtgaccgcaaacaaatttgcgattggcgacaaatgcatggtcatttatcccggatcgaaatcccgaatacagcacaaaaaactgcattggaatcagttcgggccgtacaaaattgttaaaatgttcgaatcatccgcagacgttgtcccagttgataaaagttcagctgaaccgattaccgtcccaatagaacgtctcgtccgtgtaccagtcggagttcccgacatatcaacgctcccacacggaaaaaacccataccggaacattttggctactattttgcttgcaaatttagaaataatatacccaaaaagagaacaagtaaacgaaactccggtgtcgagtgaggaatgccaaaaaaggggaatcacagaaaactcagcagaaaatttcgatcaaaatcagttagggacaactgacattttaggtgggcggaagatgcagcaggacgaaagcgccgagcttatttggaccatgaaatgcgaaggcgaaagccacgaattctgtggaaaacttctgtgcgcggagttggacccggttttggacgcaaaaacggagcccggaaacgtggaaattggcactcctctgcaggccattttgtgccttttcatcctccgttccggtgccacagtctcttccgcggcggcaaaaagccttgttcatcttatacttggctctgaacccgggatggagttggtcgtttatgaaggagtccgaaaagacaacattcgtgccggtgcccttccacgagaagaagacgtagagaaaatttggtcaatgtggtgtgaaaagtgcgcggtgaccaaaaagcttctccaatcgtcaggatttgagaagattcgagtgcaaaattccgacggagagcccaaagaaaagcccgaaactattcaggtcgaaatgccggaagcggtgcccaaattgcccgaatcagagcgtgacggttggagcacattgttcgaacagaccgggtggattctggaaaaagtccgttccatggccattcatcgttgccgcacattggttgagactccacgagttctgatcggtgactcgacggctttccaactcctctccgaaatgcgggcacaaacgcaattcattggcaccgaacgagggctgttaactgaagtaatccgtccactcagcgagtgcgtcttctcaagcaaagtgcgcgccgcaatgatcatcctcggtcgtgattcgctggtcaaagacgagaccgttgatcagatcatggaacagtgccaacggatccaacaactgtgttcccgttttccgtctgtttcgttcatttggttgcctccaccgtacgttcgtcagtacgatttggcctatcacgaaatgatcggccgtctttctgaactgctcggcgattggtttgttttcgtgactccgtttggtaggagtttgattgaaatctggcgttatggcgattcctttgatcggagtcgtgtcaatgcagatggatggatgactgaaaatggcattaaagcattgtcggcgtggatcagcacacaaattccgaaatggccaaacaacagacaacttgggattcgaacggtccgctccagcgtttcggtcactaggagagtctatgggttgggtctatgcgaccgcccggagactgcggcttcttcttcggctcgtggggggttgggtctatgcgaccgccgcccgaattctcgttctcgatcgccgtttagacgccgcgacaaccgccaatcgcaaccattcgttcgaggaggacaccgccgagatgatgtgacgcgcgaccgccggcactagcttgctcagaccaccaccgatcggatgccgaatcaacttatcggcagggacgccttttctttggggggttgtgatgtgttaaatgggaaataatttggcttttctataatatttttcttctctaattatgtgccgtttcccttgcctctgactgccttttattcttttaattcaattctctaattatatgttattttccttttgtttttctctctaatttattcctatttttctcaatcgatattcctttgcttttcttctcccttgtgctttcctttattcattctatttggtgttcacaaatttggacctcagacttttctcctctaaatattttgtgtgtggactcttaattttcgtcgtcttcgcattgaatttaaattaa

SEQ ID NO: 60069 - DNA, 682 bp, Heterodera glycines
  Genomic contig location: Contig_ID=SeqID_29592; Location=785..1466; Strand=-
  SCN-specific regions: Sequence locations=1-135,157-162,184-227,251 -374,397-584,623-682
atgaactcagcaggaattgaggacccactgtcaatggttttttgtaatgcggatctccacgagagacattgttcatttttaaattgtactaaccgtaagtatttaataaaactaataatacccaaaatttttcgaaagaaaacaatgaaaattttattgctgtttttaacgaattttaattttgtttgtaacttattctaaaatagctccgttctattcctacccatatcctttttaattttcagcttttcatcgtgagtggggctgtataactcaagcaacaaaaatgtattgcgaccaaatcaacaaaagatttgccactaagtgcgagtgccatttcgggagagccgatgaaaatatccctttcattttcccaaaactttcaaagtaagtctgaaaaaaattcactattattttaaaagatgaattttatgtctagttcaaaaaccggtctctgttccggctttttgacgttggcataacaaccccgatttcccttaaagttctcggaccttatttgctttttctaggacccatctcctaatattcagactaaattaaaaagtgcgtgtcgattttgattctaaattaattataaatcaatttaaataatttattttttgataactactaccaattatttagaatgccagaagacaaactcttttacaaagggacgtaa

SEQ ID NO: 60070 - DNA, 179 bp, Heterodera glycines
  Genomic contig location: Contig_ID=SeqID_29593; Location=134..312; Strand=-
  SCN-specific regions: Sequence locations=1-52,86-179
atggccgcctcgttttgcagcattttgtaccagaagccccggatgatccactgtgctgcttcctctgctgctgttgatgatgatgtcgttcttggcggtgttgatcggttggcaatggcgccgtcgtcaaccgatgatggcaattgcctgtctgatcggaaagggaacaaaggattacg

SEQ ID NO: 60071 - DNA, 243 bp, Heterodera glycines
  Genomic contig location: Contig_ID=SeqID_29594; Location=36..278; Strand=-
  SCN-specific regions: Sequence locations=1-243
atgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtcaaatcggcttttggaatttttaatgagtaa

SEQ ID NO: 60072 - DNA, 300 bp, Heterodera glycines
  Genomic contig location: Contig_ID=SeqID_29594; Location=491..790; Strand=-
  SCN-specific regions: Sequence locations=1-300
atgacattctatgcttctcttgttggatacacgggaagaaataatagttagtccttttgttgaatttttagaaattctatccgtcaaatcggcttttggaattttaatgagtaaatcaggaaccgtaaatgacattctatgcttctcttgttggatacacgggaagaaataatagttagtccttttgttgaatttttagaaattctatccgtcatatcggcttttggaattttaatgagtaaatcaggaaccgtaaatgacattctctgcttctcttgttggatacacgggaagaaataa

SEQ ID NO: 60073 - DNA, 91 bp, Heterodera glycines
  Genomic contig location: Contig_ID=SeqID_29596; Location=186..276; Strand=-
  SCN-specific regions: Sequence locations=1-91
atgcgtatattttttgctattttatttttaatgtgttttaaaggcaatgccgaaaagataaaggtgacaaaggccgaaaaataccatcaag

SEQ ID NO: 60074 - DNA, 412 bp, Heterodera glycines
  Genomic contig location: Contig_ID=SeqID_29600; Location=125..536; Strand=+
  SCN-specific regions: Sequence locations=1-79,115-262,301-412
atgtcagaccgcagaaaagaagctgaggaaaaaatgggaaaagcaatgtaaaattaaaaatgccaattttcaatttcacttttaaatttaattttaaatccaattttaaattttgttttccttttttttcagttttatctccgccgattgttggctcaaagtgttcgatttgctgccaccttcacaacttggcctcggaattgcgctgatcagccgacgatttgacttttacatggacgaacacttcaaaactcgccgctgggcattgaaatcaattcaaattcaaagaaaaattggaaagaatggcaccaaggaaatggaaattgccaattacgacggaaaaccaatgccaactccgcaaattcaattgccacgcaaagtcagcggattcgaacggatcaacatcacgtaa

SEQ ID NO: 60075 - DNA, 2457 bp, Heterodera glycines
  misc_feature (293)..(293): n is a, c, g, or t
  misc_feature (313)..(313): n is a, c, g, or t
  Genomic contig location: Contig_ID=SeqID_6032; Location=224..2680; Strand=-
  SCN-specific regions: Sequence locations=1-371,393-415,437-613,635 -697,719-862,902-1961,1983-2356,2379-2457
atggacaaaatgccaaaaggggagagacgagtaaaaacggcatacgaaaccaggaaatacttaaatagagaagggaagaagaagcaggcggagaaaaacatgcagacaaaacacaatggacaaaatgacgaattggacaagtgatatccaaatttatttaatcagccagtaattgtaccattttttaaattctaattaacgccttttccatatttttgcattttatcggcggctaatgggaaatgacaagcagctgagataaatcggatgaaccactgcacagcggccgcagnttgtgtttgtttaaatttgngggaggaggaaaaattgtacgaaaagtgggcggaggggggggggggtggaaattaaaaagaaagataattgaaaactattacccaatcgcatctattctttacttgtgcttgatggtgatgtaaacgatggcactgtttagggcaatgccaaaaagtgacaaaatttgttgaatgattgtcacccaaacggtgtacacgtaaatttggtcggactctccaaactcattaacagaagatggtgatgaattactgttgttatccattagtcgatttattatttcattaaaaaattagatggtaatttaatgggacttaaaaatattatacgcatgaaaatctaattcaatctgggatcaggatatcctcaggaaatttcattattgaattttatttaaatataaaaagaaaatgaaacttgcccctcgaaataattcgcctgttatgcctcctaactttttgttgttcacattagactttaataaaccaaaatcaaaaaaaaaaaaattgaattacattcgttacagtcgtgctctaatgttagcaatttgatgttaattaaagtacttaaaaagcctaataaaatatttaattgggtcaaatttctgatgtgcatcgcttcctaatgatgcaattcattcgattcatggggttttaaagtgtatggttctctgagtacaaattttttaattgcttgataattaacttttgttatgtacgattaaaaaattctcacgcaattaaatagaattgtgaaagcaatattatatgaaaccatatatggcagagaaatagagaaattgtctgacttcaaaaatgattcaagcacaaaaaagtggatgaatataaaaaagtagcggattttcttgtcgacaagacaaaaggcaacttttaaaattgcgtgattatttttgtgcaaataataagtgttttattttttaggaaaaagataaaaaataataaaggttttattttttaggaaaaagaaatttttcaaaaaaaaacttctggtgtgagtcacatttctatccgtgttgggccgttgcttaaatccgccaaatttcgactcccgtaattggttgtggatttccgtaattgaaaagcctaattatggactcggcccagtcccttccccgggccttttgggccttggaaatatttaaagaaaaagtgccaaatatctaagtttgagtattactatcattaatacttttttaggttcgacctagcaccatatctacaattcagtgatgttgccaaaataaaaacaaaatacgagacatgaaaacacaagaattgtattggaatttttatacagaatactttatacagaaaataaagttataaaccaaaattgactttgtgttgccgcttaaaaaaagttgtgaccacttatccgaatcaatttcctttccctcgccggattccgacccaaatacccgaaaaatcgtattatgtctagagagattcaaaataatttactttaagggagttgaattttgattgcttgagcgaataaaaagtagctggccaaagcgtctaactttttttagaacataattttttagttgttgaacaaattaacatggctaatggacagaaaaattcttgttttttagagcatttgaccctgacttttatacatgagcgaaatttttttataatattttagtgactaattcaatttttgagttagaattggtcgttcggcggagctctttttcaatgtaaaatggtgcaattgacacttttatagagagtaaaaattgtgcattcattaagccaacagtaaaacatattcaaaaaagaattatttttacattttcagttgttttgcatttgattgttcgaagaatggagaatttgtgacccgtcagatacaacaacgactggtggattatgattaggtaggttaatcgctcaggcaattgtgaccaattgtgccactaatcgtatgatcaaaaattgcagtgactgatcattagtgaatattcgcggcacaacaaagttgttggttagagcggataaaaaccaaagacagaagatcactggcatgatcacagccaaagatttgaaaatgcgacgagtaatttcaatttgggactgggaagaattcctgctgttgttctgatcactgagcaataaa

SEQ ID NO: 60076 - DNA, 2061 bp, Heterodera glycines
  Genomic contig location: Contig_ID=SeqID_6032; Location=2819..4879; Strand=+
  SCN-specific regions: Sequence locations=1-20,46-542,574-601,623 -631,662-714,736-762,784-891,915-1012,1034-1067,1091-1145,1183 -1190,1212-1769,1791-2061
atgcccttcccttttcggcattgcttttcctccctcctcctccatctaccgttgtttctgctactgttccatactattgctcttcatcgatgttcttcgatgactccgtttcccttctccgctccgtccgtcgccgtctgtcccatcactttccatgcccaggcaatttccactcgccaactctcttccgtcgaatttttcctcacaaagtcagtgggtggtgctttcatttattgggcgctacccgaaataaagccggctgctaatcactgatatgaaactcggctacccgacttttggggatttgcaacttggggacccgacatttggggacccgacttttggggatccgacacttagggatcccgacatttggggatcccgacattaggggacccgacttttggggatccgacatttggggatcccgacatttggggacccgacatttgggcaccgaacgacatttgagcaaaagacacttaagaaaaccacggacatttggcaacccgacatttagggacccgacatttggggatttcaataaaacaaaaaaaatttaaaaatttaattctaagccacaaaattagacaaaattacgtctgcttttagccagagttaattccattgcaaaaaaattaattaatattttaaaaattaactctgtttccggactcaccgcgaggaggcgcagaattttgagcccatactaaccacaacacaatagacaaaccacaatacattttttaactacagtagacctttttccaatttttatttaaagtgcctttcccaagggccaacgggaacagaaatccgtcaaggacattcaaaaagttccagccgactttgctgtctaattgcgtacagcaacaaaatgccgaggtcatcttttcggtttcttatatttcgagtgactttgttcggtgctttaaatgaattttttaacgaattaattttttgtggctgacctgcaaaacaaatctcttccactggtcgccctatttcggtatttatttttccaaaaatatatccagggttgtagtcatcaacattcacactgaattcataagaattcagagtgagcacaaatgggaaaaagtcctttaagatctgtttctcttcgcaagctaaaataattatatcttttcaaaaaataaagatttttaaccttttatttctactattaatttttaacgtatatttattaaacatttagccgccaaaaatgcatatacaactatttttggagaaaacctacaaattcgtttttgcttgttccacttaggacaggcaattaatcgtagattgaagaccgggaaacttagccactattacacaacaaataatgaatacaaaatcttggttcggagtttggctgcgctctcttttctggaggaaattcgagttgtgccagctttttacttgcttcgacacgagcgaatgagctcggcatacaagttgttccaaatgcaggacaaccagtcgcaatattcaattactttggacggtattgttaaaataaattggattgtttattcattatatccaagaaactatgtgcgtggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgaccaaaatggtgattaattctgttttcacatcccgttggcccttgggaaaggcactttaa

SEQ ID NO: 60077 - DNA, 581 bp, Heterodera glycines
  Genomic contig location: Contig_ID=SeqID_6033; Location=1415..1995; Strand=+
  SCN-specific regions: Sequence locations=1-581
atgccaagccaattaaacaccttttgccaaataaaggaaaaagtgccgacattgagcgggaaaacaaggcaattggctgatcagcaacaatttccattgccagagtttctctcgctgcacgatggacggcaccttctcgataaagcacaacggcaggtaaaattgatcagagacaactttcattgatgttaataccaatgctgaatatgatgaagattagcaaaggttagccccaaacggattttggtcccattgtgtttgatcctttcctaaacccattttcggcattttaaagttccgccacttcaatctcggtttagtttttgccggacggaggaggaggaaaattgtcggaggcgaataaaagtgctggcgatcagaaggacggctttttgggtgccgtccgacaattgcatcaaatgcagcaaaagctggaaatgcttctgatgaatgcggtgaacagagaggagaaagtgatgccacaacgaactgtccaatggaaggccaatggcatcggagttcaagccgaaaatggggacggaaaggtggagaagcttaaaatgttaggtggggccgattaa

SEQ ID NO: 60078 - DNA, 479 bp, Heterodera glycines
  misc_feature (11)..(11): n is a, c, g, or t
  Genomic contig location: Contig_ID=SeqID_29603; Location=552..1030; Strand=-
  SCN-specific regions: Sequence locations=1-353,378-479
  Gene Ontology: Mol. function=zinc ion binding; Cellular component =integral to plasma membrane; Biological process=digestion
ttcagcgttcnccggctgtgtcaaacacgcgacaattgtccacgaattgctgcacaaagtcggcctttggcatgagcacatgcgcttcgaccgcgacgatcacatcaaagtgcactttgagaacattccgccaggtcaaagcagcaaaaataaataaaaccagcacattttctttcagatttccacgctcagtttcgcaaaattggccaatatgagagtacaacgtacaacgtaccgtacgactacctcagcgtaatgcattacggtaaggagtccggtgcgcggaggaacggtttgacaacaatggagactatggacaaaagataccaggcaactgtttactcatgaatgcctgataactattttcaaaattgaaacccacagaatttgattggtactgtcaaagacgcttcgccaagtgattaccgtaagatctgcgcaatttataagtgcacaaaatgcatggggagaggatttaa

SEQ ID NO: 60079 - DNA, 503 bp, Heterodera glycines
  Genomic contig location: Contig_ID=SeqID_29608; Location=147..649; Strand=-
  SCN-specific regions: Sequence locations=1-107,134-217,239-263,292-503
atggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaa

SEQ ID NO: 60080 - DNA, 812 bp, Heterodera glycines
  Genomic contig location: Contig_ID=SeqID_29608; Location=718..1529; Strand=-
  SCN-specific regions: Sequence locations=1-509,531-812
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 60081 - DNA, 296 bp, Heterodera glycines
  Genomic contig location: Contig_ID=SeqID_29609; Location=637..932; Strand=+
  SCN-specific regions: Sequence locations=1-296
atgttcttcactggcaccgaccgactgtttgtcataatttttgatgaaatgtaagaaaaaattttatttataattgctcatttaaatttttaattagcgcttttttaggaaagacaaacgcaaaatcctactgtatttgactacgataacaattgtttgttttgcttgctcattggatttgtgttttgtgttctaccaaaatatgttttgtttggtgatcagatgatcaccggttcaattggcgattttttcaaggcatttttcatgaatttttcacgagccaaaattttcaaaaa

SEQ ID NO: 60082 - DNA, 733 bp, Heterodera glycines
  Genomic contig location: Contig_ID=SeqID_6034; Location=2991..3723; Strand=-
  SCN-specific regions: Sequence locations=1-649
atgcattggtcagttcaatttccactcgattgcaatgctgttgaatccgatgactttatttggcagcggtattttcggtattggcagcgatttttgattggaattgacaatttccatttctttcacgccattttttccaattttgcttcgaattttcatttgtcccaatgcccatttgcgggttttgaagtgttcgttcacacggcactcaaatcggggactgataagtgcaatttcgagtccgttttgcgccggcgtaagcaattcgaacacggccaaccaagtgtctgctgggatgaaactggaacgaaacccaaaatgaaaactccgctttttcagatcacattggggccgttctcttgaacatgccgctgaagcagtaccaaaatgcgtgtacaacaccaggcacccagaggaaaaagctgtgcaaatggggacaaaatttgcataataccaaaattgaattaccgtatttcctaaaataagagcccccgggggctttatttttcaacccccatcgaataggtgctttattttaggggggtggggttctaatttaaaggggagggagctaatgttgcccaaaaatctaattcataccaccaaactaagacttaatgaacgatcgatcagctttacgacaatttacaaaataattataaaattaaaaaataattaaatttaactaaataatataaaccaaaatatttggtttaattttaattataataaa

SEQ ID NO: 60083 - DNA, 678 bp, Heterodera glycines
  Genomic contig location: Contig_ID=SeqID_6034; Location=3834..4511; Strand=+
  SCN-specific regions: Sequence locations=1-678
atggatggcagcatttcattgtggtttttgcgcacccattggccaatgcttcaagataacattggcggcctgtcttttgccaactttggcattggccgcttccgccttatgcatgaacacattttcgttgatttgcctattgacgaacgcccatccttcgccaattgtccatcgcttcgcgttgtccaagtcccctttgggcaccacttcttccccgactttccgcccgataacagttcctccgcaaatgatggacaatcactggcgcactggcttttgtcgcctcggccggacaattcgccaaaattgtcgtctgtgctgatctatctgaatatggaagacaaaaaatagaaatgcttaaaacggtgttaataattttatgcaatatagtcagttttttgtaataatttatgttatttggttttagcatttcgaaaatgccacttctgctgtcaattatgttattgtatttactttggcccttggcgtcactgtggccccttttgaattgtttaacaaacgtaccggggaaaaaatgttcctttcaagagtcaaaaaatcgcgcatgaagcacggttctgctcgtcaaatgttgttggtccgctgcccgattaaccgcgatttgaatgaatgggtgtgatgtgaaaaggaggcgattgactggcaaatttgtgacca

SEQ ID NO: 60084 - DNA, 329 bp, Heterodera glycines
  misc_feature (129)..(129): n is a, c, g, or t
  Genomic contig location: Contig_ID=SeqID_29613; Location=280..608; Strand=+
  SCN-specific regions: Sequence locations=1-249,271-329
attttgaaagtcagcaaaacatgtcgggaacaagaggaaaaacaggaagatacagcgggtcgggacgagccacatcctcaagagtgagtctcggaataacactaaaattggatttgaagaatactgtancataccagggacaacctcgtttgggcgccagcccagtttttggactataactttttttctttgtcaatcatagtccctaaggcatttggtcaccactcccggggtcatacctcttgcacaaaaagctttcagtcaaaatcaaaaaattctttcggaatggtggcttttcaactgccaggccagggtttggaatgacaaaa

SEQ ID NO: 60085 - DNA, 108 bp, Heterodera glycines
  Genomic contig location: Contig_ID=SeqID_29614; Location=2385..2492; Strand=-
  SCN-specific regions: Sequence locations=1-108
gtataaaatttctcaaaaaaagagatagccatttttctgggatagagtataaatttaaaaattccctcaaaaataaaaggtaaattgcgcaccgccctccctatcatg

SEQ ID NO: 60086 - DNA, 499 bp, Heterodera glycines
  Genomic contig location: Contig_ID=SeqID_29615; Location=247..745; Strand=-
  SCN-specific regions: Sequence locations=1-219,278-326,348-499
atgagattatgcccatttgttggacaaatatcgcccgttggtggactttgtccgtccccacctgaacatttcaaaggaaaagccaataaaaatggttcaactggtggcacttcgtcacataaagcccgaagtaaaagcgaactcttggcaaaatgccaaaatgcaaatgccattccgtcgcctgagaaattaatggacaaattattgaccaacaaaaacaaaaaataaaatagaaaacaatttaatggaaatattttaatcaattaaaattttaaaacgattaattctttaagataattcacaatttgcctcagcccaaatgggtgcacaaaaagtgggaagaatttggcaacaaaacgaccatcgaattaattatggaaatacgacaaaaaagttgccttccctatttcaatggaaatgaagaaattattcgtttaaatggcggtaaaataatacaaaaagctcaaaaaatgtgaaaaaattattaattgaaaataaa

SEQ ID NO: 60087 - DNA, 473 bp, Heterodera glycines
  Genomic contig location: Contig_ID=SeqID_29616; Location=476..948; Strand=+
  SCN-specific regions: Sequence locations=1-150,223-260,282-397,420-473
atgtactatttggcaaagttttacattttggttcttgcctggttttgtttgccgtggccaacatttgacaaggccaagcagacagctacaatgaacaaaaaggtcattctcacaacaaatcgaagacagatggtatataaaaaagcaatgattaaaaactaatttattttaccaaaaatttatctaacaataaattaaataaataaatttattcaattaaaacaggaaaaattcgtgagttttttgtataatccaaaagcaatgaaataattttttaaggtcacgttagtaaattaggcggctttttaagaacacaaaatttaaattggccccgcaggaaatggagtaaaaaaaaacttttttttagaaatgttaaattagccatagaccaaaaaagtataattattttattttacattggcaacaaaatgcacagccggagcattattagaataatcactcgccacacatta

SEQ ID NO: 60088 - DNA, 884 bp, Heterodera glycines
  Genomic contig location: Contig_ID=SeqID_29617; Location=46..929; Strand=-
  SCN-specific regions: Sequence locations=1-246,268-385,407-504,539 -637,659-884
atggtggctaaaagccgtggcagggcaagttggaagttccgccgctacgtgcacagccaacacggtcaacagggctgtcttcaaagggatgctttgcaacttatgcaacaaattggcgcacggcctggacttaatgcgtatgatgctgaaattgttgtgccccgagtggtggatcattggaacaacagccagcaacgacatcgtttttctgtgtttatttttggatcaactggtcagtacaagccgctgtacaaatacatcaacaactattacgacacacgaatctcactctacctaaacaacgcccattttgatggtgtgcagaaggagtatggcttatttggacaacactactgcctagaatgtgagaagccataccagcgaccatcaagacatccaaattcttgtaaagcttgagatccaatttttgtgcagagtcaaaacaatgcaaagagtgcggagttatttggaatgttcgtgacaacaaccgtaatggaagaaaagtaaaataatttaaaaattttttaaaaaaataattcttttagggtcaccaatgccacgagacgtattgccaattgtgcaacacttaccacaatcccgagcggggctgtttcatccaaccaattgagccgaaggaacaagacccttacagcattgtggcctttgacttggagactatgcaacaccaagcgttggacccccaacaacctgaaaagaaggaacatcagccaaacttcattgctgccccgggttgcatgccccgactgcattcaaaacggcaaatggaagagggcaactgcaggatgtcaaatatgtgggccacgtcgggaccgttgtgttctgtcaacaccgattcatggacacacaagtggacaagcaagtga

SEQ ID NO: 60089 - DNA, 80 bp, Heterodera glycines; identical to SEQ ID NO: 51817
  Genomic contig location: Contig_ID=SeqID_29620; Location=236..315; Strand=-
  SCN-specific regions: Sequence locations=69-80

SEQ ID NO: 60090 - DNA, 80 bp, Heterodera glycines; identical to SEQ ID NO: 51817
  Genomic contig location: Contig_ID=SeqID_29620; Location=852..931; Strand=-
  SCN-specific regions: Sequence locations=69-80

SEQ ID NO: 60091 - DNA, 920 bp, Heterodera glycines
  Genomic contig location: Contig_ID=SeqID_29621; Location=240..1159; Strand=-
  SCN-specific regions: Sequence locations=1-20,42-275,297-552,574 -807,829-920
atgccaaacaaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaatgtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 60092 - DNA, 1491 bp, Heterodera glycines
  Genomic contig location: Contig_ID=SeqID_733; Location=820..2310; Strand=+
  SCN-specific regions: Sequence locations=1-389,411-931,953-1017,1039 -1155,1179-1491
atgagcgggccaatccgctcaaaaatcgggccttgtgccgcccgtaccaaggcctacattgaggcggccacggtcaatctcggaaaggacacgacagacgagagcattcaagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatgggcggacaaagcccgaggtgcagtggacacgatcgatggagtgatcggtccagaggatgacgacgaaataactgggagcattatctctcagcccgccaatcctccacaaattcaacatgttcagcctcacccacctcgccatgaggtgaatctccctcccatttctctccccaaatttgcgggagagccaagggagtggccgatgttttggaggctcttccgttcctcagtggacaaccttccaatcgacgacttcaagaagcacatctatttgttggggtgccttccccacaactcgccagctaggcgggcagtcgacttgtacccaccctcggacgaaaattatccaagggttgtcgacatcttgaagaagcgatttggtgatagtaaaactatcactgagtccttgcaggcagagctactgcacctccccaagccgggagagtcagtgctctcgctccgcaactttgcagagtccgtggaacgaatctgtttccaactaatggacttcggcgaatctgaggacaacatgttcatggcttcgacgatcaagtcgaagcttcctttctccatcctcacccatgtggtggagaaagagctttcctcaggaaagacattttcgtgccttgacatcagaaaggcacttcaaacaatagtggaagtaaaggaggaagtgcagagatgtgcacatgtcctccgaggcgatgaacgaccacgttcatccgccttcaattccccacctcaacagaggggtgcctgggatcaaaggggtgaccaccgtcactccaacaaccgacggagccaaccaccaaggccatttaatcgcggaggaacgcctcagccagaatatagggcgttctccgctattaacaaaaatccggaaagggccaaaaccccagcaagaaaatggggtcggtcctgctcgctctgctcgggaactgatcatctcccgagcgagtgcccggcattcccaacaccgggagctcgtcgaaaacggctgaaagaacagcagcgctgcctcaactgccttgtgcaaggtcacaacactgaggagtgcacctcaccataccgttgccgaaactgtggcaacaaacaccacttcctcatatgcttcaagagggaggagtcccattcacggtcaaatgggaatcgttccgcttcctcccccaagtcgggaagagagccaggagggcgaaagttccatcagcggcag

SEQ ID NO: 60093 - DNA, 4588 bp, Heterodera glycines
  Genomic contig location: Contig_ID=SeqID_734; Location=1901..6488; Strand=+
  SCN-specific regions: Sequence locations=1-287,309-1464,1486 -2306,2329-2610,2632-3009,3031-3866,3889-4120,4143-4588
atgagcgggccaatccgttccaaaatcgggccttgtgccgcccgtaccaaggcctacattgaggcggccacggtcaatctcggaaaggacacgacagacgtgagcattcagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatgggcggacaaagcccgaggtgaagtggacacgatcgatggagtgatcggtccagaggatgacgacgaaataactgggagcattatctctcagcccgccaatcctccacaaattcaacatgttcagcctcccccacctcgccatgaggtgtacctacctcccatctctctcccagaattcacgggagagccaagggagtggccaatgttttggaggctcttccgttcctcagtggacaaccttccaatcgacgagttcaagaagcacatctatttgttggggtgccttccccacaactcgccagctaggcgcgcagtcgacttgtacccaccctcggacgaaaattatccgagggttgtcgacatcttgaagaagcgatttggtgatagtaaaactatcactgagtctttgcaggcagagctactgcacctccccaagccgggagagtcagtgctctcgctccgcaacttcgcggagtccgtggaacgaatctgtttccaactaaaatggacttcggcgaatctgaggaaaacatgttcatggcttcgacgatcaagtcgaagcttccgttctccatcctcacacacgtggtggagaaagagctttcctcgggaaggacattttcttgccttgacatcagaaaggcactccaagcaattgtgaggtaaaggaggaagtgcaaagatgtgcacatgtcctccgaggcgatgaacgaccccgttcatccgccttcaattccccacctcaacagagaggtgcatgggatcaaaggggtgacaatcgtcactccaacaatcgtcagagccaaccatcaaggccgtttaatcgtggaggaacgcctcagccagaatatagagcgttctccgcgatcaacaaaaacccggacagggccaaaaccccagcacgaaaatggggtcggtcctgctcgctctgctcgggaactgatcatcttccgagcgagtgcccggatttcccatcaccgggagcccgccgaaaacggctgacagagcagcagcgctgccacaattgccttatgcaaggccaccgaactgatgagtgcacctcaccacaacgttgccgaaattgtggcaacaaacaccacttcctcatatgcttcaagagggaggaatcccattcacggtcaaatgggaatcgttctggcccttcccccaagtcgggaagaaggccaggagggcaaaggttccctcaacggcaggtggaaagccaaaaccacctgatcacggctggatttcaaccaaacgatcagtcaacccctccgacaacagaggggcagatcgttcaatccatagggatgtccaccgtggataccagcaaagggagagccaacaaggctcccaagtgcaaaaaaccgcacgcgtatctgatgacgcgacggttgttggccaagtcaaatcgtgacagccgaaatataatcaaagtagcagttctctttgacccgggaagccaaacaacgtacggagcggatccgcttatcgagaagctccgcccgcacaaactcacctccgaagaaatggaggttcacgggtttggaggaaaacgggagccgttacgcttccattcacccatttactcggtccttctccaaagggaggacggaaaatgggaggaaattctcctcaatcggacggagaaaatctccactcacttcagcatggtcgaatggaccgctgatgaatccgtcacgaatcatcacgaggtctgtgaagcaatgtgcttcaccaatgaggagccaatgatactcctcagcgcaagacacttctggcaattcttccaagggaagagagaagtgtctcccgggctgtttgtgatcaacacatcgtttggcccgctgataaatggcgagtccaacattggaccgccgaactcaaatcaaaaagctctgtcaatgacggccatccaccgcacaaatgtggaacaaatgccaaccatcaacgaggttgagcatttcttcaacctcgaatccctggggatccaggatgatcctgcccaggatgacgaccaaacagctctgaagctgtttaacgaatccatccgtcaggaagctgacggaagatactccgtcaaatggccgtggaaggagtccaatccggacctctcttccaatttcaaaatcgcccacagcaggctgtcatcggtgctaaccaagctccgacattctccagaaattctggagaagtacgatgccaccatccgcgatcaactgcaacagggcatcatcgagaaggcccaaagggctcctggacagcttgagcacttcctcccgcaccatggagtgctcaccaaaaagctacgcgtcgtttatgacgcgagtgctcacacacgcggaacaccaagcctcaacagctgcctcttccgaggcccagtgcttctgccagatttggcaggcatgcttcttcggttccgttgcccgacctttccgcttctcgcggacattcaagccgcatttctccaaatttcattggagccggaagaccgggaggtcacgaagttcctctggctaaaggacacttcaaagggactgactcccgacaacttggcaatatttcgattttgccgagttgcgttcggggtcgtcagctcgccattcattttggcggcgacactccgccatcacttgcaacagttcgactccccactgtccagggagatttcggagtccatttatgtggacaatgtactcctcgagtgcgagacggtacaggaagccttggaaaaatacaaattttccaaggacatcctccaacaaggatgcttcaacctgagggaattcatctctaactcaaatgaggtgatgaaacaaatccctcaggaggatcagcttgataagccgaaggccaaagtccttggccttccttgggacaccgagaaagacgaaattgtcttcaaattcccaacaactgatccattgaggccagtcacacgaagactggtcctcagccatctagcatcgctcttcgaccctttgggggtccttgggccatgcattttgccagccaaacgactcttccaagaactttggaaggagggccactcttgggatgatgccctctcagaagaggactcaatccgctggaattctatacaaagccaatggaaagacgaggaaatcagaattcctcgccgcgcaatgctcaatgacacacagtcaattgagctccatgcatttgtggacgcatcggtccacacattcgcgaccgcgatatacgtacgctgcgccatgaacgaaaagattcaagcgtggctgattttctccaaaaatcgtttgaagccaaagagtgcctcaaaggcactcacgatacccaggatggagcttttggccatcctggtgggcaccagagcactcaaatttgctcaaaggcaattgcgtcgtccaattgccagccttcatctttggagcgattcacaaatcgctctgtcatgggtcaaaacccatgaaactcaaccacaatttgttgagcgaaggctgaaagaaatccgagaatgtctcggatgtacctttcatttcgtccgtactggggacaacccagcggacctcgcaacacgcggaggaactccttcggagctccgcaaccatcatctctggtggaaagggccaccttggctcgcacaagcgagtcaccattggcccagcgaactctgttttcaagtaacagagtcggatcaacagccatactcaacggagaatgttggtccgagtggtgcgtttctcgcacacactcactcgaaccagccaaatgagcaggtcttaattgacccctcacgcttcagctcatggaaacgccttatgcgaacaacaatgttcgtattaagattcctcgccttaatgtttaaaaggggcgaggaaacggttgctttactcgcgaagcacagaaaggaaattcgccagatttcaaagtctggggacttcaaggcggaagacttcgcactcgcggagcgagttctcatccgcctagaccagatggatgacgctgaagaattccagcactttaaaacagtgattggagacgacggaattctccgtctgaaaaccagactggagatgagtgagaagccatacagcttctctcatcccattcttctcgccaaacattccactttggcaaagctgatcattttggatcggcaccaaaaaaggcatcaccttggagtggacaccactctgacagaattcttgagtgaattctggatgccaagtgcccgtttaaatgttaaacggactcttcgggactgtctccattgtcgccgaatgaatgcacaacagtttgcattaccaaccatgccacccttgccgg

SEQ ID NO: 60094 - DNA, 4116 bp, Heterodera glycines
  Genomic contig location: Contig_ID=SeqID_734; Location=944..5059; Strand=-
  SCN-specific regions: Sequence locations=1-129,151-528,550-831,854 -1674,1696-2851,2873-4048,4088-4116
ggtgtcccaaggaaggccaaggactttggccttcggcttatcaagctgatcctcctgagggatttgtttcatcacctcatttgagttagagatgaattccctcaggttgaagcatccttgttggaggatgtccttggaaaatttgtatttttccaaggcttcctgtaccgtctcgcactcgaggagtacattgtccacataaatggactccgaaatctccctggacagtggggagtcgaactgttgcaagtgatggcggagtgtcgccgccaaaatgaatggcgagctgacgaccccgaacgcaactcggcaaaatcgaaatattgccaagttgtcgggagtcagtccctttgaagtgtcctttagccagaggaacttcgtgacctcccggtcttccggctccaatgaaatttggagaaatgcggcttgaatgtccgcgagaagcggaaaggtcgggcaacggaaccgaagaagcatgcctgccaaatctggcagaagcactgggcctcggaagaggcagctgttgaggcttggtgttccgcgtgtgtgagcactcgcgtcataaacgacgcgtagctttttggtgagcactccatggtgcgggaggaagtgctcaagctgtccaggagccctttgggccttctcgatgatgccctgttgcagttgatcgcggatggtggcatcgtacttctccagaatttctggagaatgtcggagcttggttagcaccgatgacagcctgctgtgggcgattttgaaattggaagagaggtccggattggactccttccacggccatttgacggagtatcttccgtcagcttcctgacggatggattcgttaaacagcttcagagctgtttggtcgtcatcctgggcaggatcatcctggatccccagggattcgaggttgaagaaatgctcaacctcgttgatggttggcatttgttccacatttgtgcggtggatggccgtcattgacagagctttttgatttgagttcggcggtccaatgttggactcgccatttatcagcgggccaaacgatgtgttgatcacaaacagcccgggagacacttctctcttcccttggaagaattgccagaagtgtcttgcgctgaggagtatcattggctcctcattggtgaagcacattgcttcacagacctcgtgatgattcgtgacggattcatcagcggtccattcgaccatgctgaagtgagtggagattttctccgtccgattgaggagaatttcctcccattttccgtcctccctttggagaaggaccgagtaaatgggtgaatggaagcgtaacggctcccgttttcctccaaacccgtgaacctccatttcttcggaggtgagtttgtgcgggcggagcttctcgataagcggatccgctccgtacgttgtttggcttcccgggtcaaagagaactgctactttgattatatttcggctgtcacgatttgacttggccaacaaccgtcgcgtcatcagatacgcgtgcggttttttgcacttgggagccttgttggctctccctttgctggtatccacggtggacatccctatggattgaacgatctgcccctctgttgtcggaggggttgactgatcgtttggttgaaatccagccgtgatcaggtggttttggctttccacctgccgttgagggaacctttgccctcctggccttcttcccgacttgggggaagggccagaacgattcccatttgaccgtgaatgggattcctccctcttgaagcatatgaggaagtggtgtttgttgccacaatttcggcaacgttgtggtgaggtgcactcatcagttcggtggccttgcataaggcaattgtggcagcgctgctgctctgtcagccgttttcggcgggctcccggtgatgggaaatccgggcactcgctcggaagatgatcagttcccgagcagagcgagcaggaccgaccccattttcgtgctggggttttggccctgtccgggtttttgttgatcgcggagaacgctctatattctggctgaggcgttcctccacgattaaacggccttgatggttggctctgacgattgttggagtgacgattgtcacccctttgatcccatgcacctctctgttgaggtggggaattgaaggcggatgaacggggtcgttcatcgcctcggaggacatgtgcacatctttgcacttcctcctttacctcacaattgcttggagtgcctttctgatgtcaaggcaagaaaatgtccttcccgaggaaagctctttctccaccacgtgtgtgaggatggagaacggaagcttcgacttgatcgtcgaagccatgaacatgttttcctcagattcgccgaagtccattttagttggaaacagattcgttccacggactccgcgaagttgcggagcgagagcactgactctcccggcttggggaggtgcagtagctctgcctgcaaagactcagtgatagttttactatcaccaaatcgcttcttcaagatgtcgacaaccctcggataattttcgtccgagggtgggtacaagtcgactgcgcgcctagctggcgagttgtggggaaggcaccccaacaaatagatgtgcttcttgaactcgtcgattggaaggttgtccactgaggaacggaagagcctccaaaacattggccactcccttggctctcccgtgaattctgggagagagatgggaggtaggtacacctcatggcgaggtgggggaggctgaacatgttgaatttgtggaggattggcgggctgagagataatgctcccagttatttcgtcgtcatcctctggaccgatcactccatcgatcgtgtccacttcacctcgggctttgtccgcccattccatgaagtgctttcccgatggcttaaagtcatcgtagcgttgctcctcttgttggcggtcggctccattgaatttgagcaggagggattgccatttgtcattgcaatcctccaaaagccgaatcgctcggcggagtccacggcgctccgctgtgaggtctgctgaatgctcacgtctgtcgtgtcctttccgagattgaccgtggccgcctcaatgtaggccttggtacgggcggcacaaggcccgattttggaacggattggcccgctcattttgattctcctgctttgggagttttcggctgctggtggccggagtcctttaacccttgttggtgaagactcgaagattcggctgctggtggccggttgtgtctccctttgttgggtgagacttgggtcggcggtgatggccgaatgtgtcttgcctcttgttgggcaagacgaagaagtcggcgactggaggccgaatgtgccaaccctttgatgggttcggctaaatgagtcggctgctgatggccgaatgagtcttgccactggttgggcaagacgaagaagtcggcgactggtggccgaatgtgcctaccctttgatgggttaggcgaatgagcggcggcgatggccgagtgtcttgccactggttgggcaagacgaagagtcggctgctgatggccgagtgccttgccactggttgggcaagacgaagagtcggctgctgatggccgagtgagccttcctccctttcggtagggagaaagtaaatcggcgactgtagccgatgttcttcaccccttggcgggcgaagactttttgatcggcggctacggccgattgatggaggtcaggtcctttcggcaaggaacaactgacccctacggggctccaattttgtcgcagccaaggaggcgacaaaaacttttgtggggagcgagggaggcgagagccgactttgccaagggcaaaatcagctgtttgcttccccctttccctttctcggccgtgccttcccaaatgtgggggaagggacggacgagccggtggaagcgaaggcccgcaggagtgagagactcctgcggggaagaccgacgctgggcggacgacgacgcagacgctgagcagcagaagggggcgggggaaaccgtcccgaccaaatcccccggactctcttcacaaatatatatttattaagcagaaggagaaaatgaatgaatggaaatgtggaagtgagca

SEQ ID NO: 60095 - DNA, 1968 bp, Heterodera glycines
  Genomic contig location: Contig_ID=SeqID_735; Location=547..2514; Strand=+
  SCN-specific regions: Sequence locations=1-627,650-784,807-1320,1353 -1574,1596-1616,1638-1943,1965-1968
atgccgattccgttccgagaacggccaccttttttctcggcaccaacaatcagccgacccacaaacgaagtggtcattaatgaccgcctcgtcatcgacatcatcggccaatacgaagccgagaacggacagagagcaaacaatgctcctcaacccggggctgacaatgctcctccgcccggggccgaagaccaaagaggcccctggtggttcgaccaggattgggggccccagctcccaatggtccctgaaaacaatggccaaaatcgccaaatggacgatcagcgagacgattggggagcccatgctcctccccgacgggaaccatcgccccgtgaacacacggagcgcctgaactcatgggttgagcgacaccacggccaacaatggtatgagacggctaccattcgccgtgaagcggaggaacacctccgccgagaactgcgcaccggtgccacgctttttgcggcacacctcggtccattcgctaatgtccgtttcgacgggttttcgcgctttggaccggctaacacgcaaatgtttccgggacggactgtccgggaacatttccgacggcgcgggttccaggtggacccgaatttgccatgcctccaagagtatggaggcttcagcaatagccaacaaggaatccatgtcgattactttccaatcgacatggtcaatgtccgattccaaatcggagcttatcaaagggaagctgagccccctcgtcttccccgaataagagcatatttggcattggaagaggctcccaatgaccaagaggggcccaacaggggacccccgtctcgacggttcttcgaggccattggcctccgaagaggcaatccgaatgttggcgaaatggcggaaaacaatggccgccaagcgcctctccaacgcggagagcgagccatggactatggccgccccaattaaccggacggcagctttgagaatcgcccacgaagggcggtccccaaccgtccaatgcgccgttggcagaacggccttttcattgtggccgtggctttgtgcctcggcaatttggcggagggaaaggaattcccttcgccaaggacttgccatcagccgcttgaagcggcggacatggcacgtgaaaatcaagggggattttcacgaatacttttcccatggccattttcccacgatcagaaagcaaatctgatccgatgactccgccccttcaatggcagcggaacctatataagggcagggataaggtatatcccaccatcacttgcccttcccaaaatgccgaaacccatcaaaatgccctcctcgtcatcgtccgcctattcatcatcatcatcatcatcatcatcatcatcgccggatcgccagtcgccgccaccgccccgcaaaaaggcggtggaactgttcaacagtctcgactcgagaaaaatctcgggtttttttggtctcggtctcgagtctcggtctcgggttttcaagtctcggtctcgattttcgagactcgagaccgagacttttttacacccctaatgattgttggcctttggtaaacttctattttataaattttaggttcttttttgttcaaatttgttaatatatgtgtggtccagcgggttgtgttcttggttttgttccttatttttgcgttggatcagttcccctccaagttttattttttcttctcatttttcaaaattaatgtttttttcgatgggagttcaaacacaattttaacaattaaaatcgtaaaaatgtcatttttggactaaatctattgtcgctgacagcagcgacagatcttatcgatcgccagctgtttttgtttttcccacgctttttgctagtgatattccaattaagttttttcctctgtgccccgcccctcacattttcggcctataaaaagggcacccttttcattaaatgctcacttccacatttccattcattcatttctgctgctgctta

SEQ ID NO: 60096 - DNA, 87 bp, Heterodera glycines
  Genomic contig location: Contig_ID=SeqID_735; Location=2424..2510; Strand=-
  SCN-specific regions: Sequence locations=22-87
cagcagcagaaatgaatgaatggaaatgtggaagtgagcatttaatgaaaagggtgccctttttataggccgaaaatgtgaggggcg

SEQ ID NO: 60097 - DNA, 1149 bp, Heterodera glycines
  Genomic contig location: Contig_ID=SeqID_737; Location=28..1176; Strand=+
  SCN-specific regions: Sequence locations=1-350,372-468,500-625,650 -954,976-1149
atgttaagctttcgaatgttaccaacaatgttggattggttgacaaggaaaaaagttatagtcgaaaaaaggtgatttgcaacacaaaaatcactgccgcaatcgcttatgctttctttgtggcgtatgcctttttcttgcaaacaatttgctacagacatttcatttgccgtgtttgggaaaagagaaacaaaatttagggcatttgtatttaaggggaagaaaaatgcgaaaagaatcgatcccgtcctttcggtcgataatttatgcaaatggggaagggcgggaaaattcatgcaatatcgaatttacgaatgattgatcaccaaagaacataaatgactaattcatttaaaatgctaattatttaatcattcggcttatttggtaatttaagttgttggaatttgaattaatcaatttcaattctttttaaacatgtgtttttatgatcgataaacttcaacctatttaattgaaaaataaataaatattaaatcagccagcaggataaatgagaaattaatatccccagattttggggtttaagccatttaaaattatcgcttttagaggaggattataattaggatgcgatttataaaaaggtataaagcgtatccctaattataataaaggaaatcaatgacaaaacgaatctgcatcaaaaaccgggaataaatttgggttaacaacaatttcatctcagaacatttttgatgaatcaatgcaattattatattcatttggaaaaagattgccatagacaaagaaggggaggcaatttttggagaaaagggataatgacagcacaaaacacaaatggaagaagagggaaatgaatggctgggaaaaagaatattcggcaagagaacatttggggatggagcgaatgattaattagagcaaatgaatttgacgaaacggaagaaattagggaaaaatttaacattatgcataaaattatgaaaatttgaatgctgcggacggacacagcaaaaatgatgaaattaatgtgcaattatcaaattggtcaatttgggtccacaaacgctgtaagaaagcagggggacacaaaagaggtacaacaaaaagcagatgggcatgtaccaaaattgagcaaatttttaaaattttgcattttagtca

SEQ ID NO: 60098 - DNA, 1972 bp, Heterodera glycines
  Genomic contig location: Contig_ID=SeqID_6036; Location=519..2490; Strand=+
  SCN-specific regions: Sequence locations=1-743,765-959,981-1522,1545 -1972
atggcacttctttcgccacgtttcaatgcgttggtggacaaacatttcgatggcaaaagcgaattgacaatttggagaacgatcgtaattcgtcgcaaggacaaaggaccagaaccgaaactgactgtatggttcgattacaaatttgtgccatttccattgcccgacgaccgtccgctgcccagcaaaatccgttttaaatgccttcggattaagtaattcaaaatcagatagctatgacaataaaagctttccttccattttcacagttacattgatcactccgtcatcgcttttcttcgttcaaatcaccaaatttttgagaaaagaggcaccaatttatatttgtcgattccatcatcacactctacgaatggccagcggatttgggatgtttttgttcgtgaaatttggccaattttttcgacaaacattcaccgtttgcgcattaccggtcgtgatcatttggacaatttgcttcgtcgcacttcgccaacaattctcaccgatctcaaccaattggcttcaatcgattcctatgatttgttgcccgctgcgattggtgatgattttgatgtgccaaattcaacaatttctgctggccaagcattgtccaaatggttgcacacgccgagaaaagatggacaacccaaacgattgcattgcaaagacattcaagaacaaacgaacttcgattggatcaacaatttcaaggaggtgtggtccggggggggggggggggagcttcaagttttttattttctgaaatcggaattccgaccccataaacgtcgtaagtcggaaatttttgaaaatttccgaattttatcaaaatttcggaaatccgaattctgtgccatccctgctggtttggctccacatttttggcaaatgactgattgttgttttccaatcaaattgtttagcattttctccgtgccaatgccatttcttccgtctgttaccaaattcatttttctgttcatgtgccgtcaatgcaagtgccatttgaattgcttaacgaatggacaaaggaaaagctgacattgaccaaagcaaatgaattggacaacagttggataatgaagcgttgtaaaattattggggagtccgcggcggttcagcagcagaagaaagatgataattgggacaacaattgtaacaatgtgttcttttggcttgttgctggcactaattgcattgggtgagcaattaaaaaaagcatttgatttttatccgaatttgaattgcgcttaatttttgccattgccgccaccggaagaagtggaagaagaagcgggacaaagcatcacaaaagggacgtcttctgctgacaatgagtgacggataaaagaacaaaatcaatgagcagacgcagaagaaatgaatattaattgaaaatgaccgagcataattcatcagtgatcaaatgtattttatgaagaaaatcctctcaatttcggtaaataaatcggacgcataaaaatggcaaaaaagtcactcttattgaattttcgttgcacttttttcaaaacattttttgatgagttaaggactggcggtgtcaaaacgccagttttaccaagaatgtttttaatttggtcgaccttaacaaaagttatgacatttttttgtcgaaaaacagtacgagttggagcagtacgagttggagcagtacgagttggagcagtacgagttggagcagtacgagttggagcagtacgagttggagcagtacgagttggagcagtacgagttggagcagtacgcgttggagcagtacgagttggagcagtacgagttggagcagtacgcgttggagcagtacgagttggagcagtacgcgttggagcagtacgcgttggagcagtacgagttggagcagtacgagttgggtgtcgtccgtttcaggcatcccactgtccaggaaaaaaaatatggatttccatataattcccagcccaagtcataa

SEQ ID NO: 60099 - DNA, 395 bp, Heterodera glycines
  Genomic contig location: Contig_ID=SeqID_6036; Location=3456..3850; Strand=-
  SCN-specific regions: Sequence locations=1-395
atgaaccgacggtaaggcatttttgaaaagtcacaaattcttcatttatttcactaaactgttttcccatttcagttggatttgcaatgacgtttggatggacattttcccatcctttgaccatgcccaactcggcctcaaattggcacttctttcgccacgtttcaatgcgttggtggacaaacattttgatggcaaaagcgaattgacaatttggagaccaatcgaaattcgtcgcaaggacaaaggaccagaaacgaaactatctgtgcggatggatgacaaatctaacaaatttgtggaatttccattgcccgaccgtccgctgcccagcaaaattcgctttaagagccttgagatttagtaattaaaaatcaaagctttatggcaataaa

SEQ ID NO: 60100 - DNA, 779 bp, Heterodera glycines
  Genomic contig location: Contig_ID=SeqID_6037; Location=52..830; Strand=-
  SCN-specific regions: Sequence locations=1-169,192-779
ttggatttgcaacgacgtttggatggacattttgccttgttttgaccgtcctcaactcggcctcaaattggcacttctttcgccacgtttcgatgcgttggtggacaaacatttcgatggcaaaagcgaattgacaatttggagaccaatcgaaattcgtcgcaaggacaaaggaccagaaacgaagctgtttgtatggttcgattacaaatttgtgccatttccattgcccgaccgtctgttgcccagcaaaatccgttttaagcgccttcggattgagtaattaaaaatcaaagctttatgacaataaaagcattcatcccattttcaggtacatcgatcactccgtcatcgcttttcttcgttcaaatcaccaaatttttgacaaaagaggcatcgatttacatttgtgtattccttattcaaacaccacggatggccaccggatttgggacatttttggtcgtgaaatttggccaattttttcgacaaacattcgctgtttgcgctttaccggtggtgatcatttggacaatttgcttcgtcgcacttcgccgacaattctcaccgatcttgatcagttgacttcaatccattccggtgctttgttgcccgctgcgattggtgattgttttaatgtgccaaatgaaacaatttctgctggccaagcattgtccaaatggttgcacacaccgagaaaagatggccaacccaagcgattgcattgcaaagacattaaagaacaaacgaacttcgattggatcaacaatttcaaggag

SEQ ID NO: 60101 - DNA, 304 bp, Heterodera glycines; identical to SEQ ID NO: 51570
  Genomic contig location: Contig_ID=SeqID_29622; Location=858..1161; Strand=+
  SCN-specific regions: Sequence locations=1-304

SEQ ID NO: 60102 - DNA, 304 bp, Heterodera glycines; identical to SEQ ID NO: 56071
  Genomic contig location: Contig_ID=SeqID_29622; Location=1238..1541; Strand=+
  SCN-specific regions: Sequence locations=1-304

SEQ ID NO: 60103 - DNA, 676 bp, Heterodera glycines
  Genomic contig location: Contig_ID=SeqID_29623; Location=37..712; Strand=+
  SCN-specific regions: Sequence locations=1-676
atgtgcttctcatcagaatttgaagacacacgcactaagagcagatttatgttcgagcaaccttgtcattgccctaccaaccaactcgaggccatcaaattcagcaaggtgtggaaaatttcaaaattcttttaaatccacgcaatttgtaaaaccctttcaactctacatttgttaaggtgataggcgcggaagacaacagtctgtgctgtgtttgtgcaggtccagtaaatacaccatataagaaattgtttttacataccatttttgttacagaggaatacggtcacaggtcgttggaagtgctgtacaaatgttcgacgtgttacaaagaaacgcacagaacttatgagtgcttcagtacgtcaaatttttaccacatcccctcaattacataaattgtccgggtttcagttgacgtcgattattacagcagccgtcgttacgactgctcggaccgtgattacgatactcgcatccgctctcgctaccgtactcgaacgtacagtgcgtggggacagtacacggcaaatgtcgcaaaaatggcactgctggggcggatgaccatgaacaattttgaggcggtggagcgcaaattcgatgtgatgagcattgttcaggacaattattacaagacaaccgatgattggaccgacactttgataaggcgtcttga

SEQ ID NO: 60104 - DNA, 758 bp, Heterodera glycines
  Genomic contig location: Contig_ID=SeqID_29624; Location=219..976; Strand=-
  SCN-specific regions: Sequence locations=1-77,102-146,169-334,356 -558,581-650,673-758
atgattggctttataaaagaaaggcgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaactccggagccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgttaataaa

SEQ ID NO: 60105 - DNA, 1103 bp, Heterodera glycines
  Genomic contig location: Contig_ID=SeqID_29626; Location=1..1103; Strand=+
  SCN-specific regions: Sequence locations=1-433,455-1103
ggtcagttttgcatatttattactaatcttccatttttattccgtttcccctttttttggtcaaataggactgatgatgtcatcacttttttttcaaaaaaataaaatttttcctaaatgtgatttgtttcccccctttttcccctccctttttcaactttcttctgtccctttccgatggtccttcttcgcgtcgtccctatttgttttcgttgcttcaaaacccttctcccattccctgccctttgccttcgcaatttccgcccggccaaattcaccgtgaagaaaatatggccattcgctacagacttttcaaccgattggaccccggcggttcgcatttggtcagtgcccctgaaaatgccccctttaaatcgcattttgtgcctttccatcttttcagagaatgccttcccatgtgattcccgccatatttttctccattttgccctttgacgacttcaaagacgtggagggcaagcagagcagtttagtcacaatgtaaaaacaatggcacaattaaaatttaattgttttaccaatatttgtgcccctttttcagattttccatttggaacacaatgatgggcacaaggtaagcaattgcattcgcttgtcctccgccgtccgttttgtaatttccgtttcttcgcttttcgtctcctcaccattccctgggccattcaccagtccggctttctcctgggcctctttctgatgcttctgatggccgccctcgccttttacaccgcttttcgcgtggtcgaaagtccgaattcgttgggtgaccgccgcttttccttcctttcaccccaatttctctcttttttagccctcgacagaacgggcgccgacttttcggacgtttgccgtttcttttgggggagacgtggcgaatatttctccgtttttttctccattttggtcctcgtcggcggcgtcattctttacttcgtgttgatgtccaactttctgttttacaccggaaacattgtcaacggttgtcccatttcacttccaattcatttgactaattgaagaggcattgcagccgaactcgtcgatcattccgattatggtcaacggcactctcagctgcgacg

SEQ ID NO: 60106 - DNA, 49 bp, Heterodera glycines
  Genomic contig location: Contig_ID=SeqID_29627; Location=429..477; Strand=+
  SCN-specific regions: Sequence locations=1-49
attgaaagccatccattgcctgccggttctcggcacagcaaagcactaa

SEQ ID NO: 60107 - DNA, 997 bp, Heterodera glycines; identical to SEQ ID NO: 29629
  misc_feature (25)..(25): n is a, c, g, or t
  misc_feature (51)..(51): n is a, c, g, or t
  Genomic contig location: Contig_ID=SeqID_29629; Location=1..997; Strand=+
  SCN-specific regions: Sequence locations=1-26,48-791,815-868,891 -898,925-997

SEQ ID NO: 60108 - DNA, 940 bp, Heterodera glycines
  Genomic contig location: Contig_ID=SeqID_29630; Location=1..940; Strand=-
  SCN-specific regions: Sequence locations=1-12,51-81,130-433,460 -785,849-940
ttcttttatcctttttcttctattttcttttcttttctcttcacttctttatcccattttgtttctcaattctcatcgaacaaatttaattttattaaaatcaaataaaaaaatgatttttctttttttgtgttcagaagagcattagccaaatcgcccgtggtgaagcgagccgccgccattcaggagcaggagcagaagcgggtcagcaagcacaggacgagcagatattggctggatgaacaggtgggacggattttggatgtttaatttaaataatgcaatttgattaaaaagaaatataacaacttttttttaatcaaaaatacagttataatcaattaaataagcaaagtttttcgccaattttgttaattattccttaatcattaacaattgggaattattatgctccttcgcttttattctacattaattaacaaatatattttttgttaattgtttacacaataattaattgttttggccctttccctaattggccaattagcgccctgccatttcggcccagtttagttgagtccctctgagcacatttggctgccctcctccgcttcatccgcttcttcgtccgccgtggacaccgaatgttatttgggcgagaaggactgccagaagatgggagagaagcgccgctgcagcggctgtcacattgtggcacacacggcatgcttcccactgctggccaaggcaaacaatccgccaattaagcatttaaacgagcaaattaactaatgatcatttatcttatggattataaaacgatttttaatcttaataaaaatttaatattaaaaagcagtaaaaagttaataaaattaaaaattgatttgcaaaaattgcagatgaatttgagctgcaaaatgacttttcgcgactgagcacaaagtgccaatgccaaaagtccgtcgtcaatggc

SEQ ID NO: 60109 - DNA, 63 bp, Heterodera glycines
  Genomic contig location: Contig_ID=SeqID_29631; Location=492..554; Strand=+
  SCN-specific regions: Sequence locations=1-63
atgagaaaaaagatgtttgatagggccagacaagagaaggcaactgtttgtaccaagtttgcg

SEQ ID NO: 60110 - DNA, 2561 bp, Heterodera glycines
  Genomic contig location: Contig_ID=SeqID_6038; Location=1321..3881; Strand=-
  SCN-specific regions: Sequence locations=1-247,279-715,756-1082,1108 -1223,1269-1380,1404-1563,1591-1625,1647-1912,1953-2092,2119-2561
atggcaattgctttggcatcgtgccaaccgtcgccaattttgaatggtggtgccaatgtcattgttgtagttgctaacgaacagccaaaaatttgcaaaagcaataacaattgggcactttcctccacttcggcatccgcttcatcgtcggcacgtcgaaaaagctttaatccggtccgaatcaaagaggagcctatgcagacagaaaatgatggccaagaacatgtagctggagcagaaacaactgctgctgttgaacaacagcaacaaaaacaacattctcaaggtggggcagagaaataatcaaatttagattgattaatgaatttttaaaccattatcatttgtatgccgcttaatctgatcattcagccttaattagcgactgattagtcaatttatcttatctgctagatagttaatttatttccctaagctaatctgatccgtctaaatcgctgctgatcattgtagttttatgtgtttgttagtctttggcaatcagtattgtccgatcacttaactcagggataattcaattagcattttctctgattctgatcaatagcccgtaatcagatcaagagagacatcatattttgtcaattcagcgttcaacaagcgtcatgacgaaggcgaagaaggagcggatgatgaacaaatgggtccgatcaatcggcagcaaatgaacaacaaagtaagaaaatcatttttcaattttttaaactttttttttcattttaatatttttttaaggtgaatttgtttatggacaacaacaatatgacaatcctcagcagcacaacaccgctgaatgcgttcacacatttcccaccacagttgttcccgcttgaaggcatgaattaaatttaaagctctgagaagagtctcgagtattaattagtattaagcatatggaaaaattatgtctcgatttaatcttgagttagagtccagtttttggtcacaatgttggcgcataaaattgtatcaatctcgaaaaattcaccgtttaatttgacaacattcattagcaaatttagctgatgaggaggagtcatcagcagatggtcaacttcaaaaagatgatggtgatgaggatgatgcgtcagtgcgcgaaaaaaagctacagtacaataaccttggctattttgcgcgatttttgaaaactgagttggccggggcctgtgccggtgccgtggacaaagtgagcgtggcgacacaaataattttttttttttgttttttaatttcaatttatttttaatcgctcaggtggtcggtgacttttctacaacttcatcctcctcatccgcttccaacggttcgtcagtggacaataaccgtgaccatgttgacgaacagtacgcgcaacaatgccagcagcaacaacaccagaatgcggttcaacaacaacaatttcaagcagttcaggtaaagtcagttaataacaggaaaattgcaagcgccctaattagcgtaataaaatttttatgcccgggggaggaaaatagcggcctttaaaatcttccaaatttcgaattgtgaatttaaaaagagacgaaaataaaattaaattttaataattatctcatgggccaaagcgacccaaattgatccatttgatcaatttattttgaaatcatttttccttaaattcatgtgatgattcatcccgcccctcccttcccctgcgggtgctcctctataaaaggcgcaccgctcactcaattgggggtgaagaagaagcgacatctttttcctgattaatcaattttgcatttgtatgctttttcctgtccctttacatttaattgttaaaataaatttttaagtaaattgggttaatttcccgagaattaaggagagaatgaaatagcacccttcaaaatcttccatattccgaacagccaatttaaaattgaatacaaaaaattaaattttaataaatagacctcccctaaaatcacaaaattttttcaaaaaaaaaaattcaggtctaataaattgacaatcccccaaaaatagtatttttttctggccaattcaggcccgtttatggacagccgcgttggcattagccgccactagacagcaacaacagcagcagcagcagcaccaattactgcccgaccaacagcaaccgcaatttgtgccagccgcagctggcacatgccgaccacctgcatcacaaccacccttttcattggcatcgtcaatggtggtgccatcgtgcacaatgcgtgggggtggcggaatggcgcaattgccaaactcggttaataattaattaactttttgggattgtgatcggcttggttataaaaatagtttttgatcgccgataattagccgggaataactggattggccgggaatctcgagttggagtttcccccaaaacgggtccgaattttccaaaatttgccttatcaaaattttttctttagacttttccatggttttccgtgccaacaatgcaaacaatgaattcagcagctgttgcgacattattcgcgtaagaaaatattcaaaaaaaattttacacatattaaaataaa

SEQ ID NO: 60111 - DNA, 1363 bp, Heterodera glycines
  Genomic contig location: Contig_ID=SeqID_29632; Location=219..1581; Strand=+
  SCN-specific regions: Sequence locations=1-192,216-358,380-1150,1172 -1300,1323-1363
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcgttctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggcgcgcttctgatcagtttctgaaaaaaaagttaagcctaaggtgttgtcctgtttaaaaaggaattaaaaatttctttaaatgatatcatctccctttttgatagaaaaagcatcagaggacc

SEQ ID NO: 60112 - DNA, 147 bp, Heterodera glycines
  Genomic contig location: Contig_ID=SeqID_29633; Location=472..618; Strand=+
  SCN-specific regions: Sequence locations=1-110,139-147
attatgagccacccaatttggcaaatcggtctttttaaacgcattaaagaagattcagtcgattgcttggagtgtaagcaaaaaaacgttattaattttcatcttcatcattttttggtttaaaaatatatttgaatacttttttat

SEQ ID NO: 60113 - DNA, 983 bp, Heterodera glycines
  Genomic contig location: Contig_ID=SeqID_29633; Location=747..1729; Strand=-
  SCN-specific regions: Sequence locations=1-612,634-719,742-983
aaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtacccaaacggacacttgaaaaatcgatttttttgtttcataaatattttttttcagaaagtgctctaaagtgcacccaaatttttatttacaacttaatttttagcactctgatgctttagtatcaaaaaaggaagatggagaaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaatta

SEQ ID NO: 60114 - DNA, 51 bp, Heterodera glycines
  Genomic contig location: Contig_ID=SeqID_29634; Location=595..645; Strand=+
  SCN-specific regions: Sequence locations=1-51
tgtccgtttgggtactccaacaatatggggagcaaaatccaaccagaataa

SEQ ID NO: 60115 - DNA, 1646 bp, Heterodera glycines
  misc_feature (11)..(11): n is a, c, g, or t
  Genomic contig location: Contig_ID=SeqID_29636; Location=1..1646; Strand=-
  SCN-specific regions: Sequence locations=1-838,936-1009,1032 -1048,1081-1124,1168-1646
  Gene Ontology: Mol. function=transmembrane receptor activity; Cellular component=plasma membrane; Biological process=growth
aggtcggcacnttttgccaaaaccaataaaacatgccaaggtcaattactgtatggaccgttcgctgaatgactgtgatgtgatcgcattttgcgaggaattggccgacgggtacaattgcacatgtccgacttattccatcgatcaatcgccgatgccggaaaagccgggaagaaagtgcaaactgttgaagaacgaatgtttgaaccccgcggagaacaattgcagccgattcgcggattgtattgacaaggcggggaaggagaataatgaaaactataaacgagaataatgcttcagacggaaggctatgagtgtgtgtgccgtcctgggttccgcgatgagaacccggcaaatcctggcacttcatgcagacaatgtaaacagaaaccattttaattttctttttatctgtttaaactattgtcagtgatcaatgaatgcaaattctccgctatcaatgattgcagtccgcacgcgaattgcatcgatttgcccgatggatatgtaaaaaaaatattaaaagcctatctattttgggggggttttcagacctgcgtttgtaagcctccttatgtggacgaagggccaaaggaaaaaccaggccggatgtgctgtttcgacgaatgtgccaaccaaaaagacaacgactgcgacaaggaaaatgccatctgcgaggatttggaggagggattcacctgcaaatgtgtgccgcttttgcacacctttcaattgccataaaggtcagcgaagaaacacgccagtgctgtacagcagcaaccgtgctgagtcgaagcacgaaaaagtgcaaagtgatcactgatcaaattaaagcaagtaaaataattattaaaaaattaaaattaaaataattattttaaataataataatctacttacataattaattcgtttattttataatatttttaaatctcaataaaacggacattttttgttttctcatttttattaaaatattaaagttggcatgcacttttgttttctcattttttattaaaatatttaatgttggcaaatagataaatagtgcaacaaaaatatttttatagaaaattcatgggtagttataaacgtgaatgattctgagaagctcattttcgttatttattattttagaataatgaatattattattcatattttgattatcgcactatttgtctacgagttcccattaggctctaaatcagggtttgatgattttatacaaaaaaatggtgtgatggaacttgtgaaggaatacaaatcgaaaaaaactattaaaactattaatgatcttcactcaaaactgcaagaacaaggaacaaagataagtcttcggaccttaaaaacttatttatcaaaattaacaatagtgacaagaaacgaacatatagaagcatcgcctgatccaaatttaaaaacattaatgagccttcaagaaattttttgatgaatggaaaaaatcttgagttatttttgtgttaataagttgattcgtagaagctgttgattggccttcaacaaccaataaaataacataattatagctttctcaacttatgcatttgctttttgctccttatttatgcttcctattagaaatttatttattgctgtgagctttcttgtttggtgtgtct

SEQ ID NO: 60116 - DNA, 345 bp, Heterodera glycines
  Genomic contig location: Contig_ID=SeqID_29636; Location=1253..1597; Strand=+
  SCN-specific regions: Sequence locations=1-345
atggtttctgtttacattgtctgcatgaagtgccaggatttgccgggttctcatcgcggaacccaggacggcacacacactcatagccttccgtctgaagcattattctcgtttatagttttcattattctccttccccgccttgtcaatacaatccgcgaatcggctgcaattgttctccgcggggttcaaacattcgttcttcaacagtttgcactttcttcccggcttttccggcatcggcgattgatcgatggaataagtcggacatgtgcaattgtacccgtcggccaattcctcgcaaaatgcgatcacatcacagtcattcagcgaacggtccataca

SEQ ID NO: 60117 - DNA, 571 bp, Heterodera glycines
  Genomic contig location: Contig_ID=SeqID_29637; Location=1037..1607; Strand=-
  SCN-specific regions: Sequence locations=96-137,172-220,280-393,417 -448,505-505
agccgacatcgaaggatcaaaaagcgacgtcgctatcgtcgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 60118 - DNA, 1226 bp, Heterodera glycines
  misc_feature (45)..(45): n is a, c, g, or t
  misc_feature (238)..(238): n is a, c, g, or t
  Genomic contig location: Contig_ID=SeqID_29638; Location=1..1226; Strand=-
  SCN-specific regions: Sequence locations=1-858,882-883,1008-1078,1108- 1185,1212-1226
ggggaattgcccgagggcgtttatcggcaattgcgcgaagtcgancagcagacgagcacttgacggctacgaggggtccaaggcttctcggcccgagtgctgaacaggtggagaaacctgggcatagaaaggggtgtgatttgaccatttgaattcagggaggagtacaaaacgccaaagtacggttcgggcggtacgtgtgaaattcgcgttgtccaacttgtggagatcatcaaanagccaggccaatcacttgggctgtatttgcgtgagggcaatggtgcgttctgtccattgaaagtggcattgatttcttcttgtcccaaaggcattgatcagttcaccggcgttttcgtgtcgcgctttggcgaaaagtcggagttgcaaaagtgcggcgacattctgaggccgggcgaccaaattctggtggttaacaatgttttggtgcgcgagatggccatcgacgacgttgtgctgatgttatccatcccgagaagactgttgctgcgcacgaggcaagcgaagaatggcaaaacggagagaaaacggcatttgtcataattagcgcaattgaaacattggcaaatgaccagacgatttgttcagcttcatcaaagaccaacgcgaccaattggccatccgcggcccaaccgaacggagcgaacaaaggccggtggttgtgtttcagaaaatgcccgaaactgagcacagaagggactcggaggtaatttgagagccattggcacataaagtgaacaaaaatcgaaaaaaggcatcgaattcgggcattttggcaaagccggcgagcacagcagcgagttggctaggcaagaaggtacgacaacaacaacagctgaagaaacaacagaagcagcagcaggtggagagagggggagaaagagagaggaaaagtgtgatcagttaaagaaaagagaaagggatcagggagaagaaagggcgagagagtgatcaggggaaggggaaagagagtaaagagaaggaaggaggtaagcgatcagagaaaaaaacaacgaaggattcaacaggaaaccaaaatttgggacaatcttaaaaatggttaaaatttcaaaatttaattttattattgtgaaaaattattcatgctatggctttttccctaaagtctgaccaagcgcagcaacagcttcggcatcgtcagtatcctcatccacaacaacaacagccaatgatggtaattaccacgt

SEQ ID NO: 60119 - DNA, 56 bp, Heterodera glycines; identical to SEQ ID NO: 52733
  Genomic contig location: Contig_ID=SeqID_29639; Location=636..691; Strand=+
  SCN-specific regions: Sequence locations=1-56

SEQ ID NO: 60120 - DNA, 399 bp, Heterodera glycines
  Genomic contig location: Contig_ID=SeqID_29641; Location=275..673; Strand=-
  SCN-specific regions: Sequence locations=1-69,108-292,322-361,389-399
atggagcttttcctgttcaccttcctctacattttggccgtgtgcgcattccttgccctttttggtgcgtaaatttaaaaattaaattattaaaaatttaaatttaagaaacggtgttgccagttgtgtgggtggacgaccaacattttgtggaacagcagagacgagaagcaattttcaatgcgacgaaaaattgtgatccgttatcatcattagcgattaccatttaagaagtgccgagggggctgttaattgggtaaaaagacattgaaattatgccctggcgaattgcaatatttttttaatataaaaagattttttgaaccgagttctcgcatcaaaacctaattaaattgttgagatataatttttaatttaaattatttatccattaataaa

SEQ ID NO: 60121 - DNA, 567 bp, Heterodera glycines
  misc_feature (89)..(89): n is a, c, g, or t
  Genomic contig location: Contig_ID=SeqID_29643; Location=901..1467; Strand=-
  SCN-specific regions: Sequence locations=1-21,73-127,149-407,429 -502,532-567
atggtgagttgggccaaaaggaattttaattaaaatatacaaaaatttaaatgaaaatttttatgaaaaaaactcgggttttccctttntacgaaacgcattgcacagagctaaaaatttctacattttgtttcattaaaattgtttattaatttggttcagtcgaagaacaccaatcagtttcgagaccaagacgtttgccgctattgggtactgtatcgaaatgtcaaaaagatctatgaaaccttcgtcaagcttgaacaaatggacaaaactgttgtagctgttggaactgaacatttcggcatctttttggagctaaaaagatgtgatcagcttaaactcatccaaaaatcggtgattttttataagggcgacagaaaaaggcccaaaactcacggcaatggaaaattaataattttataattcaaacagaccgaacagaaaccgttgaaatttttaacataaatacctttatattaggagtattcttctgcaaaagtaaatttttttaaatataatttaaaaattgtgcaaaagttcaaagattactgtattaaaaataaa

SEQ ID NO: 60122 - DNA, 1100 bp, Heterodera glycines
  Genomic contig location: Contig_ID=SeqID_29645; Location=1..1100; Strand=-
  SCN-specific regions: Sequence locations=1-183,205-256,278-347,369 -811,833-964,991-1072,1094-1100
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaatttgcaa

SEQ ID NO: 60123 - DNA, 739 bp, Heterodera glycines
  Genomic contig location: Contig_ID=SeqID_29646; Location=381..1119; Strand=-
  SCN-specific regions: Sequence locations=1-140,162-374,407-739
ggctattcgccaagaattgtgccaattatcaacccattagaaaatacgacgcaaactcagttgcttgagttcatttttgcattcactggccacagttatggcataaaattaaatggcaaatttgtgcagagcaattatctcaaagagggcgaagaattttttcccattaattggacggagccaaaggaaatgaaaaagcaatttgaacgaatgacgtcatttcaggttttgttggctctcgagagtctcgacaatcgcgaaaatttatttggtaattataaattcggtttttttaagattagtgctgctgctctgttggtcaacgatcctccaccatggatgccatttgtcaccattgacactaattatgtatgttaaattaaattaaattaaaataattttaattttaaaggaatcaccgatgattccattgccatttttcatggccattcccagcgttgaaattgatacagaaataaacttcaaaatttcattgaccgacataaacaaatacaatttcactgtctcgttgcttcatgacaggccagagagccacttaaaaagtacggtacaaatcagacgaaagtacggtataattccgaccaagagtcttgaagttttcaacagttcaagcgtgctaatcagaattcatgcaaggaccaaaattctgatgagcaaaatcattagtttaatttgtcatacatatccaaaaaaggatcagaaattggtaaagacataa

SEQ ID NO: 60124 - DNA, 1363 bp, Heterodera glycines
  Genomic contig location: Contig_ID=SeqID_29647; Location=25..1387; Strand=-
  SCN-specific regions: Sequence locations=1-156,182-529,551-620,642 -919,950-1152,1174-1282,1304-1363
  Gene Ontology: Mol. function=acetylcholine receptor activity; Cellular component=nicotinic acetylcholine-gated receptor-channel complex; Biological process=signal transduction
atggttgtgcatccgtcgcgcggcaatcaggacgcggcccaactgtttgaggagttgttggccgactacaacaagctggtcaggccggtagacgagaacaacgcaacactggtggtcaagttcaagctgaagctcagccaactgctcgacgttgtaagaattttttattggaaaaaattttcaaataaatcccctacatttcaaaaaaccaccggaatgctaaatattttcaaaactgaacgaaaaaaccaattatacctccgtgacagacgaccagcagttcttcttcagagtgatcggaagtgttcaaaaaatattaacactccattttgaacaaaattagagcaatcttcgtgaaaaaatccgaaaattttttttcttttacactttccaattttttttttgtctatgatttttaatatttataagaaagtacgcttggtgaaaatttcagctcaatttttccatgagaatagttaagtgactaacaattttttttttacattataattttgaaatggagtttatcaaattttttcttgacaaatttcaaaaaatcggcctcgagaatcttggccaattctcttgtttttgaattgcattatctctcaaaaacttggaaactagggggacctactgggcaaggaattcaatttcaaatgttgaaatcgaaaaaaactaaaagcttagctgctttcccaattgatcgaaaaattcagtgccaatttctgcttcaatttggcatttttttaaatttcattattgcaacatcaaattccaacattttctttctgatcaaattccttagagccaaatgtttttgccacgggcaagaagccgccctttcccctctcataaattcctgcccccaggggtcggtcgactgattgattgactgatgagacagaaattccaagtcgaattggatttttgggcatttttcattgttatccctcatctgtctgtcagcccatcaaaatgtttttcgctgttgtcaaccaaaatattttgttttatgtgtgcgtgttggtacagcgtcatggcaaattgcttttatccccagggattttctgggatttgttttttttaattttccgcaaatttaccaaaagttttttcatcggttttacccaaaatcttcggaacacaaaatttcccctctttttcacctctccaaagttttttttatatgttagcctatttcccgacaaaattttcagtccctgcctactttgaaagtttttttgctttccccaaatatatatttttttaaaacaacctaaaaatttcaataattttttagcatgaaaaacagcagattatgaccacaaatgtatggcttcaacaaaaggaagaaatttaa

SEQ ID NO: 60125 - DNA, 139 bp, Heterodera glycines
  Genomic contig location: Contig_ID=SeqID_29648; Location=1160..1298; Strand=-
  SCN-specific regions: Sequence locations=1-104,126-139
agttatagcagatcaaaataaaaaatacaaaaaaggcatttttcagtgtaaattttgaaatagcgggcaaaaatttacgccaaatgcgctatttggcgttatgagcaattttgtctgacactggggcgtacccatagtg

SEQ ID NO: 60126 - DNA, 1874 bp, Heterodera glycines
  Genomic contig location: Contig_ID=SeqID_6044; Location=1259..3132; Strand=-
  SCN-specific regions: Sequence locations=1-454,476-485,526-632,661 -790,813-870,893-1500,1625-1768,1792-1847,1871-1874
atgatattaattgctttttttctccctcttccacctttatttggcgttgaaatttttgctgcttggcttctccgtggcgataatgccaacgttctcatcatctgccgctgctgctgttgtgccgaacagtccatctccgtcgtaggattatcagttatgattgtccatgaggtaattgatgggccattaacttgtgaaattatgaattaaattaaatttcgtacggatttttaattttctaagcctttcatctttgtttttctatttttttttgttaaaccttcagcagttatttctggttgatcagatgtgaaatcgtcctcagatgaactgctaccgatcgaaagtgacattcgatttatcaaaaatcgacgctatgaagaaattgaatttttgttaaagttcgggttggggattagaaatggtcaaaataaatatcaaattcgtgatcagggactccaaaatcctgggaaaaagtttttacgaattatttaacaaaaataatattaacaattttatttttttgcttatttgtggggagaaacattaaactttctgagtgatgacctcaaaatgggtggagaacagatggacaaaaaacttttcttcacataacttcctcattcgttttcttttattacaattattattattattttaggattaagcaaatcgttgacctaaaaaagtaaaatgggatggaaatgagaaacatgtcaaagaagaaaagtttagaatggaacaaaaaatcccttttaaaggacacacaaaaatttatttagaatattacttcattaatagataaaaaattccaaaatacaataagttgaaaagcaatcgtggcacttatcccttttgtgcccccctccctaaaaaaatttaatatttttttcttcggtaatttgaggcgctaaaaatgcatctgctgcttgtacgttaccttaaaataaacagcagatgcgtttttttcaatcctaaattatccgagaaaaaatctaaaaaaaatttctggagtaggtcactaaagggaaaagtaccgcaaacgtttcaatgccgcccttggacatgaatattcagaaccgttcaaagcgtcattcgtccaaggacgtccttgcatttttttattgtaaaaaacattcctgctgtgaaggattttcgttcaaatatttaatggcaaaatgatggatgacccaaatggcgaagcagagggcagaaaactcataaaatttgcatctccttcattttcttaattaggcaaaatgctgacccaaaaaaaaagtaaataaaatgatgggatgggaggaggagaaagatgagaaaaagtagatataaaatgtaaatttgacagcattattaaattaaataaaactataaacgatatttagagtcgattccacaattaaaattttgccagaatcgcgggtattagatagcactaagtgttttctattagcctaaaaaatttcaaaaagtttcgttaaatttcaagaaagttatgactaaaaattaaaaattaataacaaaaagattgtatttaatatatattatttcaaatattcgctatataattaaaatttatattaatctttaattatttaaatagcaaataacagcaaataattttgcacagtttaagctcattttaattccaaaaactgaaaaacaacgatttccaacataatctcgtattttcagtgttgcgaggagagcaaaaactaatttctgaaaaacaaagagaaaatccccaatcgagatccgcttttgtagccaaaataactaaatttaattaatacaatggaccaatttggttggcaaaaaccttcaaaaataattcccaaatatcgtcattttttaatattttggacaaaaataaa

SEQ ID NO: 60127 - DNA, 799 bp, Heterodera glycines
  Genomic contig location: Contig_ID=SeqID_6045; Location=123..921; Strand=+
  SCN-specific regions: Sequence locations=1-177,212-328,350-443,481 -722,768-799
atgcccatgaggataccatccatacaattttcgaattttatgtttcctgtaccagggttaccctcatgggtaagatgccaatgaggatatcatccatacaaattttttatttttgttcgagttcgggtcaggggttcgaaattggcaaaaatgggtgttgtattcgtgatcagcgacctcaaaaaccccttaaaaattattttcattaatttctaaaacacatttataggaatctgaaaatgtatgttaaaagtagcctgtaaactaggaaagtaccaatttaattcacatcatcgaaagtttaagaatgaatcttttttaaattttataccaaatttcttctttttaacagaaaatgacaattggtgaagaaatgaagcagcaaaaagtgatggcacaacacattttattgttgcaggagaaagttgccaaaatggagcaggaaaaagagcaacagaagaagaagaaggaaaatgagaaatacggtaggatggattggattactgtaaaaaataattactgttcaatgaaccgttaatattttaattatttgaaagtgatttaaatttgtaaggtttcagtcgatcaattcatcaaaatgcaaaatgatcactttgctattttggaacgcatcagtgaattggaaaagcagcaactgaaagaacaaaaacagcaagacgagaatgggaaaggaaaatacggtaatgcatacggtaacagtgttaaaattaatataatttatttatttaatattaaaatcatttttagcttccgatcaattcacaaagttacaagatga

SEQ ID NO: 60128 - DNA, 793 bp, Heterodera glycines
  Genomic contig location: Contig_ID=SeqID_6046; Location=1185..1977; Strand=+
  SCN-specific regions: Sequence locations=1-209,247-253,283-314,336-793
atggcgttttgtggaaaaacggttccttcaccactggcactcacagtaaatgttcatacggtgctggcgatacggtcggatgtggcattgatttggccactcggaaaattttcttcaccaaaaatggcattcgtttgggtacgaacaaataaattacaatcacgttgttaagcacagggtcagacgatgtcggaatttcggaaatagagtaaaaaaaaaactaatttcaaaaattttttttattaacccaattaaaattaaaatctttattctttgaccaaattagccatcttgagaatttttgctttaaattttcaaacatttctatggaaaatgaagcccaattgaataactacataaattcagagtctcatttattaaatttatttacatgtttagttcacttaattaatcaattagtaaattttcagatagcgtcgatttgcgcctttatctttccattccgtctgatgttggccaactgttcccattcgtttcattgtgtgactctgatgacaaaattgagacgaactttagcaccaatttcatggccatcactccgacgacgattaacaaaatgtggtcgtccataattcatgaacttagtttccgcattccgacgacgagtccgctgatagatcttactggatttcttatcgttatctttttggcttttgcgcttggtctttttttaagtctttttttttgcaatttttactaaaaaaacatttcttctaaccattctcagttcaccgttttcatgtaatgttacgacattttttcttgttaaata

SEQ ID NO: 60129 - DNA, 1175 bp, Heterodera glycines
  Genomic contig location: Contig_ID=SeqID_29653; Location=1..1175; Strand=-
  SCN-specific regions: Sequence locations=1-124,146-308,337-799,821 -1175
  Gene Ontology: Mol. function=myosin light chain kinase activity; Cellular component=neurofilament; Biological process=protein biosynthesis
ggatgccgagactaaagtcaagaaagacgcagatgagaaggctaaaaaggaggccgaggttaaagccaagaaagacgcagaagagaaggctaaaacggatgccgaggttaaagccaagaaagacgcagaagagaaggctcagaaggatgccgaggctaaagccaagaaagacgcagaagagaaggctaaaacggatgccgagactaaagccaagaaagacgcagaagagaaggctaaaacggatgccgaggctaaagccaagaaagacgcagaagagaaggctaaaaaggaggccgaggctaaagccaagaaagatgcagaagagaaggctaaaaaggatgccgagactaaagccaagaaagacgcagaagagaaggctaaaacggatgccgaggctaaagccaagaaagacgcagaagagaaggctaaaacggatgccgaggttaaagccaagaaagacgcagaagagaaggctaaaacggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaacggatgccgagactaaagccaagaaagacgcagaagagaaggctcagaaggatgccgaggctaaagccaagaaagacgcagaagagaaggctaaaaaggaggccgaggttaaagccaagaaagacgcagaagagaaggctaaaaaggatgccgagactaaagccaagaaagacgcagaagagaaggctaaaacggatgccgagactaaagccaagaaagacgcagaagagaaggctaaaaaggatgccgagactaaagcccaaaaagacgcagaagagaaagctcagaaggataccgaggctaaagccaagaaagacgcagaaaagaaggctaaaacggatgccgagactaaacccaagaagatgcagaaaaaaaggctccaaaggatgccgaggctaaagccaa

SEQ ID NO: 60130 - DNA, 329 bp, Heterodera glycines
  Genomic contig location: Contig_ID=SeqID_29654; Location=130..458; Strand=-
  SCN-specific regions: Sequence locations=1-329
ccgggactcaaatgtcccgctcaggccaaaatttttttctatttccgggaaaaaatcgaaatttttccgaaaaaaataccagtcgatagagctcgaaaaactatgttttggaagtggtctccgtttttctgtgaaaattcgttaaaaaatcataaaattaaaaaacccgaaaaccgttttttaggcctaactcgaaaaattttgaaaattttcgaaattttaaaatctggaaaaatcgagctcattgagctctacaataagtctgctggccacctgcgctcaggtcaaaccctaatgagttattcgcctggtactgaagtgggaaaaaa

SEQ ID NO: 60131 - DNA, 117 bp, Heterodera glycines
  Genomic contig location: Contig_ID=SeqID_29655; Location=889..1005; Strand=+
  SCN-specific regions: Sequence locations=1-46,71-117
atgctgctgcggctgcactgcttggttgtgccgatggccggtaacaacggcggcggcggtggcggtgccgtcggagtaacagttcagccaattgttgctgccgtgcaacgatgtttg

SEQ ID NO: 60132 - DNA, 522 bp, Heterodera glycines
  Genomic contig location: Contig_ID=SeqID_29659; Location=200..721; Strand=+
  SCN-specific regions: Sequence locations=1-228,250-522
atgccgacaatcattgcctttttgaacaaatgtttgccaaattcggtgaaaaaaattggcacaacgcaaatcaatttggatgaaaatggcataaaaattggttttgaagcaacggcaggagcggtcgcaaattcgctagaaacttcaacggcaacagcgattgacgaattttcaacggttgcaaatctgtcgcaaatgcttggcgaaacggacaatactgaatcggcgaacaaaaacaacagcaacaacgacattccgccaacgtctggcggccaagcggaagtggcatccatttcaaattcaaatttgacttcatccgctgatgatggacaaaatgccacgggaggagggccgctcaccaaattggaaaaacgagataagccagaaaatcggcgaattctggtggacaatgagcgtgatgagcccataaaagcggaggaagaagacgaaaaaaaggatcgagaagaaagtgccaaagcggagagggaccaacaaacattgaggaaaattgttcctgacagg

SEQ ID NO: 60133 - DNA, 4819 bp, Heterodera glycines
  Genomic contig location: Contig_ID=SeqID_6047; Location=54..4872; Strand=-
  SCN-specific regions: Sequence locations=1-5,28-118,140-168,200 -203,226-544,566-606,631-697,729-857,910-1015,1052-1206,1231 -1411,1433-1840,1895-2007,2029-2701,2723-3004,3027-3040,3063 -3264,3286-3546,3568-3569,3609-3769,...
  SCN-specific regions: Sequence locations=...3793-3814,3843-4083,4112 -4221,4253-4449,4490-4704,4726-4819
caccttttttgatcaaatatttgcccaccgaacaacttcaagtacaacgaattattaagcatttccatgccccgccgaatttgcccttttcaatgcaaaccaattcttagcattttttgaattcttgaaaaccaaacaaattattgtactctcaataattaatgaggcaattattaaattgaaattaaatttatttaatggataaaaacattttttgtgcttttcgctaattattttaaagttttccattaaattaaacaaattgctgggaaataacacaaattgctggtggtgttgttagcttatgatttattattttaacggcgcttttcatatcaatcttaaatgggaaagaaagcagaatcaattaataatcttttgacgggaggcgcaattcatcaacttttttcagtgttttccgatgaaaaatgtcgggaatgagagaccatcggtcagaaaccaacggcacgagccggatcggctgttagcagcaaaacggcagattaattagcgggcaggggcatcagcgcaactcaaccactaattgtttgtttgtttgcccaaaaatgccgccccgccacttttactccctccctctaaagtacaacataatttatgaaaaattaatctgtcaaatgtaattaaatgaagaaaaaatttagagatttgaattatttccttttgaaattaataagcgattattttaagattaaattattattttatttgtctgtcaatgttggcattcgcttttctctttttgcttacttcttcatcagcttcagtctccgctgtacagcaccattcttctcccaaagtcaccacaattcaaatgaccacagaggagggatatcgggtaaataaatttaatactttttttaattatttaaattgattaaattaatttttgtgtgtgtttagatttacgaacattggacaacccaagcatttgcctctgttctgtcagtatttttgcaagaaaagttcgtttctgttatttgtgctctttaaatggaatttaattattaaaactttaaaaatatattttaaaggcattccaacaaagaccaattagacgtagtgccggacaaattcaacgaatgttattttggcgcacagacagtgccacggatggccaaatgcatcgttcggctgttgaacaacgaattcgaagttgagctcaaaaatgccaaaattgttgctggcaccaaaaatttggtgaaaagcgaaaattgggtgggacaaattcgaatcgaaagcgaaagtgccgaagaaaacggacaaacggaacatcagaagaaaaaggcagaaaaaggacacgaaagcaattcagcagtagaaaaagaaactgtgaatggtaagtaaaatgccgaataatgggaatgaatttctttaaatgaaattttcgcaaatttaataatgtatcattgtataattaggggtatgggatttttgactcataattagcctaaaaagtgccaaaaattgagcgaattctgtgcccgttaattatcacttccaattgagagctttatctttttttaatttccggcattatttaggtacaagtaaaaccgattattacagcgcaaagccaaaatttgaagttgccgaaatgcggaaaagggaagcagtttttgccagagaccaacggcatttagacaaagactttttggcaagaaaacgcaaaaatgttgcaattttgaaaagtcattcatacaatttgctggaggcaaaacgaacacttggcctcagtctcattggaggattggcacgccttttgatgagcggcatattgggaaggaagaacaaaacacggacaataccgtaaaaggaatactataattcaaattaatatagtaaataataaaacaaattaaaattattattttaagttggcaagaaacaatttcacaaatacaaaaggcaaaaaaggcgcacaatcagttgaaaagagaagaaaaaaaatggaaggattatgcgcttaaagaaatggtaatttgttgttattaaaagaataataacttttgctttattcagcccataaaatcggcaattgcaacaaataaaaaatatgacaaaaaaacactgctgaaaatgaattcggccgatgaaacaacggcttacggtagcaaagtgggcaaattggaagcgcaaattgccaaattggtcaatgacggcatcaaagtcggcatgcgattggcggagttggaaagaaagtcaaagtcaatcgaatattcaaaatcggacgaatttaacggagagaaaagaaatgaaatggcaaattatgacgaagaaatggagggggaggagtacggtagggaacagagcgaggaatacggtaaaagcggcgaacggagggcaaagggcggagaagcggcgagagcaaaagcaatggaagcgggccgattggttgacgttttatcgccacggtttatgagcgttacggccagcaagtcgaggggaaaggtgcctaattttggcagataattgatcagccaacgcggatcagaaggggcgggacagggacgaaacgcgacaacacggtccccggccaactcagtcccaaacggtttaagacactgtactcagctagttcgggttgatgggactgagttgatcccctgctgcccagcaggaggccccctttcacccaaattcctgaaaaactattggaatgttatatataattcgaaaatagaaaatttttatttttatttttcttgttttaggctaattttctgtccccatcactgttcagcctgcacacaaaagggcatggccttgaaaggcaaatgagtttgccaaatttgatgaagaagggggtccatttagtggaccgagaccaaaacgaatggcttaatctgatcatggaagcatcgggggtcaacgagcaagtggacacagtgaaggtggatggaagaataatgcaaaaacaatttttcattttccaatgccccagaactatcatttattttgaattccccaactagctcatctcccctagcaaacctttagcttgttttgtaattctatttagctttttattaattacaatttttggatataaccagggctcccagatcaaaattttcaaaagcctcatttggcaggcaaaaaagcctcattttgggtcaaaaagcctcattttgaaaatttagcctcattgacctatcaaaaaaccacaaaatgaggctaaagcctcagatctgggagccctggatataacttaagtcgtccatttggctgaaacctcctccaattaaaagaaaataattttcaccagaattagcaatgattttcaattctcagcatttgttgtcctctgctgatgatgggtacggcactgatgatgagattgccaaaaaagtggagaaacgatacaaacgcgaatttgatggcctttatctgacgaaggaaaatgtgaggagcaaatgggcaaaatggacaattgttcactcgttgatttgaaaggtgcgcgaaatgtatggacagaacgaacaacgaaaatcggacacatgggaaaaattggtgcaaaatttgagcaaagagcaagtaaaatgaaaaacaaaataaattaattaattaaaagcatttatatttaatttccattccaagttggcagaaatgaacaggacgggcgttgtgtcgatgagtgccgaacagctccgtctgatttacgggccgagttcgcccttcaacgactcgcaaactctgcggcgattactgccaattgtgaagaacggcacttccgtcagcaaagtgggccaaacaaacaaattattgggcataaataaatggatagaattcatggaaataattaaattgataaaaaaatatttgctttttgcagatgatcgaagccgacattcgtcggctgtctgaaatggcctcatttgatctccgacaaaatgacgtggtctgtttaatattggggaacggggagctaaactatgaaatgattgattccgatatctgttgtttttgctggctaaaattagcaattgaatcgtccattcctttttttctattttcagctttccccgagtgtgtttaaaccgggtatcaaaaagccaaggtaggaaaaataataattaaaaaaaattaattagctaatgcttcatagaattggtaattcgcttgtgctctctccgcttgtcttctctccgaccattttgtctccgaccattatggggtactattttggcttaattgtctaattgcttttatttattattttcacatcttttgacctgcaattttgtcgcctcgctttttctctcctccggttcgcgttaattcattcaccttttaattatgtttaattgcctaatcattttggattttgtcgcctcgtataatgacgcccctggtgttgtctccgtttatcttctcatccattattctgactccaataattatgcagccattcattttgtcgccaggtcgattaaaaatgtaattaaaaaataattaaatttattttttaggatttttgaacagtatcgtaagtttctttttaatttgaaaacccatattttccatttttgcccagattttgagtccgttcatcttaaatccgcaaataatgtcctcccatttcttccaccccgccattctgtccccgctggtgctgaccccggcccttctgaacccgtcaatgatgtcgcccattgtgctctccccgttggtgctaaccccgcaaattttctctcccaaatttttgtccggccttttcctctccccttacgcattgtcccccgttttgatgtcgcccgttttcgcttatttggtcattttgtcgccgagttggctgagc

SEQ ID NO: 60134 - DNA, 927 bp, Heterodera glycines
  Genomic contig location: Contig_ID=SeqID_29662; Location=177..1103; Strand=-
  SCN-specific regions: Sequence locations=1-474,498-927
atgtatgctgtatttgtatgtcgtatattatgtgtgaaagtgcgtgtgagcgtgcggtccatgcaatccaattcatccgttcattcattttatgacgaagaagcccccattaggtgagaaaagaagtggagaatttccgacaatttaaagtcccgccaaaaaagccaactgacgacgaccgactgatataaatgagagaggagagagagaaagggcacgcaaattaaaaaatgattggattaatggccaaaactttaacggccaatttagttggagttcgaatgataacgatctgataaaatttggtggtacaatgtatgcgttattaaattagatttcccatcaacgccctatctccgagactttctgagtgacgaatgaaaggtcatttcgtaaaaatttgagtttcagcgggtatgtgtaaatcgtagtgatttgcgatcttttgcatattgttgagtttttgtttaatcctttttttaataaataaaaatattccggatggcgaaatcaccatgagggaatgttctgatcgagttagtgtaaaacgaaatattagtcagataaaaaaggcagtaatgatttattcagtcgatatttatcgaaaaacggcgtataattttttcttaacatatttttcggttttcttgaaaatctcaatcgaatcacttatacaatctatatgcagggacaaattaattgtggcgccattcttgttcattttttgattttattatcggtggagtcacttatccatctacaatcagcgacaaaaattcgattttggcactgtcatttttgctacacttctttgttcccactgcaccaattatattttaccattttttagtttcggccaaaacaaatcgttcttcgtccaaacatatttgctatttatccaatcggttctatatgatacaaaataaa

SEQ ID NO: 60135 - DNA, 142 bp, Heterodera glycines
  Genomic contig location: Contig_ID=SeqID_29665; Location=52..193; Strand=-
  SCN-specific regions: Sequence locations=1-142
ggcgcacggaggaagaaaagtggcggaagtcacccccggaagcaatcgatggtttcgtttctcttcgccgccatttcctcttccgcgccgtctgttcagaatcggcgccggaaaccgacttcccccgccccgacaattgagt

SEQ ID NO: 60136 - DNA, 268 bp, Heterodera glycines
  Genomic contig location: Contig_ID=SeqID_29668; Location=1..268; Strand=+
  SCN-specific regions: Sequence locations=69-127,191-268
ttgttgttgctgtgtgttttgctgttgttgttagtgccatgcttctgcttttgttgctgctggtattgactaacaatggcggcggacgcggtcaaatggcgccaaattcggttgaaatttgttccactatttaatataaaaataaataaaatgaaataatgatttttaataattaaaaaaaaaaattttacaaactttacacatgctccataaaaataataaaatccaaaaaaattcgttaaaaaattgtttttttttatatccgccc

SEQ ID NO: 60137 - DNA, 638 bp, Heterodera glycines
  misc_feature (10)..(10): n is a, c, g, or t
  Genomic contig location: Contig_ID=SeqID_29670; Location=184..821; Strand=-
  SCN-specific regions: Sequence locations=1-638
tgtccgtttnggggtactcaaacaattattgggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaac

SEQ ID NO: 60138 - DNA, 173 bp, Heterodera glycines
  Genomic contig location: Contig_ID=SeqID_29671; Location=942..1114; Strand=-
  SCN-specific regions: Sequence locations=1-173
atggcttttcaaatgcttgaacgacaatcgcttaatttgttcaggtaattgaatattttatgtacattctgatttatagagcccagaattttgaaaaagtcgggatctggattggcatcaggccgagataagtaacgggatttaaacccataaagcccggtcccagaaataaa

SEQ ID NO: 60139 - DNA, 2100 bp, Heterodera glycines
  Genomic contig location: Contig_ID=SeqID_6048; Location=137..2236; Strand=+
  SCN-specific regions: Sequence locations=1-185,207-1068,1090 -1535,1557-1657,1680-2100
atgccttcaaattctttttatgttgttcttccgtcaaacaccaatattgaaggaaataggacaaattctttccgagtgcgtttaccgcgcaaattgcaatttaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatataggctcctgggtgagggaagtgatccgttggcaaaaaaggtacgatcaacacagaattctttcatgcttttgataaacaaggctcggcgatgggccagagaagagtacattaagcgaaagactaaagaaaaacggagcgtccgtgacgaagagctgctcctacaggccctgttgacagatactggaacattggttgacctcaacagcgtggcccaaggctttctgacacgggaaaagcgtgcggaaaccagcaatatagcgttgagaatcccagctgacgataatgattcatatcaacaaaaattggatgaatacttttctaaattaagtgagaaaaatttgagcattcttgatgaattgggcatgacaaaattgaccgccgaaatcaaaaatttgagcgaagaggaacgtgcgatccttgaagccacaaaggaaatgggaacggaagcatggattcaggcgtaccgtgagatacgtcttgtttgccaatttaactatgacgtccatagaaatcgttttgtcctgaacaccgacccacggtacgttaaaaaggtcaaagtctcgcctcagctcgcttacattctcggtttcaacaacacggagtttattcaatctgaaaacgaggcaagattcatgccggacatgagcggtggagtgtcatccttccacgtttacacgccggatcttattgaaccaatgatgattggtgacgtcacggccccagtgttgctcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaaatgatgaacacgttggaaattaacaaaacattgacaagaaacaacgtgactcgccactactatattggctgttttgcagcagatcaaatacccgccggtgcaattgtcaaatttccccactgtatggtggttaatcttgaccccagcacatcacatggttctcattgggtgggcatatattgcgcttctcctttgcatttggagtattatgactcattggggttgtggccaccgcccagtgttcacattgtgaatcatttgtcacgctacaaacaaattcaatataattctcttccccttcagtctgccaactcaagtgcgtgtggtcgacatgtcattttctttttgtattgtcgatgtgttggaatgacctttgaaaaaattgtcagctttttgcactttggaaagatgcaaccggatacgctcgtaaacaattttgtaaaaagcataattttcaaagaatataaataatgtaaaaacgtcaaattaaaaaaaaaatgcatgttgattttgatcctctacaagtggattggtccacattctcgtccgagtatgtgcaatttggtggatacaacatttatcgggggttgccctatcagcgtggagcgggagttggcgcagtgttcagaagtcttatgagatatttgctgccgattggaaagcaaattggctccgcaattggacgtcagggaatggaaaccggaaatcgagtactcaccaatgtgctggagggaaaaaacctcaaagagtctctcgttagtgagagtaaggcaggactaaagaatcttctcgaaaaagcagccaacaacataaacactcagaagggtcaaggttttcattttaagcgatacaaaaaagactcggctcccaaaattggaaaaataaggcgaaaaaatataa

SEQ ID NO: 60140 - DNA, 329 bp, Heterodera glycines
  Genomic contig location: Contig_ID=SeqID_6049; Location=2136..2464; Strand=+
  SCN-specific regions: Sequence locations=1-329
atgtctccaaatgaattttctgaccgtccctttcaacaacccgacaatgttcaaactgttcaactgccgcatcaacaaccggatccagaagcagagttgcgggcacaaattgaagacgcggaggaggatttgctcttgaactggtggcgtgaagacccgacaatcgtaagcttgtttttcaatttatcatttttttaaatttcatcacattttttcagattcgttttctatttggacaccgtcgagcacctaccatcgaagccgcgcttcttcagcgcgccgaacgcgaggccgagattttgcgccaatatgccgagaaccatcaatga

SEQ ID NO: 60141 - DNA, 1126 bp, Heterodera glycines
  Genomic contig location: Contig_ID=SeqID_29673; Location=281..1406; Strand=+
  SCN-specific regions: Sequence locations=1-60,82-802,824-927,949-1126
atggataatataaagcaaaatttgcgaactaaaaacgcacgacaacaacgttgggacaaggccaagcgagaggagagaaaagcgcagacgcagagggcgacagaagcacggctggccaagaaaagtgagttttttcatcaattttaactcaaaaaaatcattttttgaatttcagccgctccactgccgaatcccaatgccgaagtgccacagcaggacgaagcagggccgtcaacatctgctgcaccgacagaagaagcgatggagccgcctccaccaactccaggaccagtgccaacgccagaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacagctggaaaagcaactgaaggaccgggatgacaccattcaatttctgcgcgagcaggtgcgcaatcgagaagcgctgatcagtgatctgcgtcggcagctggacgagcacattgtaccaccgatggcaccaccaacgaccagcaaaagtgagtgaaaatctcacattttaattttaaaaaaccttcatttttcatttaaatttcaaaaaacccatttcattgaattttagcgcctccaaacagaggaagaccgagaaaaggggtggatgaactccagcgcagcgccaggcgcgacatcgtcgacgcaattgtgggcgtcatcgatcgtgatcgctcgcgttccgcgagccgcgcatcgctggatcggatccatcgggatatccggcacaaattcgcgcactacacgccaaagaagggccaggagcggaaggagtggatggaagctgaggatgggctcctgctgcttgcccagcttgggacacagatggcttacagacggatgcaggcgactctgagcctcatcagcaggcgctttgacaccttcagcctcattgataaaaggtacagattatcaggaattcagtcatcgcgacatacttttttctgggtgatcatcatcaaatatcccccccccccccctcccgcccccctctctaa

SEQ ID NO: 60142 - DNA, 981 bp, Heterodera glycines
  Genomic contig location: Contig_ID=SeqID_29675; Location=178..1158; Strand=-
  SCN-specific regions: Sequence locations=1-373,395-596,618-855,894-960
atgacaaaaattcccggtctcggtcttggttctcgattctcggtaaaatcatttctcgcacatccctaataaattcaataattattttatcatagaaattgattaataaattcattaacattaaataccgcaacaaaacatttttcattcattctaaagaacgcgatcgcaaagcagcgccaaaaaagcgagagcgatccttttttgagcaagtccgtgccagactggcaggtaaataaaaatttatcttaattttagcaaattttctaaaataatccggattcctaatcctcactacaaaattaggctctgatcgaacccgtaagtactttttggaaaggcatttcgataccgtatctcccaaagcactgagcccttccttttaaattttctccccacccctcacaatcagtccggtataaaagaccactcctttccgtgaccagaaaatgggtcagtggaaaattcgcaagttgaacagtgaatcaggacttcttgaaaatgataaacggtagtattattacttgatacacagtattttatatgaaaatactgtattactgacgcatttagcattttccgggagcccctcctttcgatggggggtggaagggagagctgaaaataaaaccaccaaatatggaaacccaatttaatttaggcccagtccgattgctcccaggccgagatggaaaacgggcaaaaagttatgatgacaatgaaaatcgaccaatggaagaggttgctgcttcaatgcccacctcacgagaccagtcacaagcaagacaaatgcgacaacggaagggcagcaacaacaaccaatttgagccggtctataaccagcaaatatttgtgagcacaacaacaacaacagcagcagcaggtggaggacatacccatagcataattaatagggattttaattttcatgtaaagtaaatacatatattttttttctggcttctcaattttctaaataaa

SEQ ID NO: 60143 - DNA, 49 bp, Heterodera glycines; identical to SEQ ID NO: 51181
  Genomic contig location: Contig_ID=SeqID_29676; Location=697..745; Strand=-
  SCN-specific regions: Sequence locations=1-49

SEQ ID NO: 60144 - DNA, 723 bp, Heterodera glycines
  Genomic contig location: Contig_ID=SeqID_29677; Location=133..855; Strand=-
  SCN-specific regions: Sequence locations=1-185,240-723
atgcctcccatacccaacactaaagttccattaatgctcatgtgccggtgtacggtactgttcctcggctactgtgttctgtgttacggtgccgacggctcaaaatacccaaatgaaataattgacacgccaattgtaagctgtgagcaggaaaatattgtggtcaaggtgggaaaatgggaaggaaattaaaatcaaattaaatgtaaatttaattagcgaaaaataaattaaattaattgcaattattaaagatacgaacttcgagtgccaatccttcgcatatttacgcgcaagactttcacgaaacggccaaatgcatgtgagaggagggggggagagaaggaattggaattgggaagagtttagggtccgaaatcagaacagaatcgcattcccacacaacgactgcggaatgaccagggaaagactggtgagaaaagggaaactttgaatttaaaacggacaaaacgccaaggaaaacccggcaggaacaatgtatcgcatctgtctatctgtgcaggtaatgaggcgacccatcgaaactgaacttacaattaggaattaaattgtggatggatgggtttattaattactcataacagatccatccgttgttcgtcaccgattcggaccgttcgtactgtgcccaatgtgtttatatggacgccaatttggtggatgacctcgaaagggtggatgatactgtaataggacaatacg

SEQ ID NO: 60145 - DNA, 390 bp, Heterodera glycines
  Genomic contig location: Contig_ID=SeqID_29678; Location=938..1327; Strand=-
  SCN-specific regions: Sequence locations=1-15,37-43,65-390
atggagcggcataagcaacaacaacaacaacaacaagtaagggttggacaactgataaaagaaaatgcgcattggctctgtgcactggccagaacgaaatccgccaaaaaatgtaaaaagctgattcgaatggcaagcaccgaacagctgctctcacttgttgaaatttgtttgaatctcgtcgcttcgcgcttccgacttacaacccgacagaaaaagcgattaatgccccatgtgaacactgtacgccgaatgagcagagcgagaagtgagcggggcgccaggcgcgtgcttgtccagaaaggcgcaggatttggcggattgttcgctgctcttttaacacccgttttggttgaattggcaaagaatgttgtgagcaaaaatgcataa

SEQ ID NO: 60146 - DNA, 527 bp, Heterodera glycines
  Genomic contig location: Contig_ID=SeqID_29680; Location=484..1010; Strand=-
  SCN-specific regions: Sequence locations=1-146,168-208,230-408,430-527
  Gene Ontology: Mol. function=proteasome endopeptidase activity; Cellular component=proteasome regulatory particle (sensu Eukarya); Biological process=protein deubiquitination
atggactcggaagaagtgacaaaagaactgaatgaactgcacatgatgatcagtggcgaggaggaaaagttgaggaactacaaaattgaggtggacaggaaaacaaaacgagtgacaaagggtgactcactgaatgaaaaagagggagttgggataaatttcaaaacttatacaattttcgttaaaaaataaaatcaagacaactccgtttccattttctccagtggcaccttcagatcacaaatttacttagattctcctccccccccccacatatgattttgattgatcatttcccttttcatcaggttaatcggcgccggcacaattacatgccatttcttgtcaagctgttgaaatgcctggcccgtgaaggcaaacttgtgccacttgttaccgaagcagtgcaaaagaagaaaattgaggaatcgaagaagaaggattctgccgagtcggcataaacatctaattttttgatggtgcaattagttaatgtataatgtttggatgcttttatatgtaataaa

SEQ ID NO: 60147 - DNA, 130 bp, Heterodera glycines
  Genomic contig location: Contig_ID=SeqID_29680; Location=1..130; Strand=-
  SCN-specific regions: Sequence locations=1-130
agaacaaggagagtattttactgacgagtattatacatactgtacatacagagtacatataagaacatacattccattgtacaaatacatacgcataaccgaacaatgggatacaaatatgatcacaaca

SEQ ID NO: 60148 - DNA, 1407 bp, Heterodera glycines
  Genomic contig location: Contig_ID=SeqID_29681; Location=118..1524; Strand=-
  SCN-specific regions: Sequence locations=1-104,126-243,271-833,911 -962,987-1085,1108-1154,1220-1289
aacttcttctcgactcggtttacgctttgcttctgatgagtcagttgaacttcaaaagtgattctttcgatgcgcaaatttacgagggacgaattatgggcccatttttaataaaggaattgcaaaattacattaaaatgctgaacgaagctccccttttggatacttcaacaaatgtcagaaataaactcataaaattgatcattgaaatatcaaatgatttttttgcgaacataaaaagggaaaacgatttttgttttatttctcaacggacggacgtttgtcggctcattagaacaattaattacgttgagcaattaattaagcgaatgaaagacaaaaagttggccagaaatttaaaaatgcgaacgattgatgaatggtggccaagcgaatgcgaaacggaaaacgaaattcaaaaggcatttgcgcagcagaaagtgcgcatgcgaccagtccattttgactatttgaagaggattttggcggaagaagtgtatgtgagctcatttaacgagctcaaaggggcgaaggcgcggattcggaaattgctaagcgacgaaagtgccaaagggacgacggcagaagagagggcaaacgccgaccaaatcatggcaatgttcagaactcaaagatactttgaaagaggtcattaacattaaaaaagccagtaaattgggaattaatctttgtccaatttaagcatttttctatgcgccggtggtcgaattttatgaggtcgctttgtttgatggaaatgccgaaaaacggtgtgccgaatggctaaagttagacatcattttttgggtcacaattgtggagacaattatattaaaggaggaaaaagagagagaggaagaagaaaaagtgcaaaatgagcagcaaaaagaggcgggaggggaaaatgaagtgccaattaaacaatattttgaagaaacatttagtgaattttgggaaacgcaaaaatatttattttttgaattgtatgaccaaatgttcgaaagcgatctgaacgaaacgccaatgaaactggaggaatttttaaaattgatgcagaaatttatgaagtttggaaggataaaaggaactttttcatttataaatttacgttttgaaacattaaaaacattaattatttcaaatgaagcgctgaaaattaaattaatgaaaggttaataaatataatggattaaaaaaatataattaattaattaattaaggattgggaactgagcaattgataaaaacatttggaaatgaaagaacggatgaaattttacgaatttgtaaaagagaaaacgaagcaaaagaagagcaatgggtggaagaagaaaaaggaaaagcaacaaaaaagaaaaacagaaagaaaaaaataaaacagaaaaaggaaaacgaagcgggaaaaga

SEQ ID NO: 60149 - DNA, 656 bp, Heterodera glycines
  misc_feature (259)..(259): n is a, c, g, or t
  Genomic contig location: Contig_ID=SeqID_6051; Location=846..1501; Strand=-
  SCN-specific regions: Sequence locations=1-227,249-656
atggctcttgttcgatttgaagaagcgaaatccaaccgtggcaaaattctcctttctcgtcttgtgttcgaatatgcttatgagagcgactctcgaatcgagcaaggctgggaatactggaaatgcccaaaacgtcccccttactgtcctgggcgagcttgtgttcaaatggcgtggcacgtcgatgcaaatggaagtcgttacaagatgggtcgcatgtcagccgggggagtttgagaggaatgggagcagcccccgngcaggagtggcggaagggcgcataaacgcattttcataattcactggcaccaaattgagttttgtccaatttgtacaaaacaccaaatttgattttgacaggaagagcttggccgcttagaggccttttgagtatctttccgccgccgcttcggaaggattcattcgcttggcctttccgcggccgatcattggctgccctttcccctcacttttcactcctttaagcaattcttttgaggaattaaagccggccactttgcccgacttttcccaatacaatcactacgcttccgccgccaatttgcgaccgattctcgatgggcacaacgttttatcagctgctacgacggcggtcaattgtgggctgggacaagcgatcaatggacatacattgg

SEQ ID NO: 60150 - DNA, 326 bp, Heterodera glycines
  Genomic contig location: Contig_ID=SeqID_6052; Location=519..844; Strand=-
  SCN-specific regions: Sequence locations=1-326
atgggacggaaacggaaggggcggagaagtccaaacgcagcgattgcaattctcatcctttccgcactttcttttcccagtggaagtgaaaaggttggacagccaatggcatggctaatttggctaagcaaattgtcctccagacaaatggacgacacaaaacggggaagcctcggcccacgtccgttgaggttcggaagacggtgaacgaagcgaaaagtggagaaaggagaagcgaatgcgagaggaaagacgacgaacgggcaaatggcaacaaaagagccaatttggcacttgcaaatgaatgtcatttcgaatggtccact

SEQ ID NO: 60151 - DNA, 849 bp, Heterodera glycines
  Genomic contig location: Contig_ID=SeqID_29682; Location=112..960; Strand=-
  SCN-specific regions: Sequence locations=1-168,196-295,317-455,477 -696,718-798,821-849
atgccgttgtccaatttggccaaagtgctcggcccgactgtggtgggcaccaactcgcggctgcagaccatgcaggacaaacagcagcaacaggggaccgcgtacatgacggaggccaccaatcagatccaaatcatgcaggcactgctcaacatggaccatgtgaggcttttttatggggagggggaatacattaataaatagttggaggtcaatcaaacctttgtcaaggtggtcgagccatttaaattgggggcgcattatttccccccctccccgtcgtttccctccacgagaaaattaaaaaacaattttttcagcttagaaattctccataaaatttttcgaacggcatttatgctatggggctgaaaagtggaatttcacaactgaaaaagttgaaattgtttttttttcttccaaggcctattggacagaaatgtacgatggtccggcccagctgggcagtggggaagtgccggtgccgaaacagcagtggcagacaacgccgacctccagccgagggggccgagaagggggacacctggtgcagtcaattgtcagatgaatggggcgacataagacagaagaggagggggggggggcagagacaggaaagtgggaggcgaccgtattgtaaaaacagagaatggaatggcctataacttaacccctcaatccgatccatgactgtgtaaattcctcaaaatttaaattcaatttcctcgtaattctttttcctatggctttacacacatttcatcactttttgcttgctcgattctgctgacatctctttatttatttctttgttctttttgtacatgcgcattttaactggcaaataaa

SEQ ID NO: 60152 - DNA, 300 bp, Heterodera glycines
  Genomic contig location: Contig_ID=SeqID_29683; Location=1..300; Strand=+
  SCN-specific regions: Sequence locations=1-182,204-300
ataaatatacacttatgggttggcatatgcataagagtgcaccttcataaatatatacataggagaggcacatgcgtaaaacgtgcatattcacaaaatctatacatatgaaatggcatatgctgcataaaaatgtatattcataaatatacacttatgggatggtatatgcataagagtgcatcttcataaatatatacagaggagaggcacatgcgtaaaacgtgcatattcacaaaatctatacatatgaaatggcatatgctgcataaaaatgcatattcataaatataaataata

SEQ ID NO: 60153 - DNA, 384 bp, Heterodera glycines
  misc_feature (149)..(149): n is a, c, g, or t
  Genomic contig location: Contig_ID=SeqID_29684; Location=66..449; Strand=+
  SCN-specific regions: Sequence locations=1-20,51-384
atgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccncagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaagaaggacagcaaaccccagtctggaggctagcagcccaacgtacagcaacaaacgggtga

SEQ ID NO: 60154 - DNA, 826 bp, Heterodera glycines
  Genomic contig location: Contig_ID=SeqID_29684; Location=284..1109; Strand=-
  SCN-specific regions: Sequence locations=1-231,289-501,523-545,568-826
cataaaatgcactgcttgtgcgttgcttcgtgggatcatgtacttgtacgtgttcttacgttacttgctcggctcggctgtggggttttggtgtgcaggcgcgaacttgtggttctaattcgcgttttacggaccgtaactcgggcgcaccaatgcttcgcatgctgtggcggagtgcctggattactggcattcctgctttgatttttcgacctgaactcagacgtgaacacccgctgaacttaagcatatcagtaagcggaggaaaagaaactaacgaggattcccgtactaacggcgagtgaactgggaagagtccagcgctgaatcgcagctcctctagggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccaagagtccgatagcgaacaagtaccgtgtgggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtaccc

SEQ ID NO: 60155 - DNA, 70 bp, Heterodera glycines
  Genomic contig location: Contig_ID=SeqID_29684; Location=1359..1428; Strand=-
  SCN-specific regions: Sequence locations=1-70
gtcagaatcccgctagggcaagatagcaatattcttgctccccggtgtcgggaggcactacttatgcgcc

SEQ ID NO: 60156 - DNA, 540 bp, Heterodera glycines
  Genomic contig location: Contig_ID=SeqID_29685; Location=852..1391; Strand=-
  SCN-specific regions: Sequence locations=1-274,296-361,386-419,442-540
atgctgaagcaatacaaaaacttcattgctgaaacaaaaatgccaccaactggtggtgggagaccgactgagcggaagcctttttttgatctttttgatcaatttatggcggaggacacgcgaattgttggcatcattggcgaaaaccctattgaactaggttaaatctcaatcaattgacatttttctaatttataaattggcataggggaacgccccaaatcatctcctgcaattatcgactcaagcttttgctccggatcggagacttattctgctgctgctgttccgccatcatttacagatttgacaccgattcgtcatcaatcgggcggcgtgatcagtagcaaaaaacgaaaattttctactgcttctgctgctgctgattacatgtctgccgaaagaaaagaaattgtggaaatatttccagcagcatcatcaacagcaactgcacgcgatttacagattaaagtgcttgaaaaagaaagtgccaaactggatttggaaatggagaagcttaagcttgaaatccgtggttaa

SEQ ID NO: 60157 - DNA, 270 bp, Heterodera glycines
  Genomic contig location: Contig_ID=SeqID_29688; Location=42..311; Strand=-
  SCN-specific regions: Sequence locations=1-177,255-270
atgattattttatcaacaaaactgctcacgttgcccgtcctcctctcaattttactttgcattgccaaagggcaaagcgtggaagaattgtgtgaaaagcatgaaaatgagttcaatgagttattcgtcgagaagaaaggtggtgccgtaccagaagtcttatgggaggaaagccttgaaaagaaagaggacaaagaggaggagaaggaaagactggaggagcaaaagaagacggagaaggcgaaggaaaaggatgcgaatgccaaaaat

SEQ ID NO: 60158 - DNA, 1130 bp, Heterodera glycines
  Genomic contig location: Contig_ID=SeqID_29689; Location=717..1846; Strand=-
  SCN-specific regions: Sequence locations=1-212,240-249,316-439,498 -557,588-1130
atggatgacgtgttggacaaatatgcggcttatgtgatcgacggagtgatcaacaatcagtcgtccgtgaagggcgagcagtccacggagattaacagaaacagtgtcaacaaatccatgatgaacaccatgttcatgtgcttcaaaatgaagctgtacgccaagctgagggaggactatggaaatgagaggataaaagtgaggagagtatcataaaatatttttaaatatataaaattctgctgtttgaatttatttgtttttgtttttttgattaattataaattattccattaaaatttcataattttttaacaatccaagtcaaagttcgaaaaatgtttagaagctattattagtacctaatttttttatcgcttaaacaatattttgaaaaaaatgtgagaataggaaaatttattaatttgaatgttattgcaatttaattgaatttaatttgtaaactttttcaattaaattttaatattaaatttattcgcactaaaattgaagaaatttctgacaatctaagtcaatttaaattgttatcagcatcaatttttcacttaaaaatatttaaatgcttttttaatgaaaatttcgaattaaaacgaatatttgaattttaataaaattttcatttttttcgtcgggattaagtctcccgattagttactcccgtttattaatctgatcaaaatcgaattttggtccaggtcccgagtcatctgctgtttcggcatttcccgggtttccctaaaaattcccgcttccgaccaactctatttcagcaatgtttctcctcatttaaggtaattcggctacacgagttacaatttgtggtgctgaacaacgtatttgaggggatcaatgaggacaatttgctgaagtttgacatcaaaggcgttttttcgctggcctatgccgtccagtacacccgcaaacagtgtagaggagagaagggttggcaaaagtgtatttatcgggaattcgactttttcggtttgtcccgtggtggagttgaggtcgccgcctttttcccggagggtattcaattgtctgctgaagcgtatggacaattggccgacagagtgaagcgagatgcgcgcgtatgcactagaaattcttaa

SEQ ID NO: 60159 - DNA, 714 bp, Heterodera glycines
  misc_feature (705)..(705): n is a, c, g, or t
  Genomic contig location: Contig_ID=SeqID_29691; Location=603..1316; Strand=+
  SCN-specific regions: Sequence locations=1-52,86-552,574-714
atggcaaaggcgacgaaagcccggctggccaagaaaagtgagttttttcaccaatttttaattcaaaaataatttttttaaatttcagccgctccaccgccgaaccccaatgccgaaacgccacagcaagacgaagtagggccgtcaacatctgctgcaccggccgaagaagcgatggagccgccgccaccaactccaggaccagtgccaacgccagaaatggacgaggaaattttggaatttggcgattcgctgccgtcgacatcagcgacgccaatcggcgatttggtgccgttcccgtcgacacccactgcaccaatggacactggagagatgacaccgccaccagtggccatcgacgagcgatcaccgcgcatcgaacagctggaaaaacaactgaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaagtgagtgaaatttcgatgccttctcttttcccaattaattttctcaaaaattgatcattcattttttgtcaattttagcaacgccaaacagaggaagaccaaggaaggccatcgacgaactccaacgcagctcgcgaaagcaaaattcaaaacttttcaaaagtgttttatccganttttattga

SEQ ID NO: 60160 - DNA, 72 bp, Heterodera glycines
  Genomic contig location: Contig_ID=SeqID_29691; Location=216..287; Strand=-
  SCN-specific regions: Sequence locations=1-72
tagagaaaaaaagataatgtttttctctggcactctctatttattggtacacatctcgttttttgaaacggt

SEQ ID NO: 60161 - DNA, 501 bp, Heterodera glycines
  Genomic contig location: Contig_ID=SeqID_6054; Location=3875..4375; Strand=+
  SCN-specific regions: Sequence locations=1-501
atgttcgccaccttcgccagccttctcaccgagtcattcatgcttttctttggcatcgccgaatggcttattttcgcccgactttggcgcttcaacgagcaaaggtacaaactgagcatcgcaaagagtgagcacaatctctcggaaaggtttcaggtaagaaaaaaagggggggggggaaattaaaaaatgaaaataattggggaaattggcattttatgcaaaaaataatttgcgaattcgttttaataatttaattttcagttgtccgaaaacattcggacgggcaaacagctgacgccaactttgtccttccatttttggatgctttttgccagtgttgtcactgctttttggagctatttcgactttccccgattcgaccaaatttacttggccataaatgttgcgaatggcgtcaccggactgatcatcgaaacactgatgatcacgtgggtctctcttaagtcatggtttggcccaccatttcattttgcttga

SEQ ID NO: 60162 - DNA, 2219 bp, Heterodera glycines
  Genomic contig location: Contig_ID=SeqID_6054; Location=258..2476; Strand=-
  SCN-specific regions: Sequence locations=1-86,109-181,228-346,399 -444,466-542,570-684,710-1134,1165-1257,1279-1365,1398-1435,1459 -1668,1690-1882,1916-2219
  Gene Ontology: Mol. function=catalytic activity; Cellular component =cytoplasm; Biological process=embryogenesis and morphogenesis
acttttccatttaattcctttttactttttgcaaatttacatattaaaattcgttcatttttcattgatacgatgttaatttgtcgtttttcagttttattttcaaattgatttctccgtccgaccgatctctgtgttttattgcgcacttttttttgatggacatatagtttatactttacatatattttagaaaaagttaatttttgatttaattgatcttttttcacctttagatcgtacaaaatgcttaatgcgatcgatgccattgttttatttgcaattagtgaaaaagtgccaaaagtgctttgataatttcctcttttctcgcttccttttttgtttgaattatttaattactaaataaataatattctttttttttaatttatttatttccttttgctttttttattgtgctgtttacggcctcctcctcttccatttgatcaaattctgatttttcatagtttaattttgttttatgggtaaaacgatcattcgcaaataataattaattaccaattcgttgccacgagttcattttgttaaagtttttatttccgtttatgggagttgagagagagaaagagcagtaaataccgcaatttcccgcccattcattcattaatttgttcgccctccaataacaaattaaatatttaaatttggcaattcttgtttaattaattattttgtttttaattggtggtgataaaccgtattaataaaaaaggaatactcttttaaatgagcaaaagtcccaaaaacaattctcgtgaaaattgttggcaattggcggcgacaattttcggcgctttgcttcaactttttcttgtcgcaattccaaaagtaatctcaattaaattttgttgccatttaaatgtttgtgaaggatttcatccgattggtccgttggtggaaaaaaaaggtgaaaggacaaacggtggtaatacaggcggagggtcgggaattgtaagaaaataaaaaaataaatgaaaaataatgaaaatggaagggccagcgaattgcggaacttttggccgacccgcggactttcggtgccaaagttgcgataattgacattaatttggtaagggaaaacaatcgaaattcattattaacacgaccatgaaaatatttaaaacataaaaaaatttaaaagagtaaaatgccttaaaatttaggaaagcgcaaaaaaagtaactgaaaaaatatgcgaaaacggcggcgtggcaaaagcgtaaatttaaaattgaagaataatttaaaacataatacctaaacattgaaagatggaaatgcgatatttcggacgcaaacgaaattcggcgctgtgccgcagaaatacaaaaaaattttggtaaaaaattgtgaaattttgtttaaattattatcattttttttactattttggatttgaaaagattaggctgaatgataatgataataataatcattagctaaaaggtcgcgtggacattgttctgtgcagcgcggcattgctttacgttgtgcccattttggagctgaacgacgcggacattcagcgatcgatggatgtaaatgcgatgggcaccattaatgtgagcactgatcaaccggttaatcagtgatgtattttgacttttaaattctcggggtagtcccggccccgctttaaattgtcctttttcccttttccaatttggcattttccattctcttcccaattgctaatggctttttgtcagacaattcgcgtctttttgcccgaaatggaagcccggggcaaagggcacattgtcgcgatgggctcaatcgcctcacattttggcgaagtgttccaaatggcgtacaggtggtcaatgggcaaagatgaaaagtatttttgtaattagagatatatttttttaatattttaaaaaataattttgtgtcagtccaacaaaatttgcggtgcgtggcgccatggaatgccttcgggtggagctgagggaacgcgggctggaggacattctctgcacgaccatttacccattttatgttcgcactccgatggtcacttcaaagggactccgtccggtggcacggtgacaaaaaaaaagcaaaaaaaaaatgccattgtcaatgtcaaatgccatacaattaatcagttggttgccctttctgacggttgaagagtgtgccaaaagtgtcgtggacgcaattttgaaggagaaagtgaacgcgtgcattcc

SEQ ID NO: 60163 - DNA, 45 bp, Heterodera glycines
  Genomic contig location: Contig_ID=SeqID_6056; Location=35..79; Strand=-
  SCN-specific regions: Sequence locations=1-45
atggcaatggcactgggagaatcgggcattgcccgtgacgggggc

SEQ ID NO: 60164 - DNA, 564 bp, Heterodera glycines
  Genomic contig location: Contig_ID=SeqID_6056; Location=1166..1729; Strand=-
  SCN-specific regions: Sequence locations=1-351,373-564
atggcattggccgacgaatgcaaagggaacggcgccgtcgacggacaatggcaatccgacggagcattggacaagaaggtgagcaaaattgggcagacgaagaccaaccttttgccaattggttactgtacgataaattactgtactttcatttacataataccatttccatttccttatttcatttttatccccttttcagtttgtccgtcctcctcaaaatcgccaaattcgtcccgtgccacgcctttggatagcgaaaagtcactttcactggaggaaatgcgcgaattgaacagattggtgagtgttttgtaaattttttacaaaggcactaactcaaatttgactaattacctaattaattaattaccttcccttaggccactcttttgcccccgtcgttgcgcgtcctcaacccccagtcaaatgcggcccaattggtgatgaatgcgtcccattacattgccctgttgaccgccacggtgttcgcccgtgtcagcaacggcacattgccccggggcatgccaaacgaatttattaattattacattagtgaataaa

SEQ ID NO: 60165 - DNA, 105 bp, Heterodera glycines
  Genomic contig location: Contig_ID=SeqID_29692; Location=14..118; Strand=-
  SCN-specific regions: Sequence locations=1-105
atgaaagcgattacgacaaaagcggcaagtacattaatgccagagtgctcaaagtcaacaacaaatcctgaacaactactgatgaagaaggacaccgtcgatagg

SEQ ID NO: 60166 - DNA, 733 bp, Heterodera glycines
  Genomic contig location: Contig_ID=SeqID_29693; Location=231..963; Strand=-
  SCN-specific regions: Sequence locations=1-456,479-651,673-733
atgtccattgagcatgcagaaaaagtggtcgcggaatgcaaaggggcagcggatgagaagcttcaggaggacaaactgaagggacttcgagtcagtccgaacggaaaacaattaaatgaaattatcgaactgattgactgtttaattaaactaattaaaattcaaggaatctctccgtctctaccaagaagagaaggaactcattgacaatgcaactgcggacgattccaatggaccaactgttataacggcggagaatgtgaagaagttcttcgatgagctgtgcgaattgcccttttttggtgccgacattcgacaaatgttcgagacaaagcaaaaggcgcggcatgaactttacacagaatactcagaaaagaaaactggtggaattacgtataaagcgaccagaaatggaaaaggtgaagccgaaacagcgaaaattgattggatattctgttttaaaaagggaacaacttttggatgagatacctcacaccttctaaatatccgcaattatgataatcctcttaatgaaacaacctacaaaatcataaatttcatcattctcaacttttacgcctgacaaggcataacaaacccggtgcacactccaaaacgtcgtcggccgaaacgtcgtcatgccaaaaagcgctgaaaaatcccgaaaaatttactaacttagaaagaaagttttttaaaagaattctatgaaaaaagtctcgagaaaattaaa

SEQ ID NO: 60167 - DNA, 692 bp, Heterodera glycines
  Genomic contig location: Contig_ID=SeqID_29694; Location=188..879; Strand=-
  SCN-specific regions: Sequence locations=1-294,316-692
  Gene Ontology: Mol. function=succinate-semialdehyde dehydrogenase (NAD(P)+) activity; Biological process=aminobutyrate catabolism
atttgctgttgtgttcaggcggttgctgccgccagacaaaagtttccgcgttgggcgttcgaatatacggccaaagaacggggcgccattttgcgcaaatggtgcgaattgctcggcgaaagggaaaagcaattggccgaactactgaccagggaacaggttcagtgagaagacaaataaaacccaatccagtgttaaaagacgacaaaaaatatagttgctattttcaaccacaaatgtcagagttgtgggtctgggagtgatagaattttgaaaaatgatggaatttggactcttttggtgttgccaaaatgcgctggcattatttttataaattgagagccctcggcctttgttattttcatgttttgccgtactcatatcgcttcgcactgttcacagggtaagccgttggccgagtcgcgtggcgaaatccaatacgccgcctcctacttggattggtacgcggccgaggcgcggcgctgctatggccaagtggtgcccgcgtcgaaaccgttccgttctcacgtccatttgcgtgagccgtgcggcgtctgtcttctgatcactccgtggaattttccggcggcgatgattattcgcaaagcggcggccgcgctggcagtcggctgtacggtggtggtgaaaccggcggaggacactccgctgacggcactcgcacttgcgcaggt

SEQ ID NO: 60168 - DNA, 1739 bp, Heterodera glycines
  Genomic contig location: Contig_ID=SeqID_29695; Location=107..1845; Strand=-
  SCN-specific regions: Sequence locations=1-8,31-365,387-558,660 -671,828-885,1065-1120,1142-1152,1174-1411,1433-1453,1475-1635,1665 -1739
  Gene Ontology: Biological process=N-linked glycosylation
atgagagtggagaatttggtgatgatgctccccatctatgagaagctttttgaacgactgcgcaactttttggtggcacagcgaaacgcagcgaatgcaaacgtgttgaaagacgggtggcaaaaggcgaagagaaaggcggaaagtgacgcggcgaaaagcttcgacacggagcggaaaatgatcagaataacggtgccagaatgggttagggacagacacgagcggaagttcaggcaaatgctgggcatggccgaaacaccgacggaagacgggggcaaaagcgaattggaaacgatgggaaagcagcagcagaccgatcagaaacagttcagagagacactgagaatgggtaagacaacggagaaaagaagcagacagtgcgaagcactgatcaatcgatcggatggatcaatgggaaaaacactcctaatttaggactgaaaaaatcaactgatgctcgactgcgtttatggtactttctgagaatggaaacggtaaaagaaatattcaaatcgatcgaaatggaatttaatgagaaggaatttcaatttaatgaaaaaaagcaaaaaagcgaagctgagggaatggaaaagaaagagaaaaggaaagagagaaacaggaagaaaaatagaggagagggaaaaggagggaaaagagccaaagacagcgaggaaaaggaagaaaagaaggaaaaagaagaggaaaaggaagaaaagaaggaaaaagaagaaaagaaaggaaatggagaggaaaagagaagagacgaagaggaaaaggaagaggaggaagaaaaaagagaaaaaggagaggaaaaggaagaaaaaataaataatattaaaatggacacagaaataggagagaattatgacacaggggagaacgagagaaaggaggaagaagaaaaggaaaagaaccaaaggaaggaaagggggaataatgaagtgaaaaaagagtcaaaagaaggaacaaaaagaaaggcaaaaagagaaaagggaggaaaagagcaaaagacaaaagggaaaggaaaaagtgaggagaaaaaggaagaaatgagagaaaaaagagagattggaataaaaggttagagaaggggcgattggagtttaatgagcatttataaatgtgtaatttaagagttgcaatcggacgaatttatttcacaaaaatatttggaattcgtttcaaaatctgtgggcgaatggccaaccaattccaaaatacttctcgagttaagtgtttacgctaatgaaatttggcaacgaattgaagcgttgaaagaaattgggaaggaatttcaatttgaatttgggaaaaaagtggaaaatttggcgaataaatgggaaaaagcggaggaagaaaaagtgggaattgaccaacagaaggaaaattggaagaaaataggcaaaatgagggcatttttaaagcaattaatggccaatttgggaaatggagaaaatgttgaagaaaaaatcaacgaaacgggcgaaaaagagcaattaatgcaattacaacgaaacaagttcgcaaaaagtatgacgaaaaatgggaaaacggccgaaatttggcacattttgagcaaagagcgccaaattaacacattaagcgcaattttttggatggaagaagctaacaaaaggtgcaaagaagggaagaggaaggaatttgcgaaatatttggcacaatgggaaacggcggtggcacaattggaaatgggtgagaaaggggtggcattttga

SEQ ID NO: 60169 - DNA, 531 bp, Heterodera glycines
  misc_feature (114)..(114): n is a, c, g, or t
  Genomic contig location: Contig_ID=SeqID_29696; Location=1..531; Strand=+
  SCN-specific regions: Sequence locations=1-142,175-183,227-531
agcgctccacaagcagctctcaccactagtccacgcaccatccccgaaagaacagcacgcagccacgggcaaaagccgcctgtttcacgcaacagcccggctgacccgaccttnagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 60170 - DNA, 190 bp, Heterodera glycines
  Genomic contig location: Contig_ID=SeqID_29696; Location=1943..2132; Strand=-
  SCN-specific regions: Sequence locations=1-117,139-161
cccgcttgttcagtttcccttgaccggggctccagcgattgtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaa

SEQ ID NO: 60171 - DNA, 1401 bp, Heterodera glycines
  Genomic contig location: Contig_ID=SeqID_29697; Location=92..1492; Strand=-
  SCN-specific regions: Sequence locations=1-615,637-706,728-764,792 -1144,1254-1401
  Gene Ontology: Biological process=ubiquitin-dependent protein catabolism
aaaatcgagaacgcctttggaacccggtgttcgagcagtatcgccaagaccatcaacagccctcctcgtcatctgcggcggcttcattcttatcacgcagagcaaacggtgcaaatgtacgttttgcaatgttttggtagttggaaacgcataaaatctcgttttgattacataatcaaattcggccccaaatgactttcagaatcgcattgacctgggcgaacagttcgccgttcggccatcggcccgtgcgccgttggcgcccttatcagtggttccactcaaccaaaacgatgccgacgaaaatgacgggaggccaacccattcgcatcatcgcaaaacattgcagactctgtttcgacccccggtcgaactgatgttccaaggcgattgggaccaggcgagaaaatgggacaggacttagaatttgagttaaataccgcggaatttttaaggccctccaagcggcgcgtcagaagggcgtttggctgctcgtcaatgttcaggaagcgtctgaatttgcgtgtgcggtgctcaaccgggacatttggagtgtggagactgtgcgcgaggtggtccgctccaacttcctcttttggcaggttgcgaatgcttctgctttttgggttcctcttcaaccattgtcaccccttaggtgtaccatgactcggccgacggcgctcggattcgtaattattacgggtaataataattggataaataaatttggcaacaatccatggaatgactttttggtgtttctttctcttccagcctctcctccttccccgctattttcatcgtcgacccgcgcaccggtgaggaagtgagcggtcgtctgaaggcttccgactccgtctctttcctcgattcgcgtaaactctcgcgcttcacttcatacccccatatttgttctaatcattttcttcagtcacttcgttcctcgaccagaacccgacctttgaggcgcgcgatcgtttcatcagagaacaaacatcggtacaaaatgccaattccaattcaaagttttaactgttcaactcccaaaaagtccactcttcctcccgaatttgtgcgcaccacttcgcctccctccccaaaaaatcgaaccgaaacaccgacgaaaaagcgcaaaaagccagtggacgacgaagaaaaagacatcgaaacggaagaagaagggcagcaagaaaaagtgaagacgaaaagggagagtaaagaggagagaatgatgaacatacaagcgaagaagatcaaacgggtgatgacaattagtggtcagtagaaaaagggcaaaacaaacaccgaatggcaaaggctaattgacaatgcctttttcagaccacgaggacctttccactcggcgccctttcgcttcatcacaatttgctgcgtcgaacg

SEQ ID NO: 60172 - DNA, 500 bp, Heterodera glycines
  misc_feature (122)..(122): n is a, c, g, or t
  misc_feature (136)..(136): n is a, c, g, or t
  Genomic contig location: Contig_ID=SeqID_29699; Location=31..530; Strand=-
  SCN-specific regions: Sequence locations=1-230,254-441,463-471,496-500
atgaagagatccgctgctactctctcggctgctgctgctgctgccgatccaaatcagtatgagaataaaactgaacccattccaactcatttggaagctgagccagatcatgagaagaaggngtcaccgccaccanaaagcgcgcggtgtaggaccgagatttgtgggaattagcgaaaagaaaatatttgcttactacatatctgtgcccaggtacaatagcaatagacaaaatattattttaatttaatatcttaagacgattggaaccgattgtaccaccatcagcagaaggtgaagcgcctggacgacgaccgcttttctgtgaactttgagctatgtcaggaatgcgtgcgggccaattgccgagccactgacttcattgcacccatgaagaaaaagtgaacagtgaatgaagcaaattttgatttatgaggcttcattattattaatttttaaaatcacttttcactatttcattttattttctcttaaataaa

SEQ ID NO: 60173 - DNA, 342 bp, Heterodera glycines
  Genomic contig location: Contig_ID=SeqID_6058; Location=1350..1691; Strand=+
  SCN-specific regions: Sequence locations=1-60,82-184,206-342
atggatgtgtcgctggcctccgtcgcgaaggacctcggcttcgacggccacgacctgaccgacatgttggccaaactgccggtcgaggagggcttcgagggcgacatggacccggacgaggacaccctgctcagtaattgcccacaacattgggtggctttccagtccaaagtgtccccatgcttagcagacatcaacaaggaggactcggacgaggcgccccccggcacaacgctgggccacagttgggccgacgtggaacagtttctgctcgagcaggaggagggtctgcaccaaccaactagtcatatctattcaaatccgatcgatactcaaaaatga

SEQ ID NO: 60174 - DNA, 334 bp, Heterodera glycines
  Genomic contig location: Contig_ID=SeqID_6060; Location=804..1137; Strand=+
  SCN-specific regions: Sequence locations=1-64,86-106,128-334
atggctattgataagagtgcgcatcaaaagaaatttgtcggcactatttcggtggaaccatcagttaatggtaaaagaatactatgatgataataagtcttctataaaatgaccaaatcatttttcagctcaacgactccgacgcgaacagcagcagcaccagttgttggacggacagaacaccggcgaactcattcaacaaatcttcgacgaattaaatgcccagcacagttcaacaggtcgcattttggagagaaatgggcgtgcgttgttcagaattgccgaccatccggggacggagacgccgtgccatgtcccaaaagggcagcagtaa

SEQ ID NO: 60175 - DNA, 671 bp, Heterodera glycines
  Genomic contig location: Contig_ID=SeqID_29702; Location=758..1428; Strand=-
  SCN-specific regions: Sequence locations=1-132,154-671
atgtcttctccaattgatgccattctcggacctaaggagaatgccgatcccgaagcgggagcaaaagcctcgaaaacgaagggctcgaataagcctaaagtctcaccggccaatatggccgagatccaaatggagctgggcaacgcaaaggaggaaatcctttccgccgttgcaaaatacattggcgaggctatgagtactgttaaccggggaatggaaggctttaccgcggccatcaaccaaatggctaatgtgctggatgaaaaccgagcgcgggaagaaatggaacaaatgtcgctcgatgacccggagttggaagcggtgagcgttgaggccagagaaaccgggaaagaacccgagagcccgactgagggggagaatgggcagggagaaacccacccgggaccgaaaggcatctcactgccgcaggagcaatccgcccgtgagcgggggcgaggcaccggccaggggcgcgcattcatcagagggcgtgggggacatggccgtgggaccgctactggggcagccgcccatgcgcgccattatttcaacatgcgccaaggacatcgagcgcaccaccagcaccacaaccaccgtcatcctgccccaggacattgccgatgccatgattgtcagccgccgaaccaccactttggacgccgcttccgtcc

SEQ ID NO: 60176 - DNA, 873 bp, Heterodera glycines
  Genomic contig location: Contig_ID=SeqID_29703; Location=418..1290; Strand=-
  SCN-specific regions: Sequence locations=1-222,250-281,325-513,535 -554,576-581,603-807,861-873
atgtttacaaaaccaccatatttgcgtgcaaacaaatttaatcttgacatggagcgaaaagaagaagcagcatctgcttctgctgttggtgatcatttgaaaattcttcgtgccgaatttgacaaaaagttggaagaatttgcgcagaaagccattgaactggtcaatgacaaagcgatggcgatgaaggaaggatttttcgaggtacaatggcaaggacatccattttttaaacatgaaaaattgtccaaaaatggcagccagggcataattgccaatgccaacaacaacaacaacaacaaagaaatggcggaggaggagaagccgaatgaagagccttcaaaaaaaggaattgactaattcattcattccccccccccaaaaaaatggattgagtgatttctgctgatagtttttcgggctttttggcaatgttaacagaagaaaaaaggcattttatgaatttcaaaaattgttccaatgatcattttgcatttcactgggcagttctgtccttatttttaaggacattaacgttgcgctttttctctgttaacaaaacccttgggattttctttggattttcattatcttttatcatttgcttctgtcttcggctgtccttgggcttttcttttttctgtccttgaattgtccttttcccctttgtcctttctttttgctatcttttcagtttgtcctattggagttctttttattttacgattatgcattttattatgtgtctgtgcataaactttttttttatttctcttgcataatttgaaaaaaatgattttattaggcaattttttaacatatatttttattacaaaaatacaaaattatatttaattttaggtttctaataaa

SEQ ID NO: 60177 - DNA, 511 bp, Heterodera glycines
  Genomic contig location: Contig_ID=SeqID_29706; Location=483..993; Strand=-
  SCN-specific regions: Sequence locations=1-265,312-350,392-511
atgccatcgacaaattctgccgcagcacgatatgaacgggcgatacgtcgttcacagtgtgccaaccgacaagcggacatctgtttgtccaaagcgatcgcagtagaggcacgcatcaagcgccgatcggctacccagctgcgcaaaaaagccttggcccgtctcaaaatggatctcggattggcgagagcagcgataaactccggcaacttctttttgaagaggaagaaaggcatcagcctttggcttttgccaaatggacgggtaaaatttttaatatttaattttatttattttacatttattaaattcagggccctctgagagcagccattgtggttcatcatggcccgccgttgccgccgcctccgccgccacctccgccgccgccctgtgacctgatggcggcactacaaattgtagcaccattggcggcgccgggtggcaagaaagggcaattagcgctctgcttccgctgccatgtcgaattgttcgacaagcagccggagaa

SEQ ID NO: 60178 - DNA, 93 bp, Heterodera glycines
  Genomic contig location: Contig_ID=SeqID_29707; Location=78..170; Strand=-
  SCN-specific regions: Sequence locations=1-93
atggggagcaaaaatccaacgcacaattatagtacaggctatagggaagctattcccgaaggattcggtctccccataaatctgggcgcatcg

SEQ ID NO: 60179 - DNA, 497 bp, Heterodera glycines
  Genomic contig location: Contig_ID=SeqID_29708; Location=765..1261; Strand=+
  SCN-specific regions: Sequence locations=1-350,373-497
atggatgatttgttaaatgacatcgatgaagatcagcagcaaagcgaaagtgggagcagttcgcttccaccgcagtctgttaacacgatggcttggctggaacaaaacaaacagaaccaagcgcgggcattctccgagaatttgttgaaagatttgagcgctgtttcagagacgggcaaatgtatgggggggggggagctttttttgtatttcaaaagaatgagttttttgtgattaaaaattgcattggagttttttgtccttttttcttcaagctctaaaacagcaaaaatattctttttttggcaagggtgaccttcgttattgactgacaatgaggcgcattttatttatttttccctattttagctgctgaatttaacgtcaaagatgaaatggaaggcgaagcaggagacgaagaggagaatcagttcattcagaattgtcagcggattcgttcttaccaagtggcttccgagaagaattgcaaccacgag

SEQ ID NO: 60180 - DNA, 510 bp, Heterodera glycines
  Genomic contig location: Contig_ID=SeqID_29711; Location=39..548; Strand=+
  SCN-specific regions: Sequence locations=1-510
atggtgattagaagaggtacaatggtgattagaagaggtacaacagtgatcagaagaggtacaacagtgatcagaagaggtacaactgtgattagaagaggtacaactgtgattagaagaggtacaacagtaattagaagaggtacaaaagtgattagaagaggtacaaaagtgattagaagaggtacaaaagtgattagaagaggtacaaaagtgatcagaagaggtacaacagtgattagaagaggtacaacagtgatcagaagaggtacaacagtgatcaaaagaggtacaacagtgatcaaaagaggtacaacagtgattagaagaggtgcaacagtgattagaagaggtacaaccactgtcgaaaatgtacaataattgttggagaggtacaaaaattgttggaattgtacaacaatggttaaaaagggtacaatcatggttttaaaattaaataattaaggaaatcgtttattaaaaagtaagattaaaaattgaatgtaatta

SEQ ID NO: 60181 - DNA, 61 bp, Heterodera glycines
  Genomic contig location: Contig_ID=SeqID_6061; Location=456..516; Strand=+
  SCN-specific regions: Sequence locations=1-61
ggacccacgcgtttcggcgctcccgtttcggcgctcccgtttcggcgccagctcgtttttc

SEQ ID NO: 60182 - DNA, 117 bp, Heterodera glycines
  Genomic contig location: Contig_ID=SeqID_6062; Location=87..203; Strand=-
  SCN-specific regions: Sequence locations=1-117
atggccgctgattcctgcagtcaatcccccgaggagctcattttgaagacgcgaaagcgaaagatcattttgattagcaaggcacagagcaacacaataacgattcgagaaggcaaa

SEQ ID NO: 60183 - DNA, 900 bp, Heterodera glycines; identical to SEQ ID NO: 6063
  Genomic contig location: Contig_ID=SeqID_6063; Location=1..900; Strand=+
  SCN-specific regions: Sequence locations=1-651,674-900
  Gene Ontology: Biological process=gametogenesis

SEQ ID NO: 60184 - DNA, 691 bp, Heterodera glycines
  Genomic contig location: Contig_ID=SeqID_29712; Location=170..860; Strand=-
  SCN-specific regions: Sequence locations=1-412,530-576,613-636,662-691
atggaagaaaagtttcgtcccgtcaattctcttttcgcgcccaccgtcgaccaaagtgtgttttatgagcagagcacttcccaaaacactgcaaaacctctcccgccaaataatgcgaattcctccgaaaagccgtcgactttgcccaacgacggagtcggacggacgccttcgccccctcaaatgccttcggatagaaagtgcagtcaaaataaatattcaaaaaaagtcattcaatcatttaagttgcttttcttcttccaaaacaaaatttgaacttccgaacgatgtgaacgagtcgaattcggattggacgaagaacatttcgaaaacagcagcgaatgaacacagccaaagaacgccgcgcgtcaattgggacggacaatcgctggcgcattacgacggaacgggcggaggggagggaaaggaacagacgacgaatggaagcaaaaacaatggaaaaacgaaggagaacagcagcaaaaagaaagtgggaaagatggaaggggagggacgggaaaagaacggagagttcattcagtacacttcacggaacaccggcacttacacggactcggaggaggaagaggcggacaacgaggaggaggaggacgcacggtcggacgtgactttgatggaccaaaatgggaggagggagggacagaacggcacgggagggcttcagcagaag

SEQ ID NO: 60185 - DNA, 162 bp, Heterodera glycines
  Genomic contig location: Contig_ID=SeqID_29714; Location=105..266; Strand=-
  SCN-specific regions: Sequence locations=1-162
atggtcatttcgtttctctaccaaaacccgtcttcctatgacgccgctgaagagataacgaacatgacatgggcacagtttgaccaccactgtgtacgcaacggggacaaccaagtcaacgcgcagagagagtgttcacagttgaaaggtttcggaaatggg

SEQ ID NO: 60186 - DNA, 918 bp, Heterodera glycines
  Genomic contig location: Contig_ID=SeqID_29716; Location=186..1103; Strand=+
  SCN-specific regions: Sequence locations=1-876,898-918
atgaattttaaaaccgccgggggcctgggaaataaaattaacgaggcattcagccatcattacaaaatcaaaaaacaacgtggaaggagagaagccaaggctgaagataccaaagattcaaaaattgatgtcgcaaagagggccgcagcacgcgccgggagagacgtagaaagacattttaatcagatcaacaatatctcaaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatagacaagtatctgaagctgagaaaggaccacaaaaaagagagagattagccaatgaggatgttcaatttcaatatgacagtattgatcaaaaatttattgtctatctttccgctgctgtctcccatatagatttgtcaaaacacctcgcatatgttctagggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccaggatcgattagtgaa

SEQ ID NO: 60187 - DNA, 554 bp, Heterodera glycines
  Genomic contig location: Contig_ID=SeqID_29720; Location=455..1008; Strand=-
  SCN-specific regions: Sequence locations=1-54,77-303,383-461,490-554
atgcttccaataaaaattattcttctaattttcttgatttgcacaccaaattctgctgaaaacattactgaaaatgccaaatctcgaaatgaacgagacctgaaacaacaattagcttatgcatgtaacggtttaatgtacaaaaacttatcttaatatctttttgttgcatttgttcatgaagcttttttaatgttttaatttctttattttgatagcttttgacaagttatatagcttcgtgattttttataaattctccaaaaccggaattaatagcggtcgaatactcatagaaataagaaaaaataaaaatataaatcttattcatttttttaaattataataaattataatatgtattaaagatatataaaaaattcatcatattttacatttacagtggtagcctaaaatacgtgttgagggttattgatttcatacgtggattttggcaatccaataattaaatttattattttattttatcaatcattgagcttttttgtggaacgacctagcaccgttctcgtcgagttaattaagataataaa

SEQ ID NO: 60188 - DNA, 72 bp, Heterodera glycines
  Genomic contig location: Contig_ID=SeqID_29721; Location=34..105; Strand=-
  SCN-specific regions: Sequence locations=1-72
atgatcgctgatctgcgcccgtcattggaggaaaagatggcaccaccgatggagacaccgaccccagcaaaa

SEQ ID NO: 60189 - DNA, 445 bp, Heterodera glycines
  Genomic contig location: Contig_ID=SeqID_29721; Location=166..610; Strand=-
  SCN-specific regions: Sequence locations=1-50,81-445
atggcggcaggagcttgctcaaaaaggcggttcgacgccaaaaagtgacgaaaattaaacaaattaattttattttaaaacactgcatttttcagggctaaagcagacgtaaccgtgccaacagcagatggagaggggacatcgacccaagccgccgaaagtgggtcatcaacgtcaactttggaccttcgtaagtcaaaaaaaaacaatattttagaagcaaaacttaaattaaggcccgcgttcaagcccaagtccattgtcagcgactccggtcaggcaccatgtgcgtgtccgtccaaaaactaccgacaaagcaacaaacatggactttacaactaccgacaatgcaacacacatggatttgacaacgatggacaaggcaactgacgtggacttggcatatgaggacgccgcgacacaaaccgagcagttggacaaatag

SEQ ID NO: 60190 - DNA, 1002 bp, Heterodera glycines
  Genomic contig location: Contig_ID=SeqID_738; Location=25..1026; Strand=-
  SCN-specific regions: Sequence locations=1-260,283-1002
atgaacggggaggacgaagtgactgtccaagaatggactgagctcaaaattggcatcatgaaagaagcacttaaagccaagttttcggtgcctgatcttaaagatgtgctgttgagcactggatcggccataatttgcgaattatcacccgaccagttttggggggtgggttgtagaccaggactcatttatgacaaatggccaacagcggacatacaacagtggaacggttcgaacacactgggacgattgttgatgcaactcagagatgatgtgaaggaggcaacaccaaaaggtacaacacgggctgttcagccaaattatggatggccaaaaaatagggaagaaaattttcaaaatattcctgttgaggaagaggtattcgacttaaaaagtttcgaaaatctcgaaataacaagcacagacgaagctaaagataaaccaaaaaattcgacaaaagccaactcaatcagtgaactattgatgagccacgcagacgaagtggccgagacggaggaaaagacaaatgagaaatttgcattgtcagaaaggatgaaccagtggctcaaatatgcgggaataaattgtcaagtcctagtttttggttcctcattatgtcaattggctcgacacggttcggacttggaccttttcatctacaagttcgaccaaacatcagttcgtcttgctgacgaattgggaaaggttcgacaaattttaaggcaaaaatatccgcgaacagagatggaattgagagcgagaggaaacaccccggtattaaaaattaagttggaattccacgttgatttgacaattggacgatcagagaaattgaatggtgtctacaattctgtgtggctggccacgttggtccgaattaatgacctgttcaggtccgtctgcttattgattaaagaatggggaacggatatcaaccaaccggaatttggttcattcaatagcctgtccttggttattatggtgagaaggttacttcgctga

SEQ ID NO: 60191 - DNA, 5861 bp, Heterodera glycines
  Genomic contig location: Contig_ID=SeqID_739; Location=27..5887; Strand=-
  SCN-specific regions: Sequence locations=1-144,167-540,562-832,854 -1608,1631-1709,1732-1821,1843-1886,1908-2010,2033-2293,2315 -2827,2849-3962,3984-4673,4697-5206,5228-5861
atgaaacttcagttggaattggaacgagtttgccgacaactcgagcattataatcaggatttgagttcacctcaaatttatatgagtctggaacagaaattgtccaaaaaggtgttgaccagatatgtagacttaaaaaacgtcaagctgagtgcaatgcctcatggttcggattggtcaaccaacctatttagggaaacatttaaagcggctgttgagcagcttaaacaaatcaatgacatagttcaaagggctaatcccgaacagactcatcacacatccaaaagagagaagcataagagtgaagaaaaggaatcaaccttaaacttggctatcagatacaaagaccaagagaaaaaggataatcgacaatcatcgggtgctgttaagccaaagccatggcgtgggacttcaacttcatcggaaggatcaagcttacgctcatcctcacaatcgagccgatacggacgatctccgggaagaaaacccggttcaccatggcccaatcaaagtcgaagaagagaatcaaattcatcaagcccaagcccgagtcaaagcagaagtccgtcgcgatttccatgccagttttgtgctgaaaaacacttcgctttagattgtgacaaatttagttcagttgtgaacaggcgaaaacaaatagaagcgaaagcaatgtgctacatttgcttattcaataatcatatggcaagaaattgtccaagaaaacttagaaaatgttttctttgtcaacgtaccggacatcacccggcattatgcgaaagacggaaatcagtggccagaggacaagtcgcaaccaccacaactgagaagcaagaaaacacatcaaccaatgtgtttgccatacaaagctgcatgaaaaatccaaaagaaatttggtctcttctcaaatgtgtgtgggtaatcattcgtcacccgatgtttccaaaacggaagaaaagagtccttgccttcctcgacgacggaagtgaaaaaacttacatcgctaaaattcttgttgaagaattgaacttaatgaaaatcaacgaagttcacttccaagcaaagggcttacagggaacaaagttgggagactttgtcacttcggttgtggaactgaatttgttaggaaagaattttaatatgaacattcaagcgcgacagctggataaagtgatgcccaaattgccccacgttaagataaagggcgctaaaattgacaagttattgtccaacaaacttcaagtacttccaaaatttgaagagccattattattaattggtggtgacgtttataaccacttggctgttaagccagtacagcaattggctaatggtttttggattagtgaatcgaagttgggcaatattctttcgggtgaaggaaaagttaagttatcaactaaagaactagccaataccgcttctacaacttcagtcgagaaaattgttgaattttcacccaaatttgggaacaagcttcaacccgacgacgatgaactcacttttatggttgaacaacacaacaaattggaaacgatcggcctgggagacgccaatgatagagacgacaatgccaaatggatccaaaattttgagcaaaacctgaattttaatggtgaaagatatgaagttcggctgagctggaaggaggaagtgacgagtttgccggataactattatctcgcactcggacgactgaagtcgaattttaaaaaattaagggagaaaccatgcttattaaagcaataccatgaaatcattcatgatcaattggaaaagggaatgatcgaacgagttgacagctccattaactattggaagttaaaaggaaccaaagaaagggacgaactcaatggcgtcctctattatcttccacatcattttgtagaaaggcaagacaaacaattcaccaaaattcgcgttgtgtttgatgcaagttcaaaattgagaaaagaatttccaagtctaaacgaatgtcttaacaagggaccaaatttatacaacgatttggcaggtatacttttaagggccagacttaagccagttttggtcacttgtgatgtagaaaaggcatttttgcaaatttctattcatcccgatgacagagacgcactgaggttcctttggtacgaaaatcctgaagatgaaaatagtccaattgtagaatacagattttcacgcgtcacttttggcgtaatttgtagtcctgctcatttatcaattgtattgaaacatcatttcgctaaatatcggcaaccacagatacgtctgatggaaaaggacacttatgtggacaacattgtacttggtattgaccaagacaaaacaattggacaaacataccggttgctaaaagcagtattccgagatgccggaatgaatgtccgcgaattcgtcagtaatgactggtctgagattgaaaaattaccagaaactgaccaagggaagaaggaagagacgaagttactcggagttgggtgggacttagaatctgacaaattaactgttaagttagcccgatttcctaaagaaggaaaaataactaggaggacaattttgtcccaaattgccaaatcatttgacccgttgggtattgtcagcccagtcatactgaaaggcaaattactccgccaatcggtcgaacaaaatggaaaattgaaatgggacacaatagttgacaaaaatctggcttcggtatggataaaactgatgaatagttgggatgcaaaaaccctttcatttacgagaaaatatttcgacgcaacagaagttcgcaactacgagctacacggtttttcggatgcgtccgaaacgggattgggatgcgctatttacatcagagccaacactaatgaaggagcacaaactcagttagcattcgccaaaagcctggtcgtaccgacacagctcagcaaagccagcagaacaattccgtcgcttgaattacacgcagcaaaaatttgttgcaacaatcttctctttgttaaaagagaattggaaaaagcaatcacaatcgacagtgttcatttatggacagattctacggacgtaattgattttttaaactcttctaaattaaaggatcgattcattcgaaatcgaacaaaattcattcaagataagatgattccagtatctcatgttgatggtaaatttaatcctgctgactatgccagccgagggtgttcaccggaagaactgatggagaataaatgctggttttacggtccaaattggctatataaagacaaatcagaatggcccaaaagcatcaaggaatatgatccgacggcaccgaatgaaaataaacaccaagactcattcatagaaatgagtttggtcactaaaagcagtgtaatggaacaagttgaattattgctcaattatgagcaattttcacaatttcgaagatgtcgaaatactttggcttatgtactaagagccgttcaaaatttcaaaaactcagcgaataaaattatcatttcagctgttaagccaagtaatgaggtcaaatcattcagtaagcaaataaatcctctaacgattgatgaagtcgaacgtgccgaagtccatttgtggaaagaagctcaaaaagcctttccgccatctaatgagacgatcttaaatctgaatcttttccaagagaacggaatttggagagcaaaggggcgtatgcaaaatagtggcatggaccattatgctattcatcctatatatttgaataaaaattgtccaattgtggatttaattatcatggacattcatcgagaaaggaaacatacaggaatggaaaatatggttgcttcattgagaagcaaattttggattccttcagtccgaagcaaagtgaactcagttctgagaatcaatccgaatactcgttgttggatctgcgcgcgttttcacgccaaagcttacgcatatcctgaagctcctccgctgccgtcatacaggataagtggcaatttaatttgggaaacaattggtttagattatttcggcccaatgactgttaagtcatcagacggacaaggcaaacataaagtttggggtgcgatattcgtatgtgctctcacgaggatgattcatttggaattagtcacggatatgactgcgaaaagatttttgttggccttcacgagatttgtcagacgatggaagattcctcagagaattgtgtccgacaatggcactaacttcgtgttaggcaacaaagccttaaccgaaattgttcaacaaagcattaaagagaaggagcattggctcaaagttttaaaggacgagaaagtgcagaatttttcgaatcaacaaaaaattgaatgggtttttatttcgccttttgccccttggagaggagggcaatatgagcgtatgattgggactgttaagtaccacttaaaaaggtgaaataagaaataaactcctcagttttgaggaattatggactttgttttcagaggtggagagaatagtcaatgagagaccaatcacttacacttcccaatctgaagttattcagcccctaagacctattgatctaattttacccaacattggtaacaatagattggaaataaacactagatctgttgagaacacatacaatgattatattttggaaaattcaaacactgctaatgtagtgcaaagataccagaaggcaatgaatatggctgaaaaattttggcaaaattggaaagattcctatttattgggtctaagggaacgtcatcaagggaacaaacacacgccaggaaaagcaccaaaacttggggacgtggtgatcatttctgaaccacaaactccaagaaattgttggaaattgaggaaaatagaagaaattttgtcacaacgaactgcgagagtcagaatttcggaaaaatcaattattgaacgtgctattaagcacttatatcccttagaattagccgaaaatgccaataattctgactctggcattagaaagcaggaacacagttctgtgaaacaaattcattataattgggcaaaggaacctcctcaaaataaggcgcttgttaaggcaaattccccaaatcactataaatgggcaaaacaaccaccgagagtgataaatggtataactaatgtgacatgtatttcagaaatggccagagacttcgatgccgtgtctcttgattgtgaagagatggaaagagatctcgaggacgaacacaaggaggaagaatcgaaggatgagagaaagggcatttcacaaattcctgttgaggaaaggcgcccctgggatggcgttggagaaaaaagggttattattaacgctcccatcgcattcgtcggggatgacgaagtggaaccaattggacggacattccaagacaacgggctccgtgccctagttctggtgcactcactcagggacattgcctggtggcatcggttaccagaggtcgtcatcattaatgatgtttgtcagatggtcgtcgtgcggacgacggaatgggccgagcacatcagaccatttttgagccttttgggaagatgggccaaaccggcggtctggattggtagtccaatacatgttgaaggcgtcgcctggctggaaccggcacagacagtagaacttgacatcaacagacttgtgtttatgggtgctccgcgaatcactcaaaggggaggaagtgcgctgtataagaagcgatgccaacaatcattttctgatgatcatagttcgggcgcaacaaagtcgaaaaggttccgtcctgttgaggaccaaccatcgcacagcgaatggactcaggcaattcgaccaatccgtcctgttgaggacttacagcaacatcagtccagctcaaatccacgtttccacccgccacagcagtttccgg

SEQ ID NO: 60192 - DNA, 436 bp, Heterodera glycines
  Genomic contig location: Contig_ID=SeqID_739; Location=265..700; Strand=+
  SCN-specific regions: Sequence locations=1-396,418-436
cataaacacaagtctgttgatgtcaagttctactgtctgtgccggttccagccaggcgacgccttcaacatgtattggactaccaatccagaccgccggtttggcccatcttcccaaaaggctcaaaaatggtctgatgtgctcggcccattccgtcgtccgcacgacgaccatctgacaaacatcattaatgatgacgacctctggtaaccgatgccaccaggcaatgtccctgagtgagtgcaccagaactagggcacggagcccgttgtcttggaatgtccgtccaattggttccacttcgtcatccccgacgaatgcgatgggagcgttaataataacccttttttctccaacgccatcccaggggcgcctttcctcaacaggaatttgtgaaatgccctttctctcatccttcgattcttcctccttgtgt

SEQ ID NO: 60193 - DNA, 794 bp, Heterodera glycines
  Genomic contig location: Contig_ID=SeqID_739; Location=6321..7114; Strand=+
  SCN-specific regions: Sequence locations=1-335,357-383,405-438,467 -577,660-665,707-794
atgcacgaaactggcgttgaaactccgtttttgcatcgccttgaagcgcagacagctcttgattgtacaatacccttgctgcttttatttcatccacttgcgtttggatttcgtccgcaatctctttccactccctttgatcacaaatcaaattgtgtctctgttgggaggtcaacacccctagaggaaggatgggcaagggcttgtcgaggtataattcaatggcatatttggcagtctctattcgttcgacataaatgtccgacattgagagtcccttttaaaattttatacagattttatttaatttgactgaatagtcacgatttaattcgtaaaatttatcaaattggtaattcgggagccccttggttaatagtatgaattaaacaattatatggttaaataacaaattgtatgtgtattaattgaatgttcaaaataaaatttaaaaatttaaattttactccattggctttggcgaagtcttatatgtatggtggagttactgtagaatgaatgaaatatttaattgattagtcagaactgaataatcaacactccccccaaaaaggacaaataaaataaataagttcaaattcaaataaagaaattaagtacaatttaaaaataaaaatgaaatcttaataaattaatttcagatcaaaactgatttgaaagaaataatagaaaggaacagattgattgtttgggttagtgtattgtttcccaattactgtaccctgattttgaaatcaaactgatttgtggggaagatagaaaacaaaacaata

SEQ ID NO: 60194 - DNA, 554 bp, Heterodera glycines
  Genomic contig location: Contig_ID=SeqID_739; Location=1900..2453; Strand=+
  SCN-specific regions: Sequence locations=1-5,27-554
ctaaaccaattgtttcccaaattaaattgccacttatcctgtatgacggcagcggaggagcttcaggatatgcgtaagctttggcgtgaaaacgcgcgcagatccaacaacgagtattcggattgattctcagaactgagttcactttgcttcggactgaaggaatccaaaatttgcttctcaatgaagcaaccatattttccattcctgtatgtttcctttctcgatgaatgtccatgataattaaatccacaattggacaatttttattcaaatatataggatgaatagcataatggtccatgccactattttgcatacgcccctttgctctccaaattccgttctcttggaaaagattcagatttaagatcgtctcattagatggcggaaaggctttttgagcttctttccacaaatggacttcggcacgttcgacttcatcaatcgttagaggatttatttgcttactgaatgatttgacctcattacttggcttaacagctgaaatgataattttattcgctgagtttttgaaattttgaacggctctt

SEQ ID NO: 60195 - DNA, 1192 bp, Heterodera glycines
  Genomic contig location: Contig_ID=SeqID_740; Location=404..1595; Strand=-
  SCN-specific regions: Sequence locations=1-562,584-1192
atgtcggacatttatgtcgaacgaatagagactgccaaatatgccattgaattataccttgacaagcccttgcccatccttcctctaggggtgttgacctcccaacagagacacaatttgatttgtgatcaaagggagtggaaagagattgcggacgaaatccaaacgcaagtggatgaaataaaagcagcaagggtattgtacaatcaagagctgtctgcgcttcaaggcgatgcaaaaacggagtttcaacgccagtttcgtgcatcggtcaatgcaaacgatctgcaaaattttttgcgaagggcaaatcataaattggccgatacccgcacgctgaaagggaacattgatcgtcttcttcaagatgggcccggaggaacggcacgccgaaacattgccttgccaaaattaagcctgaaggagttcgatggcagtaattgggatgacttttggccattattcgaatcgacaatacatgctgatgccgatttggattacgtacaaaaaatgagttatttggattccctgttgaggggtgaagccaaaaaagtcattcaaggacttttgcccttttccagggataattatgatctctcggtgtccttattaaaggacaagtatgggaaaaatgaaaatttaatcagagatttacataatcaattggcccggctttcaaattcgaagtctcttggcgacgacatgaaacttcaattggaattggaacgagtttgccgacaactcgagcattacaaccaggacttgagttctcctcaaatttatatgagtttggaacagaaattgtccaaaaaggtgttgaccagatatgtagacttgaaaaacgtcaagcttagtgcaatgcctcatggttcggattggtcaaccgacctatttagggatacatttaaagcggctattgagcagcttaaacaaatcaatgacatagttcaaagggctaatcccgaacaaactcaacatacatacaagagagagaaacataagagtgaagtaaaagaatcgaccttaaatctggccgtcagatacaaagatcaagggaaaacagacgatcgccaaccatcggttgctgttaagccaaagccatggcgtggaacttcaacttcatcggaaggatcaagctcacgctcatcctccaaatccagccgatacggaagagccccaggaagaaaagccg

SEQ ID NO: 60196 - DNA, 127 bp, Heterodera glycines
  Genomic contig location: Contig_ID=SeqID_740; Location=4206..4332; Strand=-
  SCN-specific regions: Sequence locations=1-58,80-127
cggtgattcagaattggaactcgcccgagcctttcgcacttcgtgccctttgtgcctcatcacaatctcagttcctgcgagtttgtatgcagtgttcagaggagatgaggcaaaatcgaattcacgc

SEQ ID NO: 60197 - DNA, 1108 bp, Heterodera glycines
  Genomic contig location: Contig_ID=SeqID_741; Location=1384..2491; Strand=+
  SCN-specific regions: Sequence locations=1-435,462-807,829-965,987 -1108
ttggatttgcaacgacgtttggatggacattttccccagttttgaccgtcctcaactcggcctcaaattggcacttctttccccacgttttgatgcgttggtggacaaacatttcaatggcaaaagcgaattgacaatttggagacaaatcaaaattcgcaaggacaaaggaccaggaccgaagctgtctgtacgaatcgatgacaaaattgtgccatttccattgccggaccgtccgttgcccagcaaaatccgttttaagcgccttcggatgtggtaattaaaaatcagagctatcgcaataaaagcattcatcccattttcacagttacatcgatcactccgtcatcgcttttcttcgttcaaatcaccaaatttttgacaaaagaggcaccaatttatatttgtcgattccatcatcatactctacgaatggccagcagctgatttgggacatttttgttcgtgaaatttggccaattttttcggcaaatattcgccatttgcgcattaccaatggtgatgatttggaccatttgcttcgtcgcacttcgccgacaattctcactgatctcaatcagttggtttcaatccattcatttgatctgttgcccgctgcgtttggtgatggttttgatgggccaaattcaacaatttctgctggccaagcattgtccaaatggttgcactctccgagaaaagatggccaacccaagcgattgcgttgcggtaattacaacgaacaaacggacttagattggatcaacaatttcaaggaggtgtggccataatctcgacaaatcactgttttttgttttcaaattgtttagcattttctccgtgccaatgccatttcttccgtcagttacgaaattcatttttatgttcatgtgccgtcaatacaaatggtgccatttgatttggtgaacgaatgcacaaaggaaaagctgacattggccaaagcaaatgaaaatgaattggacaattggataatgaaacgatgcaaaattattggggagacggcagcggttcattgggaagacggaaattgggacaacaattgtaacaatgtgttcttttggcttttcggtaccactaattgcattgg

SEQ ID NO: 60198 - DNA, 1548 bp, Heterodera glycines
  Genomic contig location: Contig_ID=SeqID_6065; Location=1016..2563; Strand=+
  SCN-specific regions: Sequence locations=1-111,286-289,315-424,463 -588,610-631,653-689,711-1061,1083-1374,1417-1473,1506-1548
atgactggtcaaatgcaatgggatcgtcgcgtcccgcacttatccgtgttcgcttccgtaatcgtgaggccgcaattgcattctgtcagctgttcagggtgggcagggcgtttttctcttttgtttcgtcttttcctttttccccctcttctctacttctcttttattttctctcctccgtttcctttcctcttatcgcttcctttcacccgccctcttcctgtcttatcattctcttcccctctctcttactctttcttcttttccctcccctccactctctctcactcattttccccaaattttaggaacggcaaatatttctgcgtcaaaagagacagcagcaaccaaaggggcaggacgatgagtgcattgtgagacagcacgggacgggcattgattgtggggaccgtgaaacggatgcagggaacgaagaagaaaaagaggagggggacggacagcagacggactcctactcggacttgtccgacttggacgtgttcagcagctgcgatgaggacaccaacggtggccatgagaagacaccgccagtgacgagggaggaaacggcgaccaaagaacacggaaagaaggagggcggagagacgaagacggaaacggaagaaagtgttggtgaagagggacagcagcaaaagacggagagcaaagcgaaggcgacggaggagggagacaccaacaacaacaccaaagccagcaacagcggcatgaagcggaagaagatgcagtcgtcggcttcgcagcgtcaccgtcatggccactgcagcgaacgccgccagaaacacaagcagcacctgttggactcgctcatctgcggtgcgtttgcccaccgggacctgacgccgccggagttggcacttggctacgcactccgtcagcactgccgggtcagtcactttgttcgccaaatcctacaaaaaatattccttttataaatcttatatgaattttttggcgctattgcattttcatgaccataaatacacgactataaaataatttgacaactttaatgcaccatattttaacttcaaaaaactggctttctaaatatttttgactacaagtttttgaatcttggatcaattttgtgcattacagttctcaaattattttatggtcgtgtctttatggttggctaaactgcaatagagccaatttcctaacgaacctcacgagaatgagtttccatgccacttattaattcgatgcttgctttttcaaggagcagaatcgtgtcccaaactctcgtgtttttctgtacccgcgtgccggacgcattttcgaacgcaccgccgccgcggaggcaaaataatgaattggtcgtgtaagagagattattggactgatgactcgaaaataattcatttatttatttcttataatgttattattattgtgtgtgtgtgtcccgttaaggtttgtttgggacggattattatggcacttttgcctctgttattttattattattatttgtgttttaaacgtatctcatttcgttcctcgactctcgccattgctgcataa

SEQ ID NO: 60199 - DNA, 364 bp, Heterodera glycines
  Genomic contig location: Contig_ID=SeqID_29722; Location=682..1045; Strand=+
  SCN-specific regions: Sequence locations=1-364
atggcgtcttgccatgactatttcgagagcccacattgcgaggcttgtgtaagtaagttctcatcggagctaatatttttaaatgaattttattcagtaattattttcaaaatagttcgacaatcattttgaattggcagtaattacattgccgtcgtgatttgtgacggtcggctttggcggaaaaaggctattatgttagtttctttttttttgtttataatttattgtatattttatgactactgtattttgttagttacctttttagaaaatatatattagtgtttaatcatattttacgataaaattaaatgttaatgtttctttcaagatttccaatccaaattgaaagtagtataaa

SEQ ID NO: 60200 - DNA, 855 bp, Heterodera glycines
  Genomic contig location: Contig_ID=SeqID_6066; Location=39..893; Strand=-
  SCN-specific regions: Sequence locations=1-88,110-130,152-353,376 -502,584-649,671-732,754-855
atgtgccatggaaattggcgaaaagatttaaattcgacaaaatgctcaatgggtcaacaatcagtggcaaatgcggcgaaaatgccaggaaaattcaattttcacttcgcaacgcaacaatcattttcggaaaacaaaattacatattcgagtcagtgaaattagaaaaattaaatactactttatttggttgtaattttagagcatactgtaaatattgggttatcccataaatactgtcaacactaaaaatgaatcaaaacacatttatgtgtttgtgtgctcggatttcagggtctacatacgactttcataactcttaaatttgctaaaaattcaaaaaacgcctaaagaacatatcaaaagtgccaaattattgagaaacgtatagctttaaaatatcccagatatatcaataaaaacttaagacaaacaaaagttatgatatttattaaaaagggtgacaatatttatggacaatccaataaatctccaaaaaaggaatataattttattaatttacaaagaatttattatgctatattaattcattattacattaataaacatttttcattttttagtaattcgtacaaagacatttcttctccgtttcttaatatcgaattcaaatttatgatttcaggcgaatttttgacaattaataaaggtggtcgcgaaatttactaattttcaataaatttactaattttagcttcaccggtcacaaataaatggcacaaagaatttttcacgaattcaatgcttggaccatttttggaagaatatgccgaactttggctgttggctgcggacattgtgccaaagttgagccaaaaacgaaaaaccaaataa

SEQ ID NO: 60201 - DNA, 333 bp, Heterodera glycines
  Genomic contig location: Contig_ID=SeqID_6067; Location=509..841; Strand=-
  SCN-specific regions: Sequence locations=1-129,152-333
atgtctaaaataaagtccttagggtaattacaatccaatttatcaaatattttccagcagctcttcaggatatttatttctttttttgagatctgatctcctaaaatttttgcaccattacctgatatgaattttttaaattaattccatagaacactttattaattagcatagttattaaggttttgtgatagctaatgtcgtacaaattcaagtaaaaaaattttcggatgctttattcagataaaatattatataaggatttatccagtattaaagttggtaaataattgctatattttgcttacaagggtcctcacaacaaataataaa

SEQ ID NO: 60202 - DNA, 1168 bp, Heterodera glycines
  Genomic contig location: Contig_ID=SeqID_6067; Location=1397..2564; Strand=+
  SCN-specific regions: Sequence locations=1-279,301-641,673-677,699 -792,824-977,1026-1088,1119-1168
atgaaccaaaacagcaatgcttcttacaccgctgcacccggtacggtcccccggtggattggatttaattaaattctctccttcggcaattttttttcattaggtcgactcgtcaaattttaaggtcacatttcttaggcttaaatggaagtaaaaattaccagctttaaatgacatacaatcgagattgtggaaagcttatatgacgttcgtcaaaaaccatcatgacaatattttaacaacacaaaatgaacttaacgtgttttctctaattatatgcacgtggtatattatttttcaacctcttcagaaaggttggagataattggagacggggagattaatggagatgggcttataataagtaaaaattcggtatgcctatttttaggcttaaatttaaaaaattcatcgaatttaactctttctatagttaataaaatcgcgccaaattttataagcataatcccgggtacaggactaacttaatctaaactatttcaacgcttattggttttaaaaaaaatactgggttttctattatattattttttcagaaagtgctctgaaacgcaccaaattttgttgtcatattaataagcattctaatgcatatattttagagaaggcttatgaattcgattaaaaaaaaatttatgaattattaaatatgcctatttttaggtttaaatttttagtgaaaattaattacaaataattatccgaaaaatgataagaagttcaacaaaattttttaaaggcatcaataagacaaggaaaagcttctctatgataattttatattttttatgaaattttaaatgatgcctttcattttaggcttataattttagtgaaaattttgtccctcataatttttcggtaaatgatcagaagggcaccaaactttgcaagcatactaaaaggaagagaatcaacccattatcaatttatcatcctattgaaattttctgaccataattttattataattttgtaaaaaaaatttaaaaaaaaattaatttctgtagagctattaaatgataccattaaatattaatttggctgaatttgagccaagttatgagtttatgtgttttacattttttaaaaatttactaccctttggcggcatttaagaaacgacccagcatggtttttaggacga

SEQ ID NO: 60203 - DNA, 164 bp, Heterodera glycines
  Genomic contig location: Contig_ID=SeqID_29733; Location=1..164; Strand=-
  SCN-specific regions: Sequence locations=1-164
tgaagattcaatggctatgatacctttcaatttgtttctgctcagcgccgtaatttttgcattcatttggattttcaattattttcttccattttttagcttttcttcacagcgaatgcatatgacttaatattaaagaatatttccgtggtaaaatacatttt

SEQ ID NO: 60204 - DNA, 718 bp, Heterodera glycines
  Genomic contig location: Contig_ID=SeqID_29737; Location=235..952; Strand=+
  SCN-specific regions: Sequence locations=1-216,238-718
gatggcgtctggtactaccgaaacgcgttcattccgatcaatttggagtgcaagcagccaccgccggcggagattgtcaaagagtggatggacaagtacggttccgcagcgccaaaatcgacaaagcaggccaaacaaaaagtggccacaccattgaaaaagtcgtcacacaaaccgaagttgtccagtgccgacaaggacagcgaaatgctcaagaggaagaggaagcatgagcaggtttttcaaaaagggtggtgaaattggggtttcgggatcagaaaattgttggcttcgggatccaatttttgaccgggaacccgcccgaagaataggggtgagcatctcatacaaatctttttgaactcgtattgatctattgcaatttacccgtccataaaaatttgtggattgaataattccacttccttaaagtaacattgaaaactgctatataaatgagtggaaaggtggacacagagagatcggtcaatgtttttaactgcctttttagatgctttccaattcttcaacttcatcatcatccacatccaaaccgttgcctgtctctgcacaaaaagtggtgtcgtcctcggcactgccaacgccgggtgcgccgtcgccaaacattcccaagcaaaaacagccggcaagaccctcctccgctccaacaccaaaaacggcactgtcctcaaatgctatcaacgaaactccaacaaag

SEQ ID NO: 60205 - DNA, 199 bp, Heterodera glycines
  Genomic contig location: Contig_ID=SeqID_29739; Location=80..278; Strand=-
  SCN-specific regions: Sequence locations=1-199
atgactgacataaggggaattcatacaacggaggtgtggcaagcatctcacgggcttataggaaaggaatattgtacaacacaaacaattggagaaagagggccactctcaacatataattatgatggagacaaaaatacggttaatttctgctggaaaatcgcttctcatccgattcgtcatcatccatttatccatt

SEQ ID NO: 60206 - DNA, 72 bp, Heterodera glycines
  misc_feature (9)..(9): n is a, c, g, or t
  Genomic contig location: Contig_ID=SeqID_29740; Location=41..112; Strand=+
  SCN-specific regions: Sequence locations=1-72
atgggtcgnttcatcacggcaccgaaccttttggctactttcaatcgttgcttaacttgccagatcggacgg

SEQ ID NO: 60207 - DNA, 3306 bp, Heterodera glycines
  Genomic contig location: Contig_ID=SeqID_6069; Location=743..4048; Strand=-
  SCN-specific regions: Sequence locations=1-5,36-362,386-503,532 -543,565-867,890-1000,1030-1239,1261-1718,1740-1891,1913-1916,1938 -2080,2102-3007,3029-3054,3076-3275,3301-3306
  Gene Ontology: Biological process=DNA replication
tacggattaaaaaaataaagaaaataaaaaaataacattatgtgatttcactaaatacaaattatttttccgaaccgacggcaaatttttaccacatcattatagcaataaattgtttcagcagtggtgtgttgaccaagctgcacgaattgaatgggaccgattgaattttattaaattacaccaaaaagaaatatgcaaagagttagtgaaattgacaaatttttatatgctaaagcaaccgaagttggcgcacaagttaaaaaaaagattattttgccttcaagttttagtggtggaccaaggaacatgcatgaaagcttcatggatgcaatggcaatagttaatgaagttgggcgcccagatttatttttaacttttacatgtaatcctaaggatgaagatatattaaaaagtatgatttctggccaacaagcgtttgatagaccggatattgtagcgcgagtctttcatttaaaagtttctcaatttcttcgagaaattatagatggtaaaatatttggaaaagttgcgggtttttgttatacaatagaatttcaaaaaagaggtctccctcacttgcatatgttactgactttagattcagcgaataaatggaaaaatacaaacgacattgatcaatttatttcagcagaagtacctaatgaaaatatagataaagaattatatgacttagtcaccgcattaatggttcacggtccatgtgggccagattttcccaatgcaatgtgttggtgtcaaaaaaagaaaaaatgttcaaaaaaatttccaaaacaatttcgcgaaaaaactgaaattaatgaaaatggttatcctttatataaaagaccaaatgatggtaaaacctttttaaaaaaggattggaaaacagggaagagcaagtcgatgactaatcaagacattgtaccatacaatcgttatttacttaagaggtttaagtcacacataaatgtagaaaaagtggctgatattaaagcagtaaaatatatttataaatatatatttaaaggatacgatgctgcaactttgcgttgtgtgacaactgaaaacggaaatgtaaaagaattattttatgatgaaactgggaactatttagatgctaggtatcttagtcctgttgaagcatgttggaaaattttcaaatttcctttacaagcgaaatcacattcggttcaaagattgccagtgcacttagaaaacgaacaaataattttttttgatgaaaatgatgatgacgaaacaataatagaaaaaagagataagaaaagtaaattaatggcttattttgattttactaatgaaaaccccggtatgtcggatattttatatacagaaatgccaaaattttgtacttggaactcaaaacaaggaaaatggttgttacgaaaaaatcctgaaattagtaaaacaataggtagaatgtatcctgttaatccaacagagggtgaaaaatattatcttcgatatcttttgcttcatgtttctggaaaaggttttgaagaccttaaaacgtttaatggtattatatataatacttttgcccaagcatgtttggcgagaggtttaattaaaaatgatgacgagtggaaacattgtttaaacgaagcgagtcatttcaaaattccaacagcgttaagaaatttgtttgcaagcatattggtatttggtgagccaaaacacccagaaaatttatgggagcaatttaaaaataatttagctgaggactttttcgttaataatacaataaatgctgcttataaattggcattatcctatatcaataaacatttaattcgagaaggcaaatctttagcggattttaaaaaattaccccaagattactcgattaatgacgatgaagaaaatattgattacgaagaagaaaagaaaactgcatataatttatataatttaatgaattccgaacaaaaatgcatttttgactcagtaaaacaagtaatacttggccaaataaaacaaaaattaatttatattgatggccctggtggtacggggaaatcgtttgttttaaatgctatttttcatttagttcgcagtcataaaaaacaaattaacaatatggcattttctggaattgccgcaattttattaaaaaaaggccgaacaatacataatagatttaaattccctcttaacattaatgcaaatgttgtttccggtgttgttcagggtacaaaagcagcagaagaaataattaaaagtgatttttttattatcgatgaagcgccaatgacaccaaaatttgcacttgatgctattgaaaaaaaaactacgtgaattaaccaaatgtaatcatttattcggcggaaaaacgataatattagccggtgattttagacaaacactgcccataaaaaaatttgctatacgaagtgaaattattgatcttacaataagaaaatctattttttggagcaaatttgaacaaatgaaattaacagtgaataatcgggctaaggatgaaatatttgctgaacaaatgcttgatataggcaatggaactttgggtgatttaattcagttaccctcagaatgtattttgtctgacgattcaaatttaacaaaggaaatttatggagacatttttgcaaagcataatttcaatgaattaaaaaatcgtatgatactttcgccttataatgatttagttgatcaccataatgcgttagctttagaaaattttcccggagaatatgttacttatctaagtattgacgaagtcgaaacaactcacaattttcccgttacacctgaaataatgaattcgttcaatgctccgggatttcccctccataaattgaaattaaaacaaaactgtaaggtaatgcttcttaggaatattagtatcgaagacggactttgtaatggaacaattttgcaagttttagaattaaaagataatttattgagatgtataatacttggcgatgataaagatggttcggaagtttatatacaccgaatatcattgataaccgaaaatgaatttcctgtgccgctaaaaaggcaccaatttccagtaaaattagcttttgcagcaacttttataaaaggacaaggtgcaacatacgaaaaaataggaattgattggactcgaccaagtttttctcatggccaaacttatgtagccttatcacgcgttggttcgtggcaacaaattaaaatcaaattaccggctgataacaaagatggtaaaattaacaatatagtttggagagaaattttataaatcccaacaaattatttaaaaaactaaaagtttta

SEQ ID NO: 60208 - DNA, 1673 bp, Heterodera glycines
  Genomic contig location: Contig_ID=SeqID_6070; Location=115..1787; Strand=-
  SCN-specific regions: Sequence locations=1-8,31-178,202-235,259 -690,712-959,981-1324,1354-1673
atggtgcgcaaaaaacaaaagctaataactgacgattgtgctccaagcacttcaaatgatcagcgcacgaatgacgggttcaaagctcccggtcaaaaaagcggtcaattgattgaaacggttcaaagctccgtacaaaagcggtctgaaacaatacataattcgattgaattacaaagcaaagaaaaaagtacagaaagacgttgtttgaaaaggaaacgattgcaaatggaagaagttatagatttggatgatttgcctgatgaatttttctctcctagcatatcaaatgaaaaaattaaggaatacgatagaaatcgcaaaatatcccgctttcaaatgaatgaagaacagagaaaattagagagagagttgaatttaacagttgtgcaagcacgtagagaattgattaaaaaccaaggcttatatttaaaagcaggtgtttttgatatatcgaatgtagttttttataaactcggggaatttaatgttaagtgtattcattgtcccgctattcattttcctgaagagcaaagcaaaacaaaaggtaacaatgaatttttagattgttgcaattatggaaaattgaatattttagaagatatgatacaagaatatccaatggaattgagagttttatttcaaccagaaatcgattctaacaattacaccaaaataatcgaattccacaataatttttttaaaaaaatacgaattttaaattcttcattttcatgtgcatcgttgggttgtatgagatttgagtttcctgataaaaaaatacctatttttaaaatacaaggaagtgtttaccattcatataacacaattgcgcaacctgataataacgaattgccaacaaatggacagttatattttatagatacagatcaagcaatagattaccgattaaatgtttttcgagatcctggtggagatccaaaagatcaaactgttgcattaattgcttatatagaaaattatttacgtgaaaattatatttattcaaaatcttatgaaatgatgaaggatgtctatgaagaggcattagaagagtcaaaaaaaactggcgatgaaattcctgatgttcaaatgttgtttgatataagagaaggaactgatttaaggcgatataatatacctagatcaaacgaggtttgcgctattatttggagagacgctaatgacgatattccagctgcaaatatagttgtacatgctaagggaagtaaaaagttgaaacgatttttccacttagtccaatggttgaacccatgtgttacccgatattttatcccggtagttatcttggttggcactacggattaaaaaataaagaaaataaaaaaataacattatgtgatttcactaaatacaaattatttttccgaaccgacggcaaatttttaccacatcattatagcaataaattgtttcagcagtggtgtgttgaccaagctgcacgaattgaatgggaccgattgaattttattaaattacaccaaaaagaaatatgcaaagagtcttatagtgaaattgataaatttttatatgctaaagcaaccgaagttggcgcacaagttaaaaaaaagattattttgccttcaagttttagtggtggaccaaggaacatgcatgaaagcttcatggatgcaatggcaatagttaatgaa

SEQ ID NO: 60209 - DNA, 489 bp, Heterodera glycines
  Genomic contig location: Contig_ID=SeqID_6070; Location=2125..2613; Strand=+
  SCN-specific regions: Sequence locations=1-323,345-489
atggacgaaaaagtgaaatatagaaaatatggattatatagaacatatggacaaaaaaaagttgtcctagaagtttcaaacatggcgaaatatggaaaaaatatggacgaaaaagtgaaatatggaaaatatggattatatagaaaatatggacaaaaaaaagttgtcctagaagtttcaaaccaagctaaaaagactatttatatgcttattagcacgaaaaaagcatccagaaaaatatggaaatccatacaattacggtctctaaaaatgagcaataaaacacatacaaaaaaggaaaatttttttgctattagatcttctaaaaatatcaaaataaaggcgaaacgacaaaaaatcacctaagtacgggtcacacaataaaaaaatggtttatttgggtaaatttttcagattttttccctaaaaatggcgaaatatgggaaaaatatgaacgaaaaagtgaaatatggaaaatatggattataa

SEQ ID NO: 60210 - DNA, 948 bp, Heterodera glycines
  Genomic contig location: Contig_ID=SeqID_29747; Location=37..984; Strand=+
  SCN-specific regions: Sequence locations=1-37,59-394,416-786,814-948
atgaatcgacggtaagcaatcattaaaaaaatgtagcaaattttcatttcactattttttcatgtttcagttgggtgtgcaacgacgtgtggatggacattttcccatcgtttgaccacgctcaacttggcctcaaaatggcattgctttcgccacgttttgatgcgctggtggacaaacattttgacggcaaaacgcaatttacgatttggaaagcaattaaaattcgcaaggacaaagatgaaatgccaaaactttttgttgaaggaaaatcggagggatttccattgccggaccgtccgctgcccaacaaaatcatctttaagaagcttcggattgagtaaatccattaattctatacagagaccaatatattttttggttaatgcatctcgtacaataaaaatttacaaaaataatgcctaagccattgtacaagttgtcatgacacctatgttttaatacaactgattatatattcttcaaatttctccccttttcaggtacattgatcacttcgtcatcgaatttctccgttccaatcagcagttttgggacaaaggcaccacattgtatatcactgtttgggaaaaaaacgaagataacaaaccgatttgggatgtttttgtcgctgaaatatggccactttttgcgacaaacatttgccaattgtgctttgccggtgccgaatttttggactatttgcgtcgactcatttcgccaacaattctatccgatctcaatcgattggattcaatcatttcttgtcatctgttccccgatgtgcttgctgatgatgatgattttgatggaccaaatacgacttctgccggccaagcgttggccaaatggttgcacaatccgagaaaagatggccaaccaaagtcattgcattgctgggaattgaaggcatccacaaactttgaatggctcaccaatttcaaggag

SEQ ID NO: 60211 - DNA, 439 bp, Heterodera glycines
  Genomic contig location: Contig_ID=SeqID_29749; Location=501..939; Strand=-
  SCN-specific regions: Sequence locations=1-439
atgacaattccttcattggaagcaccggccttttattttaccaaggctttgtctcatcgtcaaaaggttatgcgtctgtataaacgcgcgattcgtgaaactcaatcctggcatgcgcaagacttgtaagttttgaatttgaagaaattgtgagattttagaaatttataatacttccgagttttttcgtttaggcttgagtgtcggttccgaatgtgcttaatgagggcacgatttgatgcaaatcgcgacgtcaacgatgtgcattgcaatccataaataacaaaacaattcactttttaagatgcgattggcacaatatcttcttgctgacggatgtcgccaactttggatgtaccgaaatgtttcccaaacaatgcgatgtatgtgaataataagtgcaacttggatttacttacaattattacaggatggatga

SEQ ID NO: 60212 - DNA, 603 bp, Heterodera glycines
  Genomic contig location: Contig_ID=SeqID_29750; Location=96..698; Strand=-
  SCN-specific regions: Sequence locations=1-472,581-603
atgctgttcaacgaagagctgaagatcagccgcaacttccaagtgtcattcgccaaagatgttgtcaaggcaagtgatcagaacgatttggctgctgatcagattgaattcctcaaccaaacattagggattggacagctaacaaaattaattttagcattttatacaatgacagtgtacgcattgattgaattcgcattaaattgggcaaatgttatcccattaaatgccattttaatcggtttggccacttttaagggccttttctttcttcactcctcaaacttgcgctgccatggctttttgtgcctccaaaattgtttggtggactcaaattggaacgtcaaattgacaaattttgtgacggaggaaataattggggacaaattgcgacacaacgaaatgaaacatatcagtgcaagtgaactgatcaaagagaagaaagccaaagaagcagccaaaaagatgaaaagcggcggcggagggacggcgaagggaacggcggcggacgcggaaggggcggacgaggtcgactcggaagcggcgggcgcaaagcggcgcaagcgacaggcggcggcggagcgcaaacgggtggagaactcg

SEQ ID NO: 60213 - DNA, 475 bp, Heterodera glycines
  Genomic contig location: Contig_ID=SeqID_29751; Location=307..781; Strand=-
  SCN-specific regions: Sequence locations=1-68,112-252,302-475
atgaacatttcggcaaaagcatataaattcagaggtgttgttagctgcttatttgaattaagcttttctaataattttttgaaaaaataatttttaaatttaaaattatttcccttttaatttgtttttttttccaaaaggcaatgagacggaaatcgtttggcgagctgttgattttcacggtgaattgaaacagtgtgtgacaaagcttgtcttcgaaggtggtacctcttctgacgatgccagtaagtgatttattattaaatttatttttttaatttaaatatttttataaattttagctgcgggacactcgtctaatgacaaagacattgaatgcccagaatggcaaattcgcgaagtgaatgtgagtgccgaatttggaggtgacccgctgacagacgaaccgccgttaattcgagctgaatatccgccaattttagcaaaaaatcgcagattattgaggcaaaaataa

SEQ ID NO: 60214 - DNA, 1061 bp, Heterodera glycines
  Genomic contig location: Contig_ID=SeqID_6071; Location=153..1213; Strand=+
  SCN-specific regions: Sequence locations=1-157,179-509,539-691,713 -886,928-1061
atgataacaaacgcagcgcaattggcccaggcaaaatattggaaaggtttgattggcttaggagttggcatacgctaaaaaaatattagatttttgcgaaataactcaagaaaattagaacaatttcttggtactttcctattttatgtcagccagtaatttcgaattcaaattttcattttgggtttcctaatgcacatacatatgtccttggaaccggaaacggttgggccccaccatgtttttggctataacttttttctttgtcatccaaatccaaaattcttggtatcattcgaaagcttaacatgtttagaagctatttctaaggtattgcttagcgattagacaattaccaaaaaatttatagcatgaaaatagcaaaaaaggcaaaaattaaaaaaaattttcttaaaaacttttgttatgttaaaaatctttgagtttttttgtaaggctaatagagagcatgtgaagagctttcgaatgataccaagaatgttgaaagtttgtataaaaatttaaatggagttaaaattgtttactccgtcagtgaaaagttgcgtaaatgtgtgaaaaatttcttaaatgaagtcccaggcctccccccccctccttttatccagccgtagagttattttctcattttgactcggttacgtcgagaatggaaagaaagtcttgggcagggaattcatagaaattaaaatttcttccttaaatgtacttcgttgcatttaaagccatcgcaagcgtagcatgtaggcttaaaagacggtggacaaaattttttcaatacgttcgtcgggcactttccattcggttcagcacaatctttgaacacaaacagagggtagccagttgctgtgaaagttttacaatgatgaataattaattaattatttcatatgtaaatatttaattttagattggaaaaatcgcaaaaaggtacttaattaatatggcaaagctccaaaatagtgattcctattgatgaatagtggcgttaaaacgaagaatttccgagctaaaaatgtgtttttcgtgcatttctcgtcgaa

SEQ ID NO: 60215 - DNA, 1192 bp, Heterodera glycines
  Genomic contig location: Contig_ID=SeqID_6071; Location=1983..3174; Strand=-
  SCN-specific regions: Sequence locations=1-262,286-384,407-515,537 -1037,1059-1192
atgtgttttaattttgcagtctgcaaacatgcattcactttcgacaatacgatttataaagtcaacggagagtttgcaaaggtgatcgaaaaatggggaataacaaaggataagccggatataaagtgccatggcaaggcgatggaggcgaaggtcggctgtcagacataccgatgcatggatggtaaatgaacactgatcaatcaatagagaccggattttagggttttacctattttttttttgcggagagtacttgatgagagacgcatgaaaagcacattttctccgaacaatttttatttagagcgactttttagcacaaaaattacctaaaacgggggttagcacctattttgtaatttacgaattttattacctgttttggccttttcccagaaatttcatagaaaaatgcaataaaaacgaaaaaatacactcactaagaatcgatcccaaagatttcagagaaaatatactccgaaaaaatgaccaaaatttcagaaaattaatatatattagttattttcttgactagttgctattttggtgggcgaaattgataaaaaaaattagtcactttttggaatttttgtgcataagaaactggggttttccactttttagaacctattttgggcgtttttagcaccaattttgcacttttggcacctattttagtacctatttcagtgtttttagcacctaaaaatccggtctctactgatcaacaaaaaaaaataataatccaaattattgcacatttaaacttccttttttgaagagtataacaacgacgtgtttgtgatcaacggctgcgccacagatcgagggaactgcagtcatacagaattggacgaattttgcaaattaaagtcgaaaaagttgcgtacaaaatgtgacttttgctatgatgaggacaccgtgtgcaacgcgaacaacactgaactgctcataaaaacgtacattgactgcaaattgtccatggactattcgtggttgtacacgccgagcgccgagcttaagaaatggctgaccaacagaaacatggagaagaacttgagaacgtgcgcgaagagaatatacaaatgccaagcgttcacttgcactgacaaaggtgaataattgggaatacggcttctggacaactcagccgaggataactcagctgatggacaactcatacaataaa

SEQ ID NO: 60216 - DNA, 1149 bp, Heterodera glycines
  Genomic contig location: Contig_ID=SeqID_6072; Location=277..1425; Strand=-
  SCN-specific regions: Sequence locations=1-108,130-702,741-809,831 -1149
atgtccctcttccgccgtcttgcaattttcatcgtcctcctcgcattcttcccccttttttgtggaggtaatttttgtattttaaataaaataacattttgtatatgccttttcttaattttaagcattgaagtgcgtcgttgggtcgcacggacttcaaaaaggccatgataaggatttcgagcatacagaatgtgctaatcccaaccacaaacgttgtaccaaaatcaagtgctccgctggtaaaagaaaatacacttacaaattgggcacaataggacagaaaaagattattattcacagagattgcttggctaaatatgcccatttccgggtgggggtcgttttagtctgtgccaagttcaaagcatcataactttttttgtcggtttatctttgtgtgatttggaaagccaatagagcttgttgttaagatctttcgaatgatacctagtttattggatttggtcaacaaagaaaaaaatgactatggtaatttggcagcgccaaatggttaagcattaaataattgatccaccattatggagagttgaattttcttataatatgtttttttcaattattattataatcgtgtcccgacatttgcttttcttaattaatgctgttttggctgtcagggcttgaacaaaattcaactttgaatccgattttggacataggcgcaaatgccggagctccattattataattcataaatgtttttaaaataaaaaattggtgtcaaattttcggaattgaattttgccgtttcttcaaattgattgtctcccgtcagcagacctttgttagtttatacattttatttttgtttagctccaaacgaaagcttcttagaaatgaaatgctatccggacgacacaaattgcgacttttacaacaaagatgtgaatgaaaaagttggatatatggcttcttcaaaatggaactgcacttgcgaatttggcaatctgctcaatgacgacccattcacatcaggtcattttgttggatgggcagctgaatttaattagtttaaatgaacattctttgcttcaattacataattaatttgttgctttgtaacaaaatctgtcgcaaaaaatgttaattgttttgtggtttgagtcgacgttttaaaataataaa

SEQ ID NO: 60217 - DNA, 598 bp, Heterodera glycines
  Genomic contig location: Contig_ID=SeqID_6073; Location=641..1238; Strand=+
  SCN-specific regions: Sequence locations=1-75,98-119,141-367,389 -439,461-574,596-598
atgagcttcttggccgctccagaagtgcagtgcagcagaatggaggtgcgtattaaattctcgaaatttggaaagatttattaattatttaattaaaccactaatgtgttagcatatgaatttttaccaaatatttaacgtcaatgtaatattgtacaggagttccagcagcttgcgaaattctttgagattctcaacaatcgattgcttagatcgattcagaaaaatgctgctgacaatgagagcgctgcttgtggaacaacgggacagagtgagaagaatggaacagtcccagggggggggggggggggggtgcggagtacgataggggtcaacggtactgggatataatctaaaccaccaaatgaaatttttaaacaaaaagttacaatacaaggaaccagcatttttggccataacttttttgaaacttaacgagattatttcttaatgtcattcgatcacaataattaaaatagttggagaaaaggagagaatatattattcggtgagggatttgggaatggaagttcggggatgggttcgaggggaatatttccaaattcaacaccactttatgtttaaagtcaaatattaa

SEQ ID NO: 60218 - DNA, 243 bp, Heterodera glycines
  Genomic contig location: Contig_ID=SeqID_6073; Location=1575..1817; Strand=+
  SCN-specific regions: Sequence locations=1-243
atgaggcttttttgcttgccaaatgaggcttttgaaaattttcatctgccatccctgaatcccgctactgtactttatataacacttgagaaaacatcgttagaaaaggatttatttaatcctcagtacgagtggtgtgttccaaaaaatgccacactcgcgctgatcaacaaaaactacaaaaaacttgcgatggccacacacccggacaaaaacaatcaatgcagcggcaaattgtttacg

SEQ ID NO: 60219 - DNA, 67 bp, Heterodera glycines
  Genomic contig location: Contig_ID=SeqID_29752; Location=880..946; Strand=+
  SCN-specific regions: Sequence locations=1-67
atggcaacgacatcacaaatggcattggaaccacccattatggtcacccaagacacgggcatgaaag

SEQ ID NO: 60220 - DNA, 95 bp, Heterodera glycines
  Genomic contig location: Contig_ID=SeqID_29752; Location=1..95; Strand=+
  SCN-specific regions: Sequence locations=1-95
caaaatagtgatttctagtgacgaaaagtgacgtccaaatgaaaaaattttaacgcagaaatgcgttttttgagctcctttcttcaaaacaattg

SEQ ID NO: 60221 - DNA, 878 bp, Heterodera glycines
  misc_feature (864)..(864): n is a, c, g, or t
  misc_feature (871)..(871): n is a, c, g, or t
  Genomic contig location: Contig_ID=SeqID_29755; Location=36..913; Strand=-
  SCN-specific regions: Sequence locations=1-170,213-254,277-522,559 -639,716-878
atgttcgaagcggtggccatgccacactcaattttcatttgttccgcaaggaggacaacgttgaatttccggttcatatttgtaaaaaaaatattttacttacataaatatcatgctggtcatcgtttcgtaaaacccaccattttagctatttttggaaaaaacacggcacaactctttgctttaaagcaacaatccaaattttcatttttggctatcgaaaaatggaagtaaatactatttatgccataacttataataatttgttaatttatttgcaattttgcagacaaataaagaaaaagctaggctatcgaaatcaaggatgccaaattttgatacctttaagcaaaattagaccatattttgtcgaaaaaattgcgaaaatgtcggattttacgaaacgattaacgtggtggattttcggaaatgggctagcacttctcaaaaatgatgcttctaaaaatgttttcaggttgtccaagtcaggcctggaccgtccaaggttgccgtaggtaggggattaattaatattaatctagaaatttttatttaattcaattgaaatcataatttaggcgatcagctcttgcttacgggagacagaaagcgtgacgaacaagttgcactgtttgtttgtttttttttaacattttaatcttttatcaaattaatcaaaatttaaaattaaataaattaattttaaatttaaaaagtaaacaaatctattttcagcttggccagtcatccaattaagtgccaaaacacaaccggcaaactcacatttactttttggctttacaacggcgctcgaattgaagtgctgattttagaagatcgtgaggatgaagtgaagaaaaatanattttanaattaaa

SEQ ID NO: 60222 - DNA, 912 bp, Heterodera glycines
  Genomic contig location: Contig_ID=SeqID_29756; Location=591..1502; Strand=-
  SCN-specific regions: Sequence locations=1-87,129-221,244-271,300 -314,337-490,530-835,857-912
atgaatgaaataaagtcaggaaactttgacgcatcatccggaattgaatggcttaacaaacattcttttgccgtgttttgtgatgggaaaattaaagaggaaattaatgatgaaaatttggaaaaattacgcaaatatttccgtgaaagtttgctaaatggaacattaacaactgatgatgaaaatgtacgcgatttggtcaaaaaagtccaaattgacgagaaaaaggcaattattggaaaaatggccaaagattcaattctcggcaaagaaaacaaagaaaattttaagaattttttggataaattaatcattggaattgaaaaaactgctgccataattaaaggtaatttgaatttacatttttatacttattttggcgattttatcttaaaaacagaagccatttgaagaattttttttaatcaaatcaccttttcttgatggatttatgtatggaaaaggcttttaaaagcttacttacttatcgaataaattttaataacgaataaatttaataaatttttttcagcaaaaaatcaccaattttcgcaccaaaaaaacaatcgccagctgaacataagagcaaagcgtggtgttaaagatgtattgtgtcgcatgtgtgccgctgttattgcattaattccctacataatgatatgtggctttttattctatttgtccgttatgcaattaaaagagaacaacactgatcacattttttattatcgtctttggaattatttacggtattttgatggtatcaccaattattatatgtaccttgttggccgctgcttgccaatatctcgattgatcatttgggcagtagtgatcttttggactgggatttttcttgttcgtgttgtgttttcttattcgaattcctttctctttttttgtttggtctaa

SEQ ID NO: 60223 - DNA, 504 bp, Heterodera glycines
  Genomic contig location: Contig_ID=SeqID_29760; Location=71..574; Strand=-
  SCN-specific regions: Sequence locations=1-321,343-346,389-389,412-504
atgcaacaccaccaccatttgtcatgcgctttttgggctgatcagttaagcatttgcaaaagtgatcgggacagaagaggcgcccggatttcaaatgataaggaaaagattgatcagcgagatgaccaatcacttcaatcaattgctgagaatgtgctttctgtttgcttggataaacaggtgaggcatatgggtgaccagcagttaaatccaccaccacttgctgataatgagtattgtatggcatatatatttaaaccaattccggatcacatttattttagaaaaccgagtttccgactttgaaaaattcggcattttctgtacataatttgagatttttaataaaattgcctaagaaatgaatttatttaaaaattttgattttcaaaatttagtttcacctgtacctgttcaatcgagtttatgaataaattaaaaaaaacaattttctttttgcagaatgtgccccgttggttgtttggtggccgaatttctgtttag

SEQ ID NO: 60224 - DNA, 1137 bp, Heterodera glycines
  Genomic contig location: Contig_ID=SeqID_29761; Location=2..1138; Strand=+
  SCN-specific regions: Sequence locations=1-853,946-996,1018-1137
atgttggaccctgacaccggactgttctcgcacccggacgcacagaaacagatgacgctgaaggagctgatcgtcaaaggctacctcaacccgtacaacacgcgcattatggaccgcgcgagcggaacggacatgcacttgttggacgccatccgcgagcatattgtggacgacgtggcgggcactgtgcgcgacacgctgactggtcgcgtgcacgactttgcgaccgcaacacgacaaggttgtgggagcagttggcactaaatccttataattaatcgcttatttactgctgctcttccaggcttggtcaaggaagacagcggcgtgttcagcgtcgaccgtcgcaccagtcgcacgtcgttgggcgacgccggctcgcctcgcattgttgagcgcaagctgcagctgacgccctacgctcaggagccctttcaagcagcctcctctaccggcagcgtcggttcggtcggaggaggcaccacacatggacaacacgcatcgctattcgacgcagcagccgcaggtccggtggtgagcgcagcaaagtcacgcgacgtgtggagcagcagcaacgggcatggcaccgccattatccgtgagagagtgccaatgcctgaacacgcataaaattttagccccaattttagcggcgacggcaaccgcaatcaaacccaatgaacgaatggtggatattgggggcggcaaaacggtcaaagtgaacgtggtacgcgacgcggacgggctggagaagggcgagtacttcgacccggcgagcaacatgaaattcaccatccaactgcatggcgacccggtgaccacgcagacgagcacaaaggcaagcagaaagcaattaatttccaatttcacataattaatattttgaaggttaattaaattttaattattttgatttaattttttaatccatttaaaaaaatttaaaaaaaaattatataagtaaataacagcaattttatggtattactttttacctttaaatattttaatttttatgatcattaacattagcgaccgaaaagtttagtctgtttaaattttgaaaaaattcaaaatttcaacgttagttttttggtttaaaaactgaaaaccgaaatttttataaaactttgtaca

SEQ ID NO: 60225 - DNA, 1115 bp, Heterodera glycines
  Genomic contig location: Contig_ID=SeqID_6074; Location=284..1398; Strand=+
  SCN-specific regions: Sequence locations=1-533,555-749,771-1115
atggcacctccaaagaatggcacacccaaagagaatcgctttatgcgaaggctaagaaaaatgctcaaagcggcgaaaaaactgtacagagattggcacatcaatcacttggcaccgattgggttcatcggcatttatatgtttgtcggtgccgtctttttttggctggccgaaaaaaacgccgagcttaacgaaatagccaaaaggtgaaacacgatggattttaacctaagaacctttctcgaattagaaaagaaatttattggtccattcgatcggagggaatttcgaacatcgaatcggtggtcggagtgaattggatgagcaaagagaggcgcacgcggctgtcccaattggtcgactctttgttctcgcagttggacgaattggccggcgcgggtgaggcgcagccccaatggaattttatggcggcgatgtgagtgcaaagtgccgtcgatatagcatttgcaaatgagtctcgacaggtacttttctggcactttgttcaccacgatcggatacggggacatcgcctgcgagacggccatcggccgaatcggcacaataatttattcggtgatcggtcagactaatcaacgattaattgcccaattaataaatgccttttgcttattttgccaattttcaggcattccgctgacattgatcactttgaacgaattgggtaaatttctgtacaaatgcatcaacgaaataatggccgtcgtttctaatcggtggaatgtgtgcattaaaccccttttattttgccggtgttttcggcgccatgccaaaattccgctggatcttccgcctacgccaatgtctccgtctctgagacaggcactcaattaaaagaaaattaaatattttggcaaatttaaatttaggcacaaaaggaatacgaacggaagacaacacatttcttcaaggatcagagaattgcgcaaaaggatctcatctttgactacgatttgaagtcaatgtccgaggacaaaaagttttccgagtcgagcgccgggggggacaatttgacgatggacgcggagaaaggcgcctttctgacggccgaaggtcaattgagggaaaacgaagccaaaacggcaattggatga

SEQ ID NO: 60226 - DNA, 515 bp, Heterodera glycines
  Genomic contig location: Contig_ID=SeqID_6075; Location=1589..2103; Strand=+
  SCN-specific regions: Sequence locations=1-51,77-491,513-515
atgacagagtcgcagcaaaaacgagtgagaaaagggaaaatggggggggggattaaaaataaaattaataaattaacaggcaaaagacattgtggagtcattggattggataaagcctgccgaagagagtacaaatccaatcattgcgaagatggaatcaatgcaagtcaattaaaattgggggggtggcggagaaaggacacacgctaatcacggatcgactgctgatcagtttatgtatgcttcactgatcagctgatcgatgtgtgtttcgatgatcagctaaattggatgaactgctggtgccgatcgtacgcttttgtgctttagctgtcctcaagtgcatttgtgcgaaatgatttcgctgccccgtgccgatcaatgggccattgccgtaatcccccaaaggcaattgacaccgcttcctgtgccattggcagcaagcggaaagctgcacgtctctctcacgaacaatcgatgaaaaggactgtggaggaagaagccaaacgacaaaa

SEQ ID NO: 60227 - DNA, 1170 bp, Heterodera glycines
  Genomic contig location: Contig_ID=SeqID_6076; Location=1223..2392; Strand=+
  SCN-specific regions: Sequence locations=1-102,124-826,849-1083,1105 -1170
atggaagctgatgtgagccacgaagtccacggacagtccaatggccatcaaactaaaaaatgtggggagatgaaacagagaatattcataaatagacgttgtggtcatggaaatggggtccaagtcgatgctccaataaaagagcagtccgaacacgcccaaattgatggacaaaacgcaggcggtgccgggcaaaatggtgctgatggaaggagtgaacatcaccaaaacgaaagtcatgcagagaagggcgaacgcaactgcaaaaagatggataaacaaaaagacattcgttacaataaggccgactcgccggtttgtattgtcaccgacggaatactgagcaattgatcagcgtacatactgtaaacaagagacagaacatgcgaaacgaccattggtactgtacctgaagtcctcgtatacggtaaggttcagctgggaataatcagcggctaattggcgccaccgttgcagcaacaccaaacggtcgctccaagcaacggcattttggaagccggtcgagaagaagaatttgttaatgcaggatgggcgttcgtttaagcaatcccttcgggggactcggaattagtcattgaaaagtcggcatttcccttttactctttggggcctaagctgacaaaatggctccaccggtgatactcgggaatggaaaagaagtcgtaaaggtatttgtagcggaagtcaatcgatccgcggttctgacaaaaaatggcaaatgaccgaatgaacacattccttggctcacttgcagtccgatgaatggcaagtacgtgttcagccacatttgcgtgctcgacgggcccacgctgccgttgctctgctcaaatcgctccaaaatgcgcataattttcggaatggccgacggtttgcgcaagtctcccggactgttcacaaaaacggccatctgtcgatggcatttcgtttataattgccaaatttttgagcaccgacctgtccaccctccttgaaaatgacattgttctgcaaacggaccaattcgagtagtggcgagtcatccaggaacagtttttccgacgttagtccaactttaatttgggcaactaaatacaaaaagaaagaatcatttgatcatttaattgtcagaatatttttaaattaattaccgccataagcggaaaacgccca

SEQ ID NO: 60228 - DNA, 3208 bp, Heterodera glycines
  Genomic contig location: Contig_ID=SeqID_6076; Location=569..3776; Strand=-
  SCN-specific regions: Sequence locations=1-319,342-342,364-1218,1241 -1321,1343-1354,1376-1450,1472-1706,1729-2431,2453-2692,2714 -2853,2875-3208
  Gene Ontology: Mol. function=sterol transporter activity; Cellular component=integral to membrane; Biological process=positive regulation of growth rate
caaagtgatcacgatcaatttccacgccattttcccaaattccacaatggaaacggtgatgaaaaagtgggagcattccgtgtacaacttcgcaatgaattcacgcggcgatccgttgctgaagctgcacgtcacctcggagggtttagtctccgaggaggtgcggaggacaggtcaaatggcaattagtacagatgaaaggcccttttaaggacagttattaggggaaacggggacagcgattgataatttaagaaatatttaaggacaaatcaaacaattaaagacaattaagcgtagattaataaaaaaaagacagtctgtctaatgttccttctcttatttgggtgttttgcttatttggcatccaatccctccgatcattgtttttctgatcgtttctccctcctcaggcattgaggtgctcccgttgatgccgatcagtctgtccgtgatcattctctttacggtcgcttctctcccttttgccatttgactttcgatctgatcaataggtgatcacttcactgaagcgtgaccaaatccggagcaaaccttgggaagcattggtcggcgttttctgtccgatcctttccgtcggcgcttctttcggcacccttttttgggtcatttttggcactttcccttccgtccttttgccatttttatcttctcccctctttcagctcggcttcgaatttctgcccattttggtggtggtcccttttctcattttggccatcggtgttcgatgacgttttcattttcctccactgctgggcacacaccgacccgagcaaagatttgcgcgaacgcgtggcggatctgctcggctcggctggcccatcggttacaatcacttcgttgaccaattggctcagcttcaccatcggaattgcgactccaacgcctgccattcgggcacgttttgaaattggcgacaattagccaatcaattagccaatcacttggcattgcttacccacaaatcatttctcggcaattcatttgccaatttaaccaatctttccctttttagactttttgtttgttcatttcggtggctgtgctttatgcttatttgtaccaattgttcttttacactgctgtgatggttattggggcccaacgcgaagcggacgagcgaaatgcgtatttgccatgcataaaagcgcgtgccgaaaaggtcgccaaaagtggcaacattgaaaaaagattagctttaaatgtttagcacacaatcagcaaaggcaaagcgaatgaaaacgtaggaaaattgagaacaaatttgtggcggttgggctcggatttggtcgaccgatacgtggattttgtgatgagttggaccgctcgcattctgttggccatttctctgatcatttattgggcgttttccgcttatggcggtaattaatttaaaaatattctgacaattaaatgatcaaatgattctttctttttgtatttagttgcccaaattaaagttggactaacgtcggaaaaactgttcctggatgactcgccactactcgaattggtccgtttgcagaacaatgtcattttcaaggagggtggacaggtcggtgctcaaaaatttggcaattataaacgaaatgccatcgacagatggccgtttttgtgaacagtccgggagacttgcgcaaaccgtcggccattccgaaaattatgcgcattttggagcgatttgagcagagcaacggcagcgtgggcccgtcgagcacgcaaatgtggctgaacacgtacttgccattcatcggactgcaagtgagccaaggaatgtgttcattcggtcatttgccattttttgtcagaaccgcggatcgattgacttccgctacaaatacctttacgacttcttttccattcccgagtatcaccggtggagccattttgtcagcttaggccccaaagagtaaaagggaaatgccgacttttcaatgactaattccgagtcccccgaagggattgcttaaacgaacgcccatcctgcattaacaaattcttcttctcgaccggcttccaaaatgccgttgcttggagcgaccgtttggtgttgctgcaacggtggcgccaattagccgctgattattcccagctgaaccttaccgtatacgaggacttcaggtacagtaccaatggtcgtttcgcatgttctgtctcttgtttacagtatgtacgctgatcaattgctcagtattccgtcggtgacaatacaaaccggcgagtcggccttattgtaacgaatgtctttttgtttatccatctttttgcagttgcgttcgcccttctctgcatgactttcgttttggtgatgttcactccttccatcagcaccattttgcccggcaccgcctgcgttttgtccatcaatttgggcgtgttcggactgctcttttattggagcatcgacttggaccccatttccatgaccacaacgtctatttatgaatattctctgtttcatctccccacattttttagtttgatggccattggactgtccgtggacttcgtggctcacatcagcttccattattacaaaggcgagattgaggacagccgagaacggcttcggcacgcgctcagttccatcgcttggcccatgctgcaggccgcgctttcgacggtgctttcgttgatgattttggtactgatccacgcttacatggttcaggtagggaggacatcccggttttcgtattgcttagcaatttcactgtttgttcaggtgttcgtcaaagttgtgctgctcgttgtggtgttaggcctggtccacggattggttgttctacccgttgtttacgctgccattcccttccaaaagtcgggtgccaccgccaacggcacttccgccgaaggttcctccactcaatcgacgacggacagcagtcacataacaaaaacgaaggcgggagatggaaaagaagcaacgggcggcaccaaagggaggacggcacggaaagtgtcgtttaaagacgcactgcgaatagggccaacgcaacagaaagtgcagccgatcaaaatagcggtgaacattttgccaaatgcaaatggtaatggtaattaatgatgccgaatttaggtgggattttctcccgaattacagcggaaggcaaaaacaaaggacgaaaacgaatcggagaaagaagaaaaggaaaaagaatggtttagagacagcagcagaacc

SEQ ID NO: 60229 - DNA, 1590 bp, Heterodera glycines
  Genomic contig location: Contig_ID=SeqID_6077; Location=73..1662; Strand=-
  SCN-specific regions: Sequence locations=1-44,66-518,549-882,904 -915,939-1590
atggcgcaaaaattggctccgattataaacgggtggacaaaatgcctcgatgagttttctgtaatatcgcatcgcatttgagttttgtccacaattgacttttcatcgaaaaagccaacatttattaatgttgtacttcatcatttgcactatgatccccccccctaatttttattttgtggatcaatcaatcgttgtatattaatcattttgatcgacattaatttccatttatttgatcgattatttgttttccattctctttgattgattaactcattcagttcccaccaattggtcgatccctcattttcattcaatctgatcgccttcctcttttttcacattcattttaattggtcactcattttccgttctatttgatccattatccatttcttattctttttttcccattcaatttgatcggtcactcattttcacctctttaatcgatcccccattttccattcaatttgatcgactccgtaacggaccttctcttccgccttctttaatctatcacatttttagtgagtgatcagtcagtcattgatcacttccattgtgccaatgggtcgtcttctctgtttgccgattggcttttccgttgccgattgggcggaagaaaaaacgcaccgcggctttcgtcggctcggccttttcgtttcgcattggccgtggacaacaataatcatatcgtaagtaagcattaattaataaatggagaaaccttcaacctgacataaattattgaatgcagagtgattgtggcgattgttctctcaacgggcgttgtcaatttcaaagaagtgaacaatgtcagggaccatttcaggtgcccttcccctccgccacccccccccctttcgctttggcatttgcttcccccaacttttgcctgtttaatccctctatttgtattcatttatttttgtccgatttgagtgccgacaattcgccaagtcgtcacgaatttcttgtggcgcgcgagtttttcaaggagcttggagggttatttcacgtggtggtggcaattgaagcagccgacggcggaaatttgctgaggccgaggcacaaaattagcacggccagttcagtgtttgtcagttcagtaccatcaaattttaaacgcatttcgaagaaattgtagactgaaccggccatcaaaactgaccttactaccgcaacaattgacacaattgtaatgcttttccgttaagatatattgacaaggctttggaagtggaagattttctccagtacaaactaaaggtgcgatgttccgcttttcatcccatctctaaaaaggcttttcattcctctgatcactttcggacatttctcggcaaaaaggctactcaactgatcagaaattcaggtcgagcatgaaggcgttcagtacgcgtacagcgacttctgcggggcccaatgtgagacgagtgacgcggtgaacattttcctgacggtgttccgcgatgttcagcaccgcggcaagggcaacattaagttaacctttccgaccatcgacgtgttcggccatcgcatttacttggcccacaacatttttcaagtccaactgaacaatcg

SEQ ID NO: 60230 - DNA, 1121 bp, Heterodera glycines
  misc_feature (57)..(57): n is a, c, g, or t
  misc_feature (67)..(67): n is a, c, g, or t
  Genomic contig location: Contig_ID=SeqID_29762; Location=1..1121; Strand=-
  SCN-specific regions: Sequence locations=1-24,46-291,322-673,695 -757,784-948,970-995,1017-1121
  Gene Ontology: Mol. function=zinc ion binding; Cellular component =nucleus; Biological process=regulation of transcription, DNA -dependent
tccattcctctctttccatttgagtctccaccatttcccccatttgagccccccccnccattgagtnccctccccctttcccccatttcctcgctttccatttgagtcccccccatttcctctcttccatttgagtctccaccatttcccccatttgagcccccaccatttgagtccctccccctcccccatttcctctcttccatttgagtcccttacgcctttttcgtttttcagccagttcaattgatcaagtccgaatcgacaagtcctcctccgctgaattctccgactgcttcctcctcctcctcttcctgctctgtttccgattcgatgggccaactcattgtcagtccctcgggcattgctctcgcggcgctgacgtgcaaaaaatgccccggggggcgcacattcgcctcgcaagaaatgttgaacattcattacatcaaaacacaccgcgaccggtcagtccgttaagaggcgaatagtttttggccttttttctcaaatattttttctccgccatttattgccacattttcagtccccaatacgcttgtgtgaaatgcggccaatcgtttagcatcaaacgcgaactgtccacgcaccaccgcattcacagcggtgagcagccgcacaaatgccgtaatttggacaaaacaaacgcaaaatacatgggaaagagttaattttcagttcaatgcggcaaggaattcggcactcgtcaattgctgaagaagcacagcatgtggcacattgggtgagagagaggaggggaatgagtggccaaattggcatgccatcaaatgccaatttaaacaaatttcagaaaacgctctcacacgtgtccccattgtggcaagtccttttttcaggtgctttcgtgccgattagtgtttaaaatgagtttttcaatttgttttcagaagggccatttgacgcagcatttgatgattcacagcggcgaccgaccgcaccaatgcgaactgtgcgacaaaacattcattttcaaattcggtagggcaaaaggccaaagcattgcgacgatgttcaccttttagacttaaataggcacctgaaaatccatcaggaacgcaaattgcatcaaaaaatgcggaaaa

SEQ ID NO: 60231 - DNA, 901 bp, Heterodera glycines
  Genomic contig location: Contig_ID=SeqID_29764; Location=603..1503; Strand=+
  SCN-specific regions: Sequence locations=1-345,367-590,632-634,657-901
atgggcgccgcaaatctcgcatcactttccccatggaatcaagccgcttcaaacaatgagagtgcgaatggaagcggtttcttgaggaatcatcataaatggaccaaatggtcaccaattgttgtgagctttgtgcagcggcttatgaagtaaaatacacttcgttattacaaaatccctgaattttcgaaaaatatcacttcggcttcctcaaaacacataattatgccaaatgatagcgaacatttaaaatcgaaaaacaaagcaaaaaataaacaaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatggcattcattttggcaaaatgcgcatcaattctttgctgtgcagttttgctcgctgttatcatttgtttttccaacaaaaatttgtacagcatttgtataaatgcgatgattttaccgtataaacacagtaatttttcatgcaaaaatattaaaattaaataaaaaattattattttatttatgaatgaatttttgtaacatgtttttcatttactattttaggactaaagcacagtttggcgatgtgcccgataaaataggagtcgtaaagatcgccataatacgaatggtaggccggtttccgggatcgggttatggggatggtatgtttgaatttggggtccgactaaaaagtcgagggtttcggggtgccacacttatccaatggttataaaattgcctctgtttctatattttccaactaccaaataagttttttttgctttgattta

SEQ ID NO: 60232 - DNA, 769 bp, Heterodera glycines
  Genomic contig location: Contig_ID=SeqID_29767; Location=110..878; Strand=-
  SCN-specific regions: Sequence locations=1-296,319-710,734-769
atgacatcgattccaccggcgctagcacaataccaaatttgtccaacgagtccattggaaggatcatccgtgactatgagtttcccagcagagaagaactgtactctcccgactgagacacaaccaatcatgaacaaatcaattctctacatacccatacgaattccgcgttcatttccagtattcaaatgctggaatgttacgacagtggcatgtaccgaatcattcttacgcgtggttactcttgatcatccgccgaagaaattcgaatcggaaacatcactggacgactgtcaaaattctttaaatcatcgtccaatgaacagaataagcgagaaacgctgggaaagttctaaaccaattaggaaggagtacggctggtacggagtgaactgttatgacaatgtccaaacagtcatcgaagaggggactggaggaattttagacggagaaatgctcgtcacatcatggggggattccctaaaaatcgaacaattcacaatcggaaaggatgactggatccgcctgccaggagcagttgaacttttgatgtggcgcattccctcgggagaatattgtgacacgcatttctctatgggaccagtaacaactgagacgtggcccggacaggccgtagtagtccacgaattgcagtacacatttccgataagtaaagaccaagacagaaaaaaccaagtgatcggagtgccaaaggaagcaataaaaacggaaaataatgtcttaattcactacattggagaggccgaaa

SEQ ID NO: 60233 - DNA, 754 bp, Heterodera glycines
  Genomic contig location: Contig_ID=SeqID_29769; Location=207..960; Strand=+
  SCN-specific regions: Sequence locations=1-14,48-257,374-754
atggtaccgacagcggaggaggaggaggcaaagacaaagacggagacggaacatttggaaatgatcgaaagcgaaacggaggaaggaaaagcggggaaagggaaaatgagagtagcggaaaaaggaggaaaagcatcacgattgccgaagatgatgcaacgcaaaggcaaagcgaaggaaagagtggcggaggacggcgataaatggaggaaaatgccgaaaagtccgctgatgtcagtggcacactcagtgaaggtgagagagaaagagagagagagaggggagaaagacagtggagaatcagagagaagagatagaggaatattgagaaagagaaagggagagagagagagggacaaggagaatgagagaggaaagtgatcgaaaaacgaacggactgaccagcagttgcctggctaactaatactgaatgtccttggaattttcatttttcataatttgccataattttgtttagactcggttcactcgtctgaccacgctcagacagtccaaagatgcgttgccgatgagtcgcagtttggaaattggtcgtcagcagagtcggattccgacggtttgcggcggcggcgacccaatgacaaagtcgtggagtttggagacgacagccatgcaaaataacaacaataacaagaacaatagcggctcggaaatgccccgacggggaccaatcaccacattaatgccatccccgcggggaatgccgcggagaatgccgacggagggaggttaa

SEQ ID NO: 60234 - DNA, 5093 bp, Heterodera glycines; identical to SEQ ID NO: 6078
  Genomic contig location: Contig_ID=SeqID_6078; Location=1..5093; Strand=+
  SCN-specific regions: Sequence locations=1-281,303-1131,1400 -1568,1590-1734,1757-1772,1795-2098,2124-2305,2330-2659,2681 -3346,3368-3405,3427-3723,3745-3911,3934-4755,4780-4823,4845-5093
  Gene Ontology: Cellular component=cell wall (sensu Fungi)

SEQ ID NO: 60235 - DNA, 752 bp, Heterodera glycines
  Genomic contig location: Contig_ID=SeqID_6078; Location=2098..2849; Strand=-
  SCN-specific regions: Sequence locations=1-169,191-520,545-726
atggtcagagcaacaacggccaggacaagggcatcagcagcgcgagcacggagcatcaaaatcaatcgtcgaaatgccaagaaggcgcgtgccgcaattggacgagccggacatgtgagtgacgcgcgagggggagagggggcaattaatacactaattaattcaattcggcacccttttttaatttgccaatttttcagacacgcaatgcgatcgcacgggagaagtgcatgatgtgtctgggcaaagtgagctccatgacgcgtgtgaccatgggctgtgtgcacgaatttcatcgcaggtggaggcggggctaattctgatcaatttcgaacccatgggaccccgagttcgaacaagtctaaaagtcgagttttcctggccaaaataccggaagttttgcgtttgctggtcgccgaattcaaaatccgttccgatcaattttaatccatggttccacgatcaattctaaaagtcgagttttcttagcataaattgccttgaacccagtttttttgtcaaaaaaaaaattttttttttttttgggtgaagatttatggattttcaaggcctagaatcccaattttgacatcattatttcggattaatgcaacgcttatcattatctcccctcaaggtgcctgtaccgctggctcaaatacaacaccaactgtcccgtgtgccgcttcaatttcatgcgcgcaattccccctgaagaaccagcggaggaacagcagcaacagcaagaataa

SEQ ID NO: 60236 - DNA, 138 bp, Heterodera glycines
  Genomic contig location: Contig_ID=SeqID_6079; Location=713..850; Strand=+
  SCN-specific regions: Sequence locations=1-9,31-138
atgtctcccattttcttaggtttttacaaaggccttttgccaccgcttgtcatcgaaacgccaaaacgtgcccttaaattcatggcttttgaccgctattggcgtgttctccgttcggatgcgcttcccacttggctg

SEQ ID NO: 60237 - DNA, 588 bp, Heterodera glycines
  Genomic contig location: Contig_ID=SeqID_29772; Location=97..684; Strand=+
  SCN-specific regions: Sequence locations=1-194,220-479,511-588
atggtcgtcaaacatttgaagggagagaagaaggacactccgccaacttacgcagtcgaattcaaagcgagcaacaccaaactgttgagcagacagcaaatttacgatttggttgcgcaactgatgaacgaactgtcaccggaaagtgccgtcaacctcacccagcctgatctgctcgtcattgtgcatgtaaaaaacaaaagcattatttttaatgaatcagatctcattacccaaattcgatgaatattttatgacgtacctgcgttaactaatgaaacaaatattaaactggaaatttttgtggttttgcttttagactattcgcactgttacaatgctttcgattgtcgcaaattattaccaacgccgcaaattcgctttgaaattggcaacggagagcgaaccgaaagagaaaagcaacgaaaaacagaacacgacccatgaagagggagagacttgaaagaattagagatacggccacattccttattatttattttttgatttcattataccctctatcactttactctgtgagaaaaatttaattgtttgctaaatttttggcaagacttccttgaaaaa

SEQ ID NO: 60238 - DNA, 97 bp, Heterodera glycines
  Genomic contig location: Contig_ID=SeqID_29775; Location=33..129; Strand=-
  SCN-specific regions: Sequence locations=1-97
atggctgctccctccattcgtctcatcaccacgtccaaggcgcctcctgcgacgggtcacaggtcggaacaacggaggccatcaaaaccatcttcat

SEQ ID NO: 60239 - DNA, 979 bp, Heterodera glycines
  Genomic contig location: Contig_ID=SeqID_29779; Location=446..1424; Strand=+
  SCN-specific regions: Sequence locations=1-979
  Gene Ontology: Cellular component=mitochondrion; Biological process =polar body extrusion after meiotic divisions
atggcaccgttcgcttttcagtccgatccaaatgtgccgactacaacttatgtgatccgcaaaaagccgcagcaggcgcgggagcccgtttttgtgaacatcgacgacatcgaacagttctcttggatcgaaccattgcaaaaagtggtggaggagcgacttaatgagcccgactataagacaatttggtcggcacactttgttttggtcttttcattggacactcttaaggctgaccagcacgcgcgtgcgtaacaatggcactttgggaatgtctctgtgttttgtcgaggaaaatgccaaatacaaccgattccgcactttggcagacatctctctgaagcccgagaatcggacgggtcctgaaaaattggatttggagtcgaaggaaatccaggaaattttggagttggacttgcacgcaaacaattaccgggacggcgactggggctcaattcggcacattgtagtcaaagaaggtctgtcggttctgtcccttcggacattggccccctgccatttcagtctgattttgttttgattttcagaagatgcgcacagctacaaagaagtggaacatgcattcatcaacacattggtgcgtggcgacgtgtccagcctgacttgggtggagagtggcaaccaatactttgcccaaagccgcgaccaactcggcccgggcctcgagctgtgctcagtgtattacgcggcggtaaacttccgtgacgtaatgttggcatacggacgccttccgccggacgccattccgggccaattcgcggaccgcgagtgccttctcggcatggaatttgccggtcgacttcaaaacgggcgtcgcgtgatgggcattctaccagcacaggcactggccacttcggtggtgtgcaacagagactattgctgggaagtgccagacgggtggacactgaaagaggcggcaacggttccagtcatttacgcgaccgcatattacgcgctg

SEQ ID NO: 60240 - DNA, 536 bp, Heterodera glycines
  misc_feature (496)..(496): n is a, c, g, or t
  Genomic contig location: Contig_ID=SeqID_29781; Location=41..576; Strand=-
  SCN-specific regions: Sequence locations=1-536
ataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggtcagtccccccgaaccgatgcgcccagatttatggggagaccgaatccttcgggaatagcttccctatagcctgtactttaattctgctttggatttttgctccccataanttgttgagtacccccaacgacacttgaaaaatcgattttt

SEQ ID NO: 60241 - DNA, 420 bp, Heterodera glycines
  Genomic contig location: Contig_ID=SeqID_6080; Location=211..630; Strand=+
  SCN-specific regions: Sequence locations=1-49,71-420
gttcaggcctggatccaggtctcgaggagcctggatttttcctggacctggattttcctggatttttgtccaggaaatcaaggtccaggtccaacatggaatccaggtccaggtccaggcttttttcaaaatgtcgatctctagttaatactagataaacttacaaataatatttaactcaaaaaaatagatgtgactaagtatttttgcatcctttttcgaatttaattcgctttttgtaacctaagttttttttgctcctatttttgggtttcaagtcctaatattgtgagaaaaatttgggaatatatgtaggaattggcgagagattgggaacggacagttagagaccggcgagatattggttgccattagcgcccatggcatattacccaaaatctccaaaattatatttaaata

SEQ ID NO: 60242 - DNA, 832 bp, Heterodera glycines
  Genomic contig location: Contig_ID=SeqID_6080; Location=2384..3215; Strand=+
  SCN-specific regions: Sequence locations=1-327,364-539,574-636,693 -727,750-832
atgtgcaattttagcaaaaaatcagctaataaacaagccaaattttacataattcccggctgtgtgttatcgctggatactaatagtcaaggttaggctttattttttatatgtttttatgtgaaaatgttttggcataataagcttttttcattcagagaatatataacgcgcaagatttagttgcacaatagtcggctaaccacaattatcattacaagcgcttggaattatatgtaataaaaattgcaaaattggatataaatatttttaaaaatgccgaaatatgctaaatatattcaaaaactcaaaaatatgtacctaatgtaaataatttttgattttttagaaaaaaatatattagaaaagcatgaaatagggcaagcgcaaaatgccacgaagttaccgaagatcttcgaataacattttgtgtgttttaaaaaatttgtttttataccactttttgaatgccattttatgggtacattttccaattttttgtatttttttaaggaatttctaaaaattcataaaacttcaaaatataaaaaataaaaatatttaataaaaattgcaaaattggggtatttttgatcatttaagaaaaatttccataaataatcttcaaaaatagccatattatttgaaataaatttggtttttaatttattatatattaaattaaatttttactttaacatttgcctatataaatgaaaaacaaaagaaaagtattatttataatattttcagttgaaaaaatacccttactaatcaaaaaagcattcaactaaatgaattgaaaatgggacatcaattataaaagctttaa

SEQ ID NO: 60243 - DNA, 921 bp, Heterodera glycines
  Genomic contig location: Contig_ID=SeqID_6080; Location=3330..4250; Strand=+
  SCN-specific regions: Sequence locations=1-357,402-540,562-867,896-921
atggacaagtgggctgcacttgtgtaagttaattgggtgggggaggggttaattgcccctagaatgaggcaatcaaagcaaaacccgaaaaatactgatcaccaaaacggtttaaatgcgtttaattgatctaaattaaaacaaaaaaaacacgaaaatgagggtttttaatcggtgttaaatgggaaaccgatctagtcctaaacgaatcgagaaacacaggccaaatatagactatctgtccactttcagtctgttgatcgccctgatcaacgcgctggacagcgctgttgttcgacaacagcgcgccgccaacgcggacgcatcgaaaccggaaccgaacaacgaaaagccaggtaaattaaaatgaatttaataaaaaaaatttaatttattaatttgatttaggaaatgtggactcggacaaaggaaattcggacaaaagccagggagcgggtacggaaggaaagaacccggatgagccaaaggaaagccaggaagaggatgaaccaaatccgaagaagccaaaggaaagccaggaagtggaagaggatggaccaaatctggaggagccaaagaagccgggaacgcgggaagcggaaggaacctggaggaaaaaaggccaaggcggaggcggaaagaaaacgggtggaaagggagggaagaacgcgaaaaaaaggggaaagagagcgcccgatgagccggcaccaaagtcgccgaaaatgccggataaatttgacctaaaactgccaagtatgcataaaacactgatcgtcctggggtcagatccaatcttctgacatggcatgttcaggagtggttacatttgttgtctgcatttttttgtagtttttaaatgaaaggtgcaaaaaatatttaattttgtataatataagcaaaaagcaattatttcctatttaa

SEQ ID NO: 60244 - DNA, 1813 bp, Heterodera glycines
  Genomic contig location: Contig_ID=SeqID_6081; Location=402..2214; Strand=+
  SCN-specific regions: Sequence locations=1-331,353-739,781-852,874 -877,899-902,924-1089,1111-1143,1165-1226,1248-1423,1446-1813
gtgtcattctacagtagaggtggctaccaattcgctgccaaaaagtacggtatcgaaaaagaaaaaccaacggaaaacttcaaaaacatggaagaaatcgacgaatacggcttcatgcacggtaagttcttcgcatttaaaaaaggtgctaggtcgtttcgtaaaaaatgtcaatcgaatgataacaaggtttttaaatttgattgtgtttaagaaaggttatttacgagttttctcgaaaaaactgtaaaattgacacttttacgaaatgataggtgaaaatttttaaaggaattttgggatccactagtgcccaaaactgctacaggggaaaatttttattttgtttacaaatttacagaatcccctatgcttacgcccttgtgttggatcatttcacattttgtttggagcttttaattttcaaaaagatttacccattttcgagtctaacttattcgaaaataaaaatcaaaagaatcaattttatgataatgattttttgttttacaaaaaaagggatttacctaaccacatttgcattttttttcgttttcagacatggtgttgctgctgtttgacggttgtgtcatttgtaatggcaaagaagtgcctaatgttacgctgtcactcctccaacatatgccacaggtaaaaaaatatgtttgcccctctttactactatttttacagggaccgttggtcgattcgtgtcaagaatatgttaaacggcccaggtaaaaaacaaataaacagaaaataaatatttgttgaatttgtttttagtaaagcactgattgtgccgatgaagcgagttcaacaagaatcccaaggcaactttgcatacgctgttttgctgatggaacggtacggtaactataaataaatgaatatatactactgtcaataaagaagaaataaaagatcggtaacggcgcacatttacaaatgaccgtattctgaggcatatgcatttattctaacttacggcctaatacgcacaaaaatgattttttaacttcttttgaaacttttcttattttttgtgtctttttgatgtttcatcctttttttcgtgcctttttttaaattcatttgttttgttctatttctggaacgtcaaaaaatgacaaaatcatacttgttttgcatcatagcactaatattttcaaaatgtttgccggcggcctgatcagcatcgccggctcatacaaattagtccttccccagtggtgggaaaagcaaaaaagatcgtatgattaactaaaaacataaaaattcacaaaaaatttcggaaaagaatctttttgaattttaaatggtagacaattttaacaaagattattgtattacaaagactatttctatcagtacgggtttaccaattggaaagaccattttgtgcttttaaaaatgccttttaaggggcgcgcttttttcaaaaataatagattttatgattgggttcattttttaagaaaattaggagtttggggcccggcggtgccgttaggcgccgccgtggaaaattttgagtttttcttagttttttaacagatttttgttcaaaaatgactaaaattttcatcaatctttaaatttaaatgacattatgccataaaattccaaaaatatcataaaatttaagaaatcagaacaaatttggtcactacctcaaaaccagaacatttctgataaatcagaacatatccgagccctgggttaaagtgaaaaattttagcctctgtcctgagaagaaacccgcgaccgacatcgataaccctgccaacaaattctatatgcaaatgctcaa

SEQ ID NO: 60245 - DNA, 623 bp, Heterodera glycines
  Genomic contig location: Contig_ID=SeqID_29782; Location=820..1442; Strand=-
  SCN-specific regions: Sequence locations=1-548,570-623
atggcacgatgtgtcacgtcgctcgcgtttctcccaattggagatttgacccctggaatcattgctctggacatggctcttcccgacgaacttactcccgtccttgactggtaaattgataatctcacaaattgtttactatttattgttctttaattatatataaggttcataatgaaaactacacgggtcgtcttaagcatgatggaaaccgaacacgcccgcgatttgacccaaacatttggagtgtttacactcgaacattgcaaggcgatgaccggacgaataaccattcagaagccgcgaacagacgcctgcaatgcgcatttgcctgttcacatccatcgatttggcatttcattgaccttctgcgaaaggatcgaaatttatccgatgatgacttcgcgaagtgttcaactggacaagaaccaccgcaaaaggcaaagaaatatcgcgaagcagaccgccgaattctcacgatggttcaaaattatttaccacttaataacgtagacactaacattttcccaattcatcaccctttcaatcatcattttattattacatttttgatcggaatttctcgaaattatgaaatgagaccgtgatttgaaacaaataaa

SEQ ID NO: 60246 - DNA, 1248 bp, Heterodera glycines
  Genomic contig location: Contig_ID=SeqID_29785; Location=103..1350; Strand=-
  SCN-specific regions: Sequence locations=1-126,150-875,899-1115,1137 -1172,1196-1248
atggttggtggcaaacccctggccgcctgtggaagcttttcggcacagattgttctcaacaagtaagctcgcttaagcacattatattaatgatacatttattggctactgctgataaagttatctttaatattatgaataatttttaactttagtctggcacttccagaagggagccggagtccatgccgcgcactggcgggacgcgttcttggaatctaaagctaagaacgcatcaacgcgggcggttgctcaggcggctgcgcgtggtgaattcatccgaactccgcagaactcggactacgtccggctccgtgacctcctgccggagcagagggatgttagggaggcagcggccgaggaggtttggtttaatagcgtgtgatagagagataagaggcaatagagatattgaagcgggaatgggagaaagacataagagcaagaataaaaatagtccaaaatcgagttctggaatattaggctaaaatatatacctttatcggaatatgccaataaaggtaattgtcgtatacgtatatttaaatcatttcacgttttccctcaagggtgtaaatagacatttttttaaggacattctcgtcgctggggcgcaggacctgaatgccattaccggcaaaaaggcagcaaaagagtccgagcgccaggagctctgcaaccgactgattgagcgctcgatgcgcgtggcgcgccagatgaagcagttgcagaaacatgtagcttttttaacatgttaaatgataatataactatgttttttagtggcacgaatctactgattcgctgcgcaacgagcgttgggcggttgccagaagagaccgtgaaatcaaggcgctgaagagagagctccgaaaggagcaggtggaaaagcagaaggaaatcgagcatttggaggactgctgcaacgaatatgttcagagcatgcaacgggtatttttgatatctttatgggcagcagtcaatacgggtatcgtttatatacttttttacagatccttcaaatgtctgctacccagcaggggctgttgcgtctctttggcaaagctgcgatcatggcaaagattgaagacagcgaggagttcaacttcctgttggaggaccaggagttgctgaagatcgtcctaggcgaagcgaccgacgtggctgcgaaggctgctaagaagaggaagaagccgggcgccacgccgccgccgcagggggcggttgcgcaacagcagacggtcccag

SEQ ID NO: 60247 - DNA, 951 bp, Heterodera glycines
  Genomic contig location: Contig_ID=SeqID_29788; Location=224..1174; Strand=+
  SCN-specific regions: Sequence locations=1-67,89-265,289-385,410 -873,897-951
atgcttgaacagaaagcatatgtattaaattacatgcccaaaatttaccaagtccatcagaacgagcggaagaaaaagagatgctatttgaacgtaacgattaatgggaaggatgtggaggctctgttcgatactggtgcggacgtaacatacgtcagaaattcaacggcgaaccaatgcatgctcaatgttagacgcggcgatttcccacaagcgcgagctgcaaacaaaacatcgattcgtttcttcggctcagctctggcagaaataaaattgggggaatttgaagggaaattcccgctgctcgttagcgaggatgactgctgcccatgcgcggcaataattggaaccgatctaatggattacataaccgaacaaggcgaggaggaaattggccttaacttcaaaaagggctcggtacgaattggacacatacacctgccaatggtcgcagcagttaccatcgagaagaaaccaattgagattcgtttgctaacaacacagactctgccaccattctccgacacattcgtgtggggacaattgaatcaaagttttgatgctgaaaaaattttcatcacgacggaaagagaacatcagtacttcccactccgggtgggaaagtgtttggccagcccaggctcaacacggaacgcaccattacgcttactaaatttcggaaactgtccgattaaagttcacgccggttcacgattagcgattctggaggcaatcagtgatacaactcaaattaattcattgaaggaggaagacaaaaatgaagacccaaatatcatgaatgaggctgaatggtcaaaatttaaagccgaaatcgatcatatttcaccggaggcagactggacagaccaacctttggaattcccgaaggaagtggagaaaatcaaatccattcttgagagaacatcgcactacatagggtgcccactttaa

SEQ ID NO: 60248 - DNA, 557 bp, Heterodera glycines
  Genomic contig location: Contig_ID=SeqID_29790; Location=71..627; Strand=-
  SCN-specific regions: Sequence locations=1-104,126-190,213-337,361-557
atggatgcgacccaactgacaatgaatgaagtgagtcattagtagggtgaggattttagtggcaaaaatcccaataaaataggctaactagaaagcggcaaaaccatgccaacacaatggaaaatagatcattgatgaaagggtgctatttatcttgtataaaaaaaccatcaaaatgaaaattttaaacataaaattttactcacaaaatttgctcaaacccaactgcaattaattttttatatcattcgatggtccctaacagttctctatttttttaaacttaaccaaattttttgaaatttgcaggcgattcgaaaacatttagcaagatcacttaataaaatatttaaaatttttcaggctaatagagaattttgagggctatcaaaagattaaaaaaaaatttcgatattgcttttgagcaaactttcattcaatttttttaacgccctttttgatgaattttggcttttttataacggatcacaaatcagcatcaatgaaagtgttttttataaatagtaaaatttttagttttgctcaaaacaaataaa

SEQ ID NO: 60249 - DNA, 275 bp, Heterodera glycines
  Genomic contig location: Contig_ID=SeqID_29790; Location=1134..1408; Strand=+
  SCN-specific regions: Sequence locations=1-217,239-275
atggaaatttttgatgaatatattattgttgatgaaaaatcactttcaattaacattggctcaaagttcaatgaagtgactcaattcgctgcaatgtaatttattatatatttaagttttctcattatttttttgggaccaaccgagacgggtaattttggtggtgtcaaacgcataactttctaattaaccacttaaattaattaaataatgtgggattatatttcattaaaatttatgatttttttctcaggtgtttgcctatcgattcttaa

SEQ ID NO: 60250 - DNA, 705 bp, Heterodera glycines
  Genomic contig location: Contig_ID=SeqID_29791; Location=632..1336; Strand=+
  SCN-specific regions: Sequence locations=1-31,53-75,111-154,176 -368,390-437,460-559,581-705
atgaaaactcttcgcagtcaagcgggccgccaatcgatgccaatggtggtgaattttggccgggtgggtaaaaactttttattttactattttaaattttcaaagtatttcagactggggacgcgcaaaggactggacaagtcgggggccgccgatcgatgccaccctctgttgtgccggcgaatttgggtggcgtgccgccataccaggtacaaacacaacaaatcccttcgcttccctttcttataccatttttttttaaaaaaggagccgcaaacgcagcgcgaggtgatttacgatgtgcctgcggatggtatgctggaagacgacgacgatgacagtttttgaacgatgagccgatacaacaatgagctttaattcctcataaatttttataaaatttgggaattttcatttcacatttaacaaattttggctaataaatgtaattcaaaatgattaattggcaatttataggagaccactaaataggagaaatttcaaatgttttactgttgggtattcagaacgttaggcgagattaatgctctttacgcaaaattttgaattttaagcatttgatataatctttttgaatgattaatgtgtgatatagtggagaaaatctgtcggtacatcaaatgagcaatttgtttaaaaatgggtcacatccattatcgggaattcgggatgctttggtgcata

SEQ ID NO: 60251 - DNA, 1941 bp, Heterodera glycines
  Genomic contig location: Contig_ID=SeqID_6082; Location=157..2097; Strand=+
  SCN-specific regions: Sequence locations=1-299,321-1685,1717 -1912,1934-1941
atgcttccgccgtcggtcggcggtggttggcccaccgcttacgcgacacagcagcaacagtcgatcaatgccgtcacttcgtcatcggcaaaactgctgccccagcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacagcagcaacagccgatcgactccattccgtcatcgtcgtcatggaattttggccaacagcagcaataccaatttgcggcagatctatcacaacaacaccacaaagtaaaaaacttcggtttgagagaggaggtggtggatgggtagccccaatcaaagaatattttagatgtcgtccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtatatgggtagcaccactcaaggaatattaatattttagatggcgggccccacttcatcaacggcagctttgaacccaacgctgttcgttccgactgccaaagttttggaccccgaattggttagcaaataatcattaatttgaattagggaagttacttagacacacaggagggcattagttttgcatatccaaaatgaagcctcttaatttttgtgagtgaaattatggatgacttataaaactgtatcaaaattaaatggttgtggtactcatttggtggtgccgaagatgacccatattgatttgttcaacaaaataatggtcattttcgatttgcatctctttatatcatggaaatgttttctctaaattcgcttttttccttcccaatctccgctcttttcggttttagaatgtattaccctaaaatgattaggcttccgtctgaacttatttccgaattggcgagtgctcttccccttgacccccgctgggccgtcatccgtgtgtcttcggcctttgattttttcgtttatacaaaacagataatttataggaagataaatagccaggaatttaaatttgtcttacattattttaattgttcccacttttaggtggatgaagggcttaaaaaagcaaagcaacaagtttcgtcagttgccaatgctcagtccagtgacgaacaacgacgaaaactgctcacaggttggaaccatcgatgttattttgtatagcctaatagaggctttaccattttgtgttgttgactttatctggtaaaagtcggcatttgttttagaaatcgcggcgtttttcaaaaacaaaacttcagaggctgaagtgattttaagcaccgcagtgtcaacggatgtgaattcatttaaatgtgtgtgcacgcatctttacactcttttggggaaggaggaccaagcaaaagaagcattcacaaattgtaattttggttatggaaatttacatttagaataacaatttcagttcttcttgaattgtgtggagctttctctgtgccttcggtaaattgagtctttttgggcggcctaattttaatcggggcatggtcattcctgtttgtcttttccatttcaaatgaaatttgaaaaaatttatcattacctcatccgtattcaagatactgagcgctggcggtcatgagaacatttcaaaagctttacaaaaaagtttcgagcaagcggaaatctgttgctgcttttgcaaaaaaaatgtgcttttagccaacctctgttattgtagccttgcccaagaaaaatgtcatcaccaatttgagttaattggtttaaaagattaaatatcaaaaaa

SEQ ID NO: 60252 - DNA, 927 bp, Heterodera glycines
  Genomic contig location: Contig_ID=SeqID_6083; Location=809..1735; Strand=+
  SCN-specific regions: Sequence locations=1-274,296-927
atggactcactttttgatgccggcaaaaacgagggacgaaaaaaggatgaggccaatggagggggagatgggaatatgctgagaaatggacagcggaagagaagccagagaaaagatgaggaacaccaagttgaagcgcaaaatgaaccaaacgccgacaaagccacggtaacggtaaattggggtcctaaaaaggagggaaatggggaaagaacccaaaatcctggagcaaaatgaaagattgataacgaattagggatgggacttccaaaacaaattgaaaatgtaaaaaattctaattttcagtcatttaatttaatttggccccattttaaagtgccaccaaaccatgcattttcggctgtcgctttctctttcagtgccaattcgtcagccgtccattccatgggttggacagactcttcaacgagccggacattcttcgaatcagacgacagtggcatgccactcagaaagtgtgttggtcggttgggagttttgccgaaaagggacggaaggcaaaatgaaattcgatggacggaacgaaaggcattggccaagggaatggccgagacatttggaatgaacagctgtctagcacaaaaatgcatctgaagaatctgataatgtgaaatggattcgtattgtaaaatgcatgacttttatgtattttaagggtagttctagagaatacaaaatgagtagtgaactgaacccttttaaaatttaaatataagaaactttttactgacaatgaattactttttttaattatataaacataaagccagagtaaaaatttaaatttatttagtaggagaaaaagaacggattaatggatttgtaacttctgtagtgataacgatggtctgaattttaatggttagcgttacaagttgtaacactaaaaaaaattccaaatatgca

SEQ ID NO: 60253 - DNA, 862 bp, Heterodera glycines
  Genomic contig location: Contig_ID=SeqID_6083; Location=570..1431; Strand=-
  SCN-specific regions: Sequence locations=1-328,350-627,650-862
cagattcttcagatgcatttttgtgctagacagctgttcattccaaatgtctcggccattcccttggccaatgcctttcgttccgtccatcgaatttcattttgccttccgtcccttttcggcaaaactcccaaccgaccaacacactttctgagtggcatgccactgtcgtctgattcgaagaatgtccggctcgttgaagagtctgtccaacccatggaatggacggctgacgaattggcactgaaagagaaagcgacagccgaaaatgcatggtttggtggcactttaaaatggggccaaattaaattaaatgactgaaaattagaattttttacattttcaatttgttttggaagtcccatccctaattcgttatcaatctttcattttgctccaggattttgggttctttccccatttccctcctttttaggaccccaatttaccgttaccgtggctttgtcggcgtttggttcattttgcgcttcaacttggtgttcctcatcttttctctggcttctcttccgctgtccatttctcagcatattcccatctccccctccattggcctcatccttttttcgtccctcgtttttgccggcatcaaaaagtgagtccattttcgttttctctttaattttccatttttactcccccccgtttcgtcacagatatttcacgcgaattgtcgccgtcgtttccgtggacaccgcctccaggtccatctatcgcattggctacccctccgtttttgccacacggcgcagtcgcttcgcccgctttttggacgttcagccgttgtccaccaattcggacagtgtgcgaggcgttgcacgccttcgctttaccgatgggtttg

SEQ ID NO: 60254 - DNA, 1214 bp, Heterodera glycines
  misc_feature (1089)..(1089): n is a, c, g, or t
  misc_feature (1211)..(1211): n is a, c, g, or t
  Genomic contig location: Contig_ID=SeqID_29794; Location=119..1332; Strand=+
  SCN-specific regions: Sequence locations=1-68,90-320,342-772,794 -924,946-1099,1206-1214
atggaacagttcctcaagcaggagaatctcgactaccaagtacagtcgaccgacttcatgacccaggccaactcattggaggactttttcggcaaagtggtggtggacaacatcgtacaagagaagaaggtgcgtttggcatctgatcaccgatctgtcactgttgatctgactcattgggccttctgttcctgatcatttagggctttgaatttgcatgttttggtgtgatatttgtggtcattgatcacgattatggcatgcatttatgcgcatattccgaatgccggatccgaatcgaacaaaaagtcgagaattcatatttttactcaaaattaattcaagcaaaaattagttacaaaccattatagcatcaaaattagtcatcattctgtacatattttaacatacctacatatatattcaaaaattgggggtttcgactttttgttcgagttccggtccacgaattcggaatagccaaaaggcatgccatcttcatgatcaaaaatgaatgctcaattagctggatatggttaactgattggactcataggatgcattagagctgaattcgagccatgacagaccaatgatccctgaattctgcttgattcgttagtttagtgattctaactttcctctgttttcagaaggcttacgctaaacagccgaacgacatgaagggcatcgccgttaattgggacaaatggcccaacgtcgccagaaaggttgaggatgccaatgtagcgtccaaggtgggaaactgtgtccccatttaaacagtttaataacgcacaattcgattccacagattggcatcaaaccaatggtcgcaaaggcgggcggcgtcactttgttgggtcagtcgacgctggcggggtcggcccacggcaaaacgaaagtgcgttcattttgagggcattttattaaaaaaccaatataattgaatatgttttaagcgcgtttctcagaagaagcccggtaccatcagcaaacagttgggcagtggcacatcggtgacgcaaaaatcttcggcgacggaatcggcggccaaaagtacgacgcaaaaatcttcggctacgctgngccaaaagtcggaggcggaccgggagaagtcgaagaaggaggaggagacggaaaccgaaacggacgaggaggaggaaacgacggacaatgagggaagaggaggaagaaggcgaggaaagtgntga

SEQ ID NO: 60255 - DNA, 420 bp, Heterodera glycines
  Genomic contig location: Contig_ID=SeqID_29795; Location=105..524; Strand=-
  SCN-specific regions: Sequence locations=1-147,169-359,398-420
atgacaattgtaatggtgtgccggttccgtttcgttttggcacttgttgtcacggaaattcatcgccacattgacaagtggtaagggtttatttaaaaaaaatgcctgatctgagcaatttggacagatccctgactatttatgatgtatttttctaataattcaattttcttggttgaatttttgggacaatttgaactattttcatcaatttgataaaaaaaatccacttgaaatacgtaggtctatcatccgtcgactgacctaaaaattacattttttttctaaattgtcaaaaaacctagtttagaacaaaagtatgtaactacattgtaagaccacaaaatagaattggaagcattttatagaaaattaattaaattaattaaaaattttagtgttttccattctttacaatga

SEQ ID NO: 60256 - DNA, 435 bp, Heterodera glycines
  Genomic contig location: Contig_ID=SeqID_29795; Location=822..1256; Strand=-
  SCN-specific regions: Sequence locations=1-435
atggcattttttccagagttgcaatgttggcacggcttttctgccgaagcggaacttaaagtgtaccttcccgaattgggccttcataacagtggcattcatatgcccttgaaaacatattccgtaacgaaatcgacaaaaaattgcccaaatcatctgctcaaatgctacaaatcccaatgcatcatttcaaaagatgccattatcgaacgcattgataagaaactgtttccggaaaatgccacttacgaagtggagggcacggaattggaaggtgaacgaactgctgagaattttgatcagattatctatccatcagagatcagcattatgctggcaaggaaaatgggatcaaaattttgcaaattaacacattactgggcaaaaaaaaaaagaaagtttaaaatattttgaaaaattgacctacatattaaa

SEQ ID NO: 60257 - DNA, 427 bp, Heterodera glycines
  Genomic contig location: Contig_ID=SeqID_29796; Location=718..1144; Strand=-
  SCN-specific regions: Sequence locations=1-149,180-427
atggccgcagcggcttactcatttttggcaatgcatgacgcggatgacgggccagcgcttgccggcatcaacctgaactatcggcacatggtgttcatgtaccatgacaagcgacgagcgttgaacaagccgccaagcagcggtcgcaagggcggtgccggcggcggtggtggcagcgcggactcgccgccctcctccgcggttgctgcacagctggacgagtcgccatccagcagttgctacttctcgctacatgccatcaaattctacttccaggtcgtccatcgtcatgccgtgtcaaaatatcgcaaaaaaaaaaaaacaactaaaaattgctactttttcaatgtaaaatttgcaaaaaacaaccccagttcatgtgggtgcgccccaaaatttcgtcgccgaatttaaaaaaaaaattaaa

SEQ ID NO: 60258 - DNA, 117 bp, Heterodera glycines
  Genomic contig location: Contig_ID=SeqID_29799; Location=839..955; Strand=+
  SCN-specific regions: Sequence locations=1-117
atgacagagcaaatgtgccgaatcagcgcagaacgaaccgttgggcaacaaattgaggcggtgatgacgtatttggccaatgtacggggcgaagtgtacgaaaatgcgatgtgttgg

SEQ ID NO: 60259 - DNA, 652 bp, Heterodera glycines
  Genomic contig location: Contig_ID=SeqID_29799; Location=128..779; Strand=-
  SCN-specific regions: Sequence locations=1-34,75-304,329-344,444 -540,564-652
tcacagtaatcattttcctatcaaaaaaagaaagaaaattattacaaagaaaatttatttattttttttaaattgcaaaaacaaaattctgcagctttttggggcctttcattttttggagtgttttttatttgtcccttggcactgagtgagcggaaatatgaaaatttttgttctgcaaaatggctttttgtgggcatcagcggacggaatgatggacaaatgttggattattcaatgaatgaatcggcggacggacggcagaaaaaatattgccattttttgtccgatgaatttaaattccattggaaaaaataagggggagaaatggacaaagaaagggaaacgaacggacgaacgaacgaatgggagaaaagaaaaagcgaacgatgggacggacaaatgatcaaaaaaaacaccgcaaaaacggaaaagcgaaggaagagaagaggagccattccattcattcaattgaattcaaattgagaaattgcaacaaattgtggtcggccgaaggaaagggaaatcgtcggacaattttaatgaaaaataaaatccaaaaatgaattaaataacgataagaagaagagaaggcaattaaatatccgaaaaatataattaaaaccgacccaaaattgtcccaattataaaa

SEQ ID NO: 60260 - DNA, 481 bp, Heterodera glycines
  Genomic contig location: Contig_ID=SeqID_29800; Location=22..502; Strand=+
  SCN-specific regions: Sequence locations=1-327,349-481
atggctagatgcaccgtcacacgtacagtcacttcgaaccgtttaaaccatacaatttttccctttttaagttcttaacgtataaaatggtttcattgtcaacatgttcttccaaataccgttgttttatttagaaattcctaaaaacaattgttatttcagatccaattaatcagtgttgcaaggaccatgacaagtatgtttgaagaaattatgaaaaaaaacgaaaattttgttgaataagatgaaaaataatttattaatgcactccaaaaccgaagcgcctcgttgtttaagtttttttagtcccataaagtataaacatatgaaaatgaagaaaaaattaaacatttaaatgctttttttcctgaaatttcaaaatgcttcgattaaaaaaaaagtttcaatttttcgattagacaaaattgagggaaaaaaaatttttacatgagtgataaaacgcatgacaaaacaacaaaaa

SEQ ID NO: 60261 - DNA, 318 bp, Heterodera glycines
  Genomic contig location: Contig_ID=SeqID_29801; Location=331..648; Strand=+
  SCN-specific regions: Sequence locations=1-127,174-179,201-318
atgaatcgaacagccgttcccgaagagaatggcaaaatggagcacacttttgaacgcatgggcaacattcagtggggcgttggagaattggagtgggaggcatggatgcgccagttggacggaaccgtaattaattattatgtaataattaaatttaattttttaaattttttccaattctaagggctaccaaactggacacaagtacagattgccaattctgctcgaaccaatgacgaaaaagaaatgaatgaacaattaatacaatagagagatatttaacctaatgcaaggatattaattctataatttaatata

SEQ ID NO: 60262 - DNA, 2751 bp, Heterodera glycines
  Genomic contig location: Contig_ID=SeqID_6085; Location=618..3368; Strand=+
  SCN-specific regions: Sequence locations=1-7,44-389,451-605,627 -900,936-984,1030-1195,1235-1247,1270-1306,1329-1379,1403-1474,1533 -1541,1563-1601,1624-1770,1793-1965,1987-2081,2367-2751
atgttggatttggttggcaaagaaaaaagttatagccaaaaaatcggctggggccgaaccgtgcggggccgaactgaggtagaccggcagggaatggaaaaaatgcttagaattggatgggaaacgaacccatgcctgcaccccatttcgtagtggcaaattttattgaaaattccaataaatttcaaataccgtaattttaatttattgtgagtaattagctgatgaaattttcatctttcaacgttttgatgaaaaggcacgtcagcggattacacaattaaattgtcaatttgtccacctttttcagttggtcgttgacattttggccaccgccgggttcattttggacgcggaatcggcattgaaattgcgttggttttttgtacaataaaaaataattaattttaaaaaaatatattttctctctaaaataaataatttaaaaatgcaattcaatttttaaggcttttatattgtctcatttcttaattatgcttttccaaattcagaagaattgtccgccagtgcccttccgccctttgcttccgtcgatggttcgtcccaatttgtgccgcccgccaccaccaccaccaccgccgccccgttggcacttgagtcaagcacagttgagcagcagcaggcacagccaaacccattcaaagccgcaccaccgtactccgtgtacgacatcgccaacggcaactttacagtactcggctgcaccgcgcaacgaccgtacctttttctcacgctaatcgcacgccaatgggccgcactgttgatgctgttcatgggcctggaacgacttctgtttgtcctctacccgctgtggcttcgctccattcaaatgaagtgagaaaaaaatgatataaaaagcgatagcattttagggctcggatttatatatttatatatgtatattaaaaaaaattggaaatgttttatggaagcaaaagattttctaattttgattaaataaggaaaaaattttatataattaattcttttttttttacaaaattttttggcgaaaaatgttcattttgtcaacataaattaaggccctagcaatttggacaaaaaaccaaaatattcacaaaataagcaaggaaattttagggcttgacgctattttatatatgaaaatttcaaaaaagcaaaaactttttctgctttttatgattaggtcaagaaaaattgaaataatttaaaaattttacaaaatatttaacgaaaaattgtcaattttaacaacattaattcaggctctggtaatttaaacaaaaagataccattaattttgattttcattatttaactttatgataaggttattttataaattaaaacctaaaaatagtcacaacataaaaatgggaaattaaaattttcatttttgtgaattgactaattgcttcctgatcactttaagtagcttttagcttttggacatacatatatgtaatctttcaaatttatgatttatttttttattccaaatttaatttcattttaaattttataattttgcttacaaagtcaattaattaatttaatttgattaagtgtggccccacttaacgtgttcaccgttttctttgccctcttctccactggcattgcctacacaaatgccacttatgtggcggcctatgagcaaacgcacttttcgtgtgaagcgacttgggcattcggcgaagactatgggtaaaataaaggacaaaaaaaattggcgaaaaatgaaaaaaaccatttttgaattttattaaaattccaaatggggaaaggacacttttggtttgcaatttttttgtaaaaaataagtcgtgaaaaattctttctaggcttttcggggcctcaaattacgaatccgacatcacttttgaccagttcctaatctctaacttgactcgaaaaaagttgaaaatttccatttttaaaaattaaggtaggttagcgattcggaattggttgaattatatgtcagattcgtgatcagggattcggaaacattcggaatcacttttcttacagttagatatcatcttataaaatttgcaaaccaatccgattttactttttattttatttaattgggttttcattttctttttaattcattttaatttatttttctttttacttttaaatttattttagttgattttccttttttcctttttaaatgttttttaaatttatttggttgattttctttttaatttcttttaattatttcttttaatttattattttaatttggttttaattttgatttagttttatttatttttttcctttttatttttaaattatttactttttaatttttttaaaattcttattttagttggtttttctttggcattgtcatcgctccccaggccttcggctgtctgttctgcattattgcctatttcatggtccaccatgaacatgcactgagaaaatttgggggcaatcgcctgaaattagccagcgaaaagagaaaacttaggtttttttttgcaaataattatcaattttttacaaaaatttaatttcaggaaaatcaaatggcttctgatcacttcctcctcattcgtcgcttttccccaaatgcttttgctttttctccaattaattgctccacaagaaatgtttctgatcaaaatgctcatctcccaactgttcttggccaaatgtttcggcaacattttgatgtacaatcgagcgattgcttcaacacgatttgggttcattgaaatg

SEQ ID NO: 60263 - DNA, 83 bp, Heterodera glycines
  Genomic contig location: Contig_ID=SeqID_6085; Location=375..457; Strand=+
  SCN-specific regions: Sequence locations=1-25,47-83
aaaaataggcttagaatcacatttgaatattttacaaattaatttttgatatatcattttttgaaaaaatcgattttttaggg

SEQ ID NO: 60264 - DNA, 1009 bp, Heterodera glycines
  Genomic contig location: Contig_ID=SeqID_29802; Location=125..1133; Strand=-
  SCN-specific regions: Sequence locations=1-68,90-696,718-849,876 -958,1001-1009
agcactttctgaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 60265 - DNA, 601 bp, Heterodera glycines
  Genomic contig location: Contig_ID=SeqID_29805; Location=236..836; Strand=-
  SCN-specific regions: Sequence locations=1-70,92-233,256-265,323-575
atgggcgaaatggttgtcaatgagatcgaatgggcgcgtatcgaacgcccattggacgatacacaattggcatttgccgttcaaaatgacatgcacttaaaaaagcggacagacggcgccacaactttggatttggaagcgtttatgatgaacccattctttgtgcgaatgatccaagatgaaaaaatcaaacaaattttgtgcagaattctctttgatgaaagaggtgggcaatgaaaaataaaggagggggaaattgggatactaattaaattttttacgttaaaatttaattaaatgaaatagtctaaaaataaataaagattttgttaaaagagtagggtggcaatttttttgtcttggccattttttaaaaaatgattattttttgtacagacatatatatatatataacttattttactctggaaattactatttttttgtatcgttgagaattatttcaggcatgctaaaatacggatatccacagacaaaaatttccaatttgatgataagtcttagtttgaataaattaaaaatttctcaaaaaaccctgccagggttaactaccttttgaaatttttctttttaaaataaa

SEQ ID NO: 60266 - DNA, 49 bp, Heterodera glycines; identical to SEQ ID NO: 51181
  Genomic contig location: Contig_ID=SeqID_29807; Location=734..782; Strand=-
  SCN-specific regions: Sequence locations=1-49

SEQ ID NO: 60267 - DNA, 1307 bp, Heterodera glycines
  Genomic contig location: Contig_ID=SeqID_29809; Location=629..1935; Strand=+
  SCN-specific regions: Sequence locations=1-120,142-517,539-1307
atggtcgaacacttagcgttggtggcgccaatagtcaatgcaggtttggggcgtctcgaaaattttggaagaaatatgggagaaataaatggcggcgaaataaggaatttgccaccaattggccacctttttgaaagaaatggagattttgaggatagttgggttcgggaaagacctccactgaactcaccgctattcgagtcaattcgccacgcgtatttgaatgtgggtagagccgaaaacaggggtcatcatttaccgccgagttttccaaatcgtgccgtcgaagcgtatgccaccggtggtcagccaactgcacactacacgcgagcccacgttatccaacaactgcacacgttctatacgcagccgattgcagtaaaaccgaccgtagtgcaataccaagcccatttacagcaacaatttgctcccgcggcaccaaatcgcatccatagtcctgtctcagcaaatttcaaccgtgatgcgaacattggtcgaaaccaacaaccgcagacttttcaacataaagaaaggggccaacaggtccacaaacaaattgcttatgcgagtcatgaccatttgccattccaaaaaggcacaaactcccgggatggaaattttgggcaaataaaccccgtgaatgaacaaaatcgttactatcagagtaaccaagtcgaccccaacatgataatggcgcagaccattaaaagtcttgacaatttctcgtactcaatgacgctccaccatttgccagagctgagaggaaatgccggagcggacgaagtgaatgtcttttttcgccagttggacgcagttagcgaagattggcccaacgataagcgcttaagcgccgcgttaaagtcaaattctcgggtaggtcagaacgcgcaaccaattccgccgttgccaacaatcccttccggtatgaaaatatccgaagagcgatgaaacaacaactcgattcaacggatgcgaagtcaacctgtgcttttgatgagttgatggcaggtgtccgcagaaggaacggagaaagcattgacgatttggcggaccgagtctcatcgttagtgcgaagggcataccccgggctcggcgaacattcatatgatgattattcgatccgacacctcatccgctcactcaaaaatccggatttggcactcactttggaactggcacgcaaacacgatatgatcttcgacgaattcgtggccatggcagctcgcgcggagatcacacaaaaattcgcaaaagcagccgagcaaaaagacacaaattttcgccaaaattttgatcagcgtcagcaa

SEQ ID NO: 60268 - DNA, 1956 bp, Heterodera glycines
  Genomic contig location: Contig_ID=SeqID_6086; Location=2583..4538; Strand=-
  SCN-specific regions: Sequence locations=1-121,143-311,334-345,419 -423,445-460,522-697,719-853,875-935,958-1117,1154-1304,1326 -1375,1397-1498,1520-1608,1630-1870,1892-1912,1937-1956
atggcgaaaattcttagcaaaattgatgacaatggagacattagctcagccgatcagacgtcggagtaccgaatttttcaatttgttttgcaatttttgacaaagtgcaatttgactgaacaaaacaaaataaatgttcaaaattgcttttgcattttgtcattttttgttgagcaattattggaaaatgcaattaacgcaaagcattttccattggttggcattgaatccatttcgatggcacgtgaacgctttgctgagaagcagcagcaattgtgcgcggacaaaaggtcagtggttttgtagttaccgtagtaaaagtagacaaaataattacagtaaacatttttttatatatatatttttttgtcttttttttggtttttttaattccttttttttattagttatttttgttcgtaggttttttccacgattgcatttagattttttaatgatattttttttattttttcttaccttcttttttttcttctttttgccttttttcttatttttttaaaaaaaaaagaaattttctatgataattttagagtctatagtattcattattctattagcaactgaaaattgagtaaagagaaacaggataaaaaccacaactgcatacaaaaaaaaaataaacaaaaaatacaccttttttatttcaaaaatccaaattcgtgtattttactgatccaaaaatccccaacatttgaaatattagcgttaatttatgaattgtctaattttcaaaaaaaaaaaaaaatcgattcgtctattatagcaatcgtatgttgataaaacggaaatttcatccaaacaacataattcgttaatttaatgtttaagcataagcaaagaaataagaaaatattttggcgaaagcattgtaaacttcgcaaaagcagttgaacttgactttgattttgacaatggtattataataaaattgaaattgaaaaaaagattatatattctttacaaaattagggataagcctggctttagaatggaattttgattttttaaatcttggataatgtgataagtaaagcggatttgtattgtttcatattttgcactaattcgaccaaaacatcaattaataaaaacttttgatttggtttgttatttttataaacatttttcagatttttgtccctatttaaggctcttatcacatgaaatttcgaaaaaaaaaacactaaaatgatcaaaaattaaaaaaataccgaaaattcaaaaaattcgaaaatttttaactttttcatgttcaaccttccaatttaaaacacattttctttaacacttatttttccaataaaaaaacttctttattgaatcaacaactgattcatcggacattgaattcttatatattttttttatttttcaagaattaaaatgattttttgcttctagtctcgaaatttaattggtaaagatatgataattcagtttttgagcttttttgttttgggtttgccttttgttgtcaattgggaaaaaattaattttgtctaatttcaattatatgatcaattcttacagatatacaacaaatcgttcccgtcttattaatgcaattcgaaaaattgaaagaaaacaaagtttggaataatgcaaacccgaaattttttaaaacggttgaatggaatttgctcgaatttgagctgaaagcaagtgataaaaaagaaaaatgggaacaaattgaaaaattgagaaacaattgggaggacacatttggaaagatggaacaggaaaatgcaaaatttgaagaaaaaatgcaaaatttaaaagaatatttaggaaaaatgaaacaagaaaaatctgtatcaaggaaaaagcaattgcaagtgaaatttattgaaaagtgagaaaagaaaaattcgaaagattgtgcgatgtcattttatttttaagagaaaaattagagattttctttccattaaa

SEQ ID NO: 60269 - DNA, 1119 bp, Heterodera glycines
  Genomic contig location: Contig_ID=SeqID_6087; Location=117..1235; Strand=-
  SCN-specific regions: Sequence locations=1-21,44-266,288-405,448 -510,532-707,734-757,779-781,808-818,840-975,1006-1028,1109-1119
atgcataatttcttgaaagatacggaaaagcaaaaaataaaattcagtcaaattttatttgaaactgtcaccaaatacaatgacaatgtgaattatgatgaacaccgacagctaatttcattcccactttcgatgggtgtacatttagttaagcgattcagtgcactaattacattaattagtcagaggtgagcattttgcatttaattgtattatttagagaacggggatgaagtgcgcttataggggctgtggtcgaaaatggcactttattagcagtttttcatcaaaaaacgaccaatttatgcatttttggacaattttaaaaattgcaaattgaaaaaaataatttgctattatttccctattttctaaacaaaatacttttgtcaagtgcgaatcgggattatttataataataattttatttttcaattattatattttgtttttcaattattgaacttctactccaattgaccgaatttgttggatggaaatggattttgagaaaacattgcaaaatatttcttcagaggaaccgcttcagctacataagccactaatgacattagataattatcaatgggtcaatttcaaattgtttcttacattggcaattcgattaagtactcaaattgagcaaatcggactttttttgagcacattaatctccgccaacaacaattgttatgcgtcatatgagtaagaaaaacaaaaacataattttattcacaaatggaaaaagatgaatttaaatttgttcttttttcctagtgtcatttaaatttttaaattatttaatttctctaaagttctaaatatgtgaataaacagaaaatatgttattaaaaattgatcaagattttctttactctttactagtttaggttttttgattacaaaattcaaattcgggacaacaatttgctggaaataaattctccgacttggcttctgccttattatgtgaattatgaaaatgaaaatgaaataaaacagaaagaagctaaaggtaaaagcataactaattaatttaatttttaaataaatttaaatattattaattttgtcaatattttctagaaatttattaatttttaaaaatggttcattaaa

SEQ ID NO: 60270 - DNA, 476 bp, Heterodera glycines
  Genomic contig location: Contig_ID=SeqID_29814; Location=285..760; Strand=+
  SCN-specific regions: Sequence locations=1-163,189-476
atgtatgctgccgcaaaagaacaaaaagttagtcaaaaaagaagtgcttcagtatttaatgaggaatcatcttcccaacaaccattaaaacaatatctactagttctatagtcagcggtcgtcaataaaaaggaaaaatgatacagaacaaataaacaccccgataaataataaataacaaaaattgaagaaaaacttttggttaacaaattacacttatcggaaaaagattgcaaattaactgaacctaattgttaacaatgtttcggtgtgaagttagtatagaattaatgtcaagtatttttgcgtgtctctgctcaaacaaagaattgatccacatttgaatcggcgaatcaagtgtcaatttcaaatccgatccgattattataccggccaattcaccggcaaggttcagcactgctcctccggaacttccaacgttgcttcccggagttcctactaaacagcaaaattta

SEQ ID NO: 60271 - DNA, 56 bp, Heterodera glycines; identical to SEQ ID NO: 52733
  Genomic contig location: Contig_ID=SeqID_29816; Location=162..217; Strand=+
  SCN-specific regions: Sequence locations=1-56

SEQ ID NO: 60272 - DNA, 558 bp, Heterodera glycines
  Genomic contig location: Contig_ID=SeqID_29819; Location=338..895; Strand=+
  SCN-specific regions: Sequence locations=1-27,63-75,222-558
atggaaagaatttcactttttgtcaatattgccggcattgtgttcatctttttctgtattggaaggtgatagccctataatttaatattaaaaaaaacagtaaaacttttttttaatagaattaaatatctaaaataattatttttatttgtttagtaattaatttttgttaattaataagttattttgattaaaaaatatctttaattaaaatattttttccattttagtgatgccgtttcaatttcggactgtgccgaacggcgctttcccggctccgaatcatttgtctgtgtgtgcaatcggacattctgcgacctgccaattgggccccatcggttgggcaaaaatgacaacaatgccattgtgtacatttcggacccggccaaattccgtctccatcaacagcaagtgccaattgaggtggaatacagtgaccaaaatcgtcggaaggataagccgcagcgcatttgctcatcggatgacgaaggtatggaaaaaccagcacattttggcagtaataattcagacctggcaaatgccatcaaaaaatgttaa

SEQ ID NO: 60273 - DNA, 336 bp, Heterodera glycines
  misc_feature (50)..(50): n is a, c, g, or t
  Genomic contig location: Contig_ID=SeqID_29819; Location=1289..1624; Strand=-
  SCN-specific regions: Sequence locations=1-170,192-336
atgaagggatcgaaaccgttaaaggattcttcaaaagagtatcaaacagntctgggctctggcggtgcgttcactgacgcggctggcgtcaatttgaacgcgttgagcaacaccacgcgtgcaacactgttgcgtgcctattttgacaaggacattggtgggtttggcacaatagaaaccttaaatttaaattggaatttttcataaaattagtgtaattagatttaaactatttttctggttattcttatcagcactcaaaaatatgagaattaatatttcagcgacattttttacgcttttatggaagacataataaaaaaaatagaaaataaa

SEQ ID NO: 60274 - DNA, 221 bp, Heterodera glycines
  Genomic contig location: Contig_ID=SeqID_29821; Location=1..221; Strand=-
  SCN-specific regions: Sequence locations=1-221
ccgggactcaaatgtcccgcttaggccaaaaattttttctatttccgggaaaaaatcgaaaattttccgaaaaaaataccagtcgatagagctcgaaaaactatgttttggaagtggccttcgtttttctgggaaaattcgttaaaaaatcctaaaattcaaaaacccgaaaaccgttttttaagcctagctcgaaaaattttgaaaattttcgaaatttt

SEQ ID NO: 60275 - DNA, 453 bp, Heterodera glycines
  Genomic contig location: Contig_ID=SeqID_66; Location=359..811; Strand=+
  SCN-specific regions: Sequence locations=1-141,164-352,374-453
atgccattcgccgttcacttatgtgccgatggaccaaacaatgtggcggtgcaacggaagtcgctgagtcggctcgaatttgtggacatttttgtaaatgacagagaagcgatatatgtatgttttgctatatcgtatttcctaaaatggcttttaaatcaaatatagtttactttagaaattatggaattggtaccattttattggatttttgggtcctaaataatattatctcataaaatgattttatcatgcaacttcaaaattgattaattcaatgattgtccatgttctgaatacaggatttatttaatatttggccattttccatttttaacaaaacaaaatcaaactatcatattttgttaagaaaagatatttatgcctttaatcgccaattacctggctcgtatttttattttattttttcatttctttttgccagataaaaca

SEQ ID NO: 60276 - DNA, 704 bp, Heterodera glycines
  Genomic contig location: Contig_ID=SeqID_66; Location=1805..2508; Strand=+
  SCN-specific regions: Sequence locations=1-26,48-197,219-457,487 -522,545-576,599-642,664-704
atgacaaattttttgcgattttttgtcaatttgttaagaaaaaatgtgagttattttttggaagggcgatgggcggtgccattggcgctaaaattttaaacagattttcactgaaaattttcgatttttcggttaaatttagcaaaaattaatgattgttatgacaaaatgctaaaaatttgatttttttacataaaatgtacattttttacactcatacgcaaaaataccggtttccaattacatggaaatgaatacagttaaaattttctaagcacaaagccgaaatccgagtacgtacttggcatccaagtacgaatccgagccctgttataacagattaaaaaaaaagaatttttcacaaaaaatgaaaatcagaaaaaaatgaatgaaactggaataaattgaaggaaaaataggcaaaaaagttgggcacaaaacgtactcttattcatagatatattaaaaaattaaatttaataaattcaaagcaataaataatgaaaaactcagaatttcgaaaaaatttttaaaacaaataagtgttgaatattttcaggatatgtgataaaaatgtttaaaatagattctaattttatatgatgggttgaaaatgcatttatagaaaaaaatgaatgttttgtgtttcgaaagttgaaaaatttctagaattaaatttacataataattgctctgaaagatga

SEQ ID NO: 60277 - DNA, 520 bp, Heterodera glycines
  Genomic contig location: Contig_ID=SeqID_66; Location=2862..3381; Strand=-
  SCN-specific regions: Sequence locations=1-35,75-231,254-427,465 -483,508-520
atggaaagtatttatgctttcaatccttttggtatgttcattcaaaatttttgtttaattttccattcttttttagttaattcagtctcgacaagtcttggtctctgatcgtaaatttatttttagacgctttgaaacacattccaatttgtgcaccaattaaaaaattgttgatcagcataataatcatctgaatggcatgggttctccgcctgatccggcgatggaaatgccgccgccaaaagagatcaaagtgttggagagctcggcggatgacattcagcaccggcaaacagaagcaagtggttgagaacagtacacaccattaattcgggcgctaattggccttaattggtcacataatgcctgagagatttaattcggtttttaatggcttcaaattggaatatctgagggcataagtcatttggacaaattttatttatttattgttttgtttaaaatgatagaatttgtgactgtggtcggatttatttcttttccgaaaaaagtgaataaa

SEQ ID NO: 60278 - DNA, 695 bp, Heterodera glycines
  Genomic contig location: Contig_ID=SeqID_67; Location=97..791; Strand=-
  SCN-specific regions: Sequence locations=1-23,45-467,489-513,536 -539,561-695
atggcatacttcggacagcaaaaggagcagaaacaggagctgcatgatggggccatggaactgaacattatcggggaaggaacgtccaaaaatgaactcggcttcaaagaggagagcattcgtgccggatttgtgcacacgaatctgagcagtgccgaggatgacatgcccatagatgagcacggattcagcgaaccgatcacccgtgccgcttttgtccgcaaagtgttcctcgtcattggtgtaatggtcggtcccttcccttattgtttatttcgctatatgaacccaagttaagttcggggttgtctctctgatgtgcgccgttccgttcgtccatccgcccctaatggaatttgcgaaaaacaactactggctctgcttgatctcgttcggcacttatatggtcgtctactttgtgctgttatgcttcgacagtgtgcgccgcacatttccgaccaagttggttttatttgtttgtttaagtcatttgaaattaaatttttgtcctcccaaattaaagaccaaattaaataaattatttatccaaacagaaaaaattattgaatttgcaatgaatctgtgttttgcgttctctgacataaccgttgtttgatcaatttattcacttttttcggaaaagaagtaaatccgaccacagtcacaaattctatcattttaaacaaaacaataaa

SEQ ID NO: 60279 - DNA, 954 bp, Heterodera glycines
  Genomic contig location: Contig_ID=SeqID_68; Location=1895..2848; Strand=-
  SCN-specific regions: Sequence locations=1-23,45-463,486-523,545 -723,745-954
atggcatacttcggacagcaaaaggagcagaaacaggagctgcatgatggggccatggaactgaacattatcggggaaggaacgtccaaaaatgaactcggcttcaaagaggagagcattcgtgccggatttgtgcacacgaatctgagcagtgccgaggatgacatgcccatagatgagcacggattcagcgaaccgatcacccgtgccgcttttgtccgcaaagtgttcctcgtcattggtgtaatggtcggtcccttcccttattgtttatttcgctatatgaacccaagttaagttcggggttgtctctctgatgtgcgccgttccgttcgtccatccgcccctaatggaatttgcgaaaaacaactactggctctgcttgatctcgttcggcacttatatggtcgtctactttgtgctgttatgcttcgacagtgtgcgccgcacatttccgaccaagttggttttatttgtttgttttcgtcggttttccaccatttgcatctcagtttgattttcactgccatcctcacattgtccattggttttctcgccatggtaagtgcgatgatttttgttcacaaactaatttcatttggaataatttaggtcataaccgctttctgttcgtccgtgtccgttttggtggccatggggatcactaccgtttcatgtgttgggatcgcactgttaacaatggtcacgaaacgcgatattactagcaggtgttttattcattgcattttcctgccctttttggtgtttggctttttcatgtcatgaagttaaatgcgggattactggatttgtgggattaatcccgcgggataccgtcccgcaaaaaattttgagcttcaatccctatgcgagatccgcaaatttgaaatttctgggctctactgacaacaaagaaatgaacacagtaaacccaactttttaaagcttaataaa

SEQ ID NO: 60280 - DNA, 76 bp, Heterodera glycines; identical to SEQ ID NO: 51705
  Genomic contig location: Contig_ID=SeqID_68; Location=243..318; Strand=-
  SCN-specific regions: Sequence locations=1-76

SEQ ID NO: 60281 - DNA, 1415 bp, Heterodera glycines
  Genomic contig location: Contig_ID=SeqID_742; Location=209..1623; Strand=-
  SCN-specific regions: Sequence locations=1-199,233-597,626-835,857 -902,940-1137,1177-1415
atgaacacaacggcaccaactgacattgaactgtttcttttgttcctcggcggtgccgttgaactgttgataaattttgttggcattccgttgtccattgccaatttgattttggtggcacgcacatcggtcatccacccgaacatgaaagccattctcatcttccagagtttctttattatcttggtaaatcaaattcaattaaaaacaaatttaaaaaaaaataataaaacattttctacttttaagcgtggttgctgtcgttttgttatttgtctgttcaaattcatcactgggaaccaatttggtgccaagcatatgcaatttttcccggtacttttgaaaatatatttcatcggcatttacgcccgtaattttgtgccgcatgttctgatcgttgaacgcatattggccactttatttgttcgaacatatgaaaagaatcgtggcaatctgttcaccattctgtggatgccttttgcggtgagagtaatcataaattattatccaattataactaattatagcgaaaacaacataattttggcatactcatacagaataaattttatgaatacattatcaattcatcctaaaaagtttattttattttgtaatacaccaaaaggaattcttgaaaattttgttaagcattaagaagatataagcgatcaaaaattctatttgcagttgatcatcccaatttatattgccaccacaacgccttcaccacatgatcataagcaaccaataacgaatctgatcataattgccgtccaattgctggtcggaagcattgagttaggcattttctaccaattaagccgatacaattccaaaatttatcaaaaaatgttccaaaacattggctcgaataatctatcaattcgttatcaggtaacataaataaaatatttaataaaaaaaatattttattttgaaagctatcggaaaacattcgcattggtaagcagctcattccgccgttgtcgctgaatttgggcaacattttcgtgggaacaattattttgttatgggaccttttaaattggccatataatgagctgattgctaatttctgcattaatctcaactcattcttcggcctccttatcgaacttttcattataacgtaagtaaatataaaatttaaaaatttgattaattaaaattttagatgccacccatttttgaagagagatttgtgccaatttttgaaccgtattggcaaaatgtttggcttcaatcatttggcctataatcaccgaattggtgttactccatctttgtctgctctcaatggcattgctcagcggaatttgatcagtggaaaagcatggattaatacccaatcaaaaccagaagatcactttgccatactgaaagaagcatgggagaaggggtcgaatccttaa

SEQ ID NO: 60282 - DNA, 1031 bp, Heterodera glycines
  Genomic contig location: Contig_ID=SeqID_742; Location=2426..3456; Strand=+
  SCN-specific regions: Sequence locations=1-104,140-179,301-303,360 -633,661-846,869-1031
atggttatgaaatttgtgaatttgaattggatttcttccgcaatttcgacaggggtcggtgggaaaaaaattcagaatgtctaagaatttttttaagaaaaaggtattaaaaaaatttaaacatttttcattaaattatctcaacctttttttgattctcggaacagatatgtgtaacatttattttctgaattctttttttttttgaatttgtttctctttttttttgaatttgtttctctttttttctggcacgctcgttcttttatgttttttatttaattctgtttcattttttttaggtaaataaaaatattttttggtaaatatataaatatatttttttattttaataattacacatgcagctaattctaatttttggtctcgaatgccctctcgaagatcattcgatagccctaaagattttctattaacctgcaaaatttcaaagaatttcgttaagcttaaaaatttgtttgcttttgggcgatgttatgaattttctgtcaaaatttttattttgatgcttttttgagtaaccacccagcaccattgatttgtgacaaatgaagatcgaatgggcgcgaaattgtcaaattttctcttcattagtttttttttttactaaaaatattcttttttctgaattttcttcaagcgcataattccgacagaggcggaggcagcatatttctctccctattctcaagacctaaattcaaatatgcgtatcccactgcgggattgaattcaaattttttttttcgcgagacggaatcccacgggattaatccgcaaaatccgtacaaatttttaaatttattatgagttttttttattcatcatttttgaagaaatattagtcggggcaaaatggaaaaatcgatgagaaagatttaatcacttataaatcatcatattcatttacatattttagagaagaaaataacttttaaattattaagcttctacgatgaacaaattttttgtttttaaaatttttggccccttggtttaaaatttttgaa

SEQ ID NO: 60283 - DNA, 723 bp, Heterodera glycines
  Genomic contig location: Contig_ID=SeqID_743; Location=90..812; Strand=+
  SCN-specific regions: Sequence locations=1-54,76-138,161-285,309 -491,513-540,563-566,588-589,611-723
tcaaaatatttggaatatgacttcgaatccaacgagacaattccattgttccaaaaacttcgagatgaaaaaaccgctgactatagtcagaaaacggcagaaattgacacgtgagtttgccaattattaaaattggggaaaaaattaaattattatttttgggttatcaaaaaatcgtctgggagggtatcattgtcaacaatgccattgctgttcattttcattttgatcaaatttttaattttttggcgaatactaaaattttggaatgatgccatacggtgcataaaatttcttaaaaaattttatactacaaattttggttgtcaaattttagtgccaaatttctgatttttaatttgttaaaacttttgcagagaaatggtcttacttattacaaatccttatctggtggctgtggacaaaatcaaacaattactcgccatactgaaaacaataccggacaaacaatgcgatcaaattgccaacgcttggcgccaaattcgaattgagtacgcaaaaagtctcattgagaaggcgcaagcagcagcagcacagcaggaaaaggaggaacagtcaaaacgacgaatttcattaatttaataattgccagtttttatgcatttttaaattagcaaaattatttgcataaatttatgaagaggtgtttttctgagggtttttagaacccggaattttgaaaagtgcaaaaaataatattta

SEQ ID NO: 60284 - DNA, 396 bp, Heterodera glycines
  Genomic contig location: Contig_ID=SeqID_743; Location=4449..4844; Strand=-
  SCN-specific regions: Sequence locations=1-396
tccggaataaattgctaattctcacataaaatgtccataaaagaattccattaatgtcgtctctatcaaatgaatgtgcaataatgtccgctaatgttcacatgaagtgtaattgatcgaatctccgataaatgaaaaagtcgccgcggcttccgttctcacggccgactgataaatggcgaattgcaatgaaaattatcggattgatctttgagctttgaaatgggcactaattagccgaacatggactcaccctaaaaaaataactcaaataggctcaaaaatcattaatttggccgaaatttaagcgatcagagtaaaaataatttctcattcgacttttgaattttctcttgcacaattggcagtcattttaacttagtccctagaaatttt

SEQ ID NO: 60285 - DNA, 1016 bp, Heterodera glycines
  Genomic contig location: Contig_ID=SeqID_743; Location=1423..2438; Strand=-
  SCN-specific regions: Sequence locations=1-77,104-589,612-796,822 -909,931-933
atggcaaatacaggaggcaaaattgcctttgagaattctacggtaattttcggcaatttttttgttttggtcgcacaccaaaattttaaaaacaaacaaaaattcgcgcacaaattcatataactcatctttttaatctgatccatttggcgggatttttgcattaatgtaccaaagataaagctgtacccgaatttgtgaatttgcgtgcatttttgttgattttattttttatttttgacctgccaccccaaaacaggaatgctcaattttgcaaattgcttttgccatttctaaaaaatctatcaattaaaacaggtggttttcaatggcggtaaaattgccgaaccaaatggcacaacaaattgggaaataacgctgaatcttttttttgtcaacattatttctttgaatgatcagcagcagaataatgatcaattctatgagatgaatgtgtattgccatgacaagaatacacaaccattttatcatgcatcctttaaatgctggaacggaggatgccaaagaataattaatgtggatgaacaaaaatgcccaaaaaatgcatatgacattcaattatggagttgggacaattggaaccaacaacaggtttttgatagagaaatggtcaaaatttgttttaaaagcatcaataaagcctaaaatactcaatttaccgtttattccgaaaaaaacactcttggcttagcttagtaaaaatcccaaaaaaattagaagaaagttggtattactgggtatgaaaaaaaggcaagacgttttaaaaatgcccaggaaatttttaaaattaaaaattattacaatctttaaattgtcaaaaagccagagcctgtagttaatatattggaaattgcagaaattttactaaaattgaccaaaaatttgggtaaaaaattattattttgaatacccaatttatataatgatttagtttttatgaaatgaattttgtttatctaaatatatatttttttatttacatcattttaaataaa

SEQ ID NO: 60286 - DNA, 359 bp, Heterodera glycines
  Genomic contig location: Contig_ID=SeqID_743; Location=2626..2984; Strand=-
  SCN-specific regions: Sequence locations=1-18,43-286,311-359
atggcaaaaaaatatgggattttatttaaaatttttatatttctctatacttcaaaggatgcaaattgtggccaaaacaaattgattcttgacctatcgccaagttttcatgaaaatagtcaaattaggtaagttatgcataattaatttaattgttggacgaagatgtatatttgcccaaaaatgcacaagtcattacaagtctaaaaatttgcatttaaatttatgccattttttaagatatttttgtcttttacttaaaaaattgcatatgttttcaacattctttttttattaaattttaaatttacagaaaaaaatcgaatcatacggtaatatctaatgattttatggtttag

SEQ ID NO: 60287 - DNA, 185 bp, Heterodera glycines
  Genomic contig location: Contig_ID=SeqID_744; Location=1..185; Strand=-
  SCN-specific regions: Sequence locations=1-185
tccggaataaattgctaattctcacataaaatgtccataaaagaattccattaatgtcgtctctatcaaatgaatgtgcaataatgtccgctaatgttcacatgaagtgtaattgatcgaatctccgataaatgaaaaaaatcgccgcggcttccgttctcacggccgactgataaatggcgaat

SEQ ID NO: 60288 - DNA, 5265 bp, Heterodera glycines
  Genomic contig location: Contig_ID=SeqID_745; Location=888..6152; Strand=+
  SCN-specific regions: Sequence locations=1-77,101-160,199-480,535 -610,633-640,662-712,734-822,844-879,901-1157,1255-1472,1494 -2066,2088-2424,2446-2729,2751-2762,2793-2884,2915-3370,3401 -3439,3547-3558,3580-3990,...
  SCN-specific regions: Sequence locations=...4024-4139,4164-4322,4344 -4652,4687-5265
ggggatgatacaaatgagtccgaagaaagcagtctggaactgagtaagtttagcaaattttcgattttttaaagaagataattttaaaatatttaattaagagaataagttggcatttgcggtgccgacacaaaaaaaaattttgtttaatgcataactgaaataaaatgtttttttataaaaaatattacatttaatcaagcacaaccattcatccccaaattgttccaaattgtttgtatgcttttaagcagtaattagttaggttcaaatttagtcaaatgtatggtggaaaacacgaaaacggaggcggatatcgatgccgaagacaatgatggcaattctccatttatgctggctgtcatgaaccagcgcactcaaattgttcgttattttatctcgaaaggggtgcgaattgatcggaccaacaaaaatggtgaggaaaaatgttggatttcgaaacgaacgatattttagaggttttttttaatattttaacgaaaatatcaattgaataaaaatatttatttatttcggtattttaccgatggatccaatcacttgtacgatatctattaggttaaacacttaaatttattttttgctcagttggaattttgaaaaattttattacgaattccaaaatggaatttttgaaaaatatcattagaatttccaaatggaatttttgaaaaattttatgtcgaatttctaaatgtaatttattttgaaaaatacattagaatttccaaatggaattttgaaaaatattattaggaatttttccaaaaagatttttgtaaaaattttattacgaattccaaaatggaatatttgaaaaatttaattatgacattcaaacatttttttaaatttttcatttaatttgggtaattcaaagccattgcaggcatgtgcgcgctgcatttctgtgctggcgctgacgacagatttgagttgtgcaaattgttggtggacaacggggcaaatgccaacaaaaccgatggcattggtcatggcgttacgcccttgcatatcgcatgcggccaaggcgctttaaaaaatggttagaaaatgaaaattggcatgcgcatcctatggattggcattaattagggattactaggctcaatttgttaacggattttcttagaaagaattattaaatattttaataaccacttttgcattttgactaaaatttttacattaaaaattatattatgtataaaaaaaaatcaaatatatttaattcctgcggagggttgaaccaaggaaaacaagtagtaaatcagaaagattagccactaggccatttgcacagttgacagtctttttcttataaaatataacaaatccaacattgttagtatcattcgagagctgtaaatgttctctattaacctacaaaatttaaaaaatatggcccaaaaatttctgaaaacctgtttctgatgtacttttggccataaatttgttcaaaattgaaattttttggaattttgcaggctaatagagcatctgaagggctttcgaaagttcggtttttctaaatccgggtatgggagcggaacccgggaaatcccgttccgatttcggtcccactctatgtactctaaaaaatgaaactatttacttattcagttaaatttttggtggaacaatgcggaggcgacattgaacttgccgattctgatggtgcttcagcgattttttatgcagtggcgaaagagcaattcgatgttgttcaatatttggtctccaaaggagcgcgcattgatcaactcaaccacaaaggtgaggatggattggatatgactgatctggtaaatagtgaatattactagctagggttaagcctgaccccgtcccgaccccggaccccgagattttaggccatttattgcgagttgtaagtagggaccggacttttaggcacgaaaaattgcaaataggcacctaaaataggcacaaaaaatgtgaaaaaaagcacaaaaaattacaaaaagcgccaacaaaggcacaaaaaattggaaaaggcagcaaaaatcaacattttggacaactaaaaatataaattatactgggggtccggcggtgccgataggcgcagcagggaaaatttttttgtaaattgtaagaaatatgataagacaaattgaaaaaatttcaaaaaattttccatttttttcaaaaatactgaaaaaggcatgaaaaaaggcacgaaaatcacgtacccttgcataaggcactaaaattgcataaaggcaccaaaaagtccaagctagaagcttaaatcaagttaaaaactcgtttttcgtgcgtattaattaggccatagcaagttagcaaaaaaaaaaaaggcataagcctcaaaatccgaccctagttataagtagggcccggattcttagttttttaactattttttctgcggctttattttgatgagaaatgcacaaaaaacacatttttaattcggaaattcttcgttttaacgccactattcatcactaggaatcactattttggagcttcgccactaaaaaaaactattttggaagttggccactaaaatagttttttgccactattttggcgtttcgtcactatttttcccactattttggcattttttttggaaaatttcccaaaaattcaataaaaacgaaaaatataccccaagaatcgacctaaaaaaaaatcaaaaaatacacccctaagaatcgacctaaaatttttcaaaaatacacctctaagaattggaaaattttttcaaaatttcttccccaaattttttttcttgctcaatatttgctaagaaaatattggaaaggaaatgttcctcatttgtgactgcaaacagtgaataaaattgtttgccttaattttaaattattttcaaattaaaaaacagctatttaaaaaattacacccctaaatttggaactttttcgccactattttggcatttttttgtcactatttagttaattatttggggattttttatcactaaaaatccgggccctagttataagcaactaaaaaccaccgctggggatatacgatcttttttcctaaatttttcagtactttcctgttatgcgactacaagccaaaattttaaaaaaacaacaaaagggggcgcaaaaggcggtgaccaccaataaataaaatgggtgatacaatccaggggaagtcttgaagtcaatacacagggttttatatgcattacatgcgcgaattttggtttgtagtcgcataacaggaaactaccaatttttcaaaatttattatatgtacaattgatttattatatacgcacaggtcgttcgccattaattgttgcgtgtttggttggacatttgcaaattggtaatttaatgaaataattattggagcaggattttgtgctttttgaaaagggccgatatgaatttttattttaatttttaattaaaattcaattatttctttttttttaattctggtttttccaaaatttctcatttttaaatttataaacaaacaacaaaacaactttatgaatgccgtaaaatccccaaaactttaaccttacttaaaaatattaattgttttttaagccaaatttcttgtggaaaacggcgcggacatcgaagttgtcgcttctgatgggcttactgcggtgagggccgcaataataaaggacagtgttgaaattctcaaatatttgctcgtcaacggcgcgcgcattgaccgctgacgagtttttaagaacaagaactttattgatgagtttctaaactttgggataaaactgagaatttgtcattttacccatgctcataacttgaaaaattagctggaaacccgccgaaggttttttttacacttcgccttaaattttattccagtttattttatcgaattggtcggaataataggatgaaataattttttagcccatttattaattgatttttgccaaaaaatgactaccttttcttttatttatttatttattcaaaaattaaaaaagttaacaattgataaaaatttcaattacctagttttctttagttttcatttcatgaatgcggttgaattctttcattttctttgagttatgggcctgaattatctattattagaacaatttatttattttttaaatttatgctttcgttttattatcataaaataaattaatcatctcttttttagcccacttcttgtgtttttaagttttttaaaaatttttcacatttttttttcattgaacgtattcctaattaggtaaatcaaatattttttagggttttttgtatttattttaaaaattctacatgcataatttttgatctcaaatgctctcgcgatttattgatttagagaagagcgaagagcgcgaaattgtcaaaaatttcttgttcattagtttttaatcattttgttcttttctaaattttcttttggttaatcctttttcccaatttttttttgaagcattaatcccgactgcaggattgtaactcattttttgcgggacggaatcccgtgggattagtcccgcaaaatcccgcgccggtccctacccatatacttctgcatttggttcattctcaacagttttaggaattttctcgcattctcgacaaaaatggtcgaatatttatatttaaatataatatattttttaatcacacagtcaaagctcgctttgttaatatttatctgagctcccaaacccaaaaacacacaaaaccacttacctataggttttcttatgcgctgaaaacgatagaacaatccaaaaaatttaacgcgcttcaactttaaaccggtttttgaacgggtttaaaactcgaaaaattgaggataaaggtggggcctcctgaccttttaaaagggtcaaaccctgacaaatttttgtgaaattttattgttcgatcgttttcagcgcataagaaaatctataagtggttttgtgtgtttttgaggatgctaggtcgaaggactaaaagtgcaaaatttgctaaaattttgaataaatccactaataacttttctcagacgcaacctccttcgccagatttgcactttctgctcgttcacacccacccacgaccatcagacaagaagaatacaagtgattttgcgccccgacgttccaccatggcacacgagtgctacggctttggcaatgtgcgagcaattaagcacgcacatcgggccagatgctggggcatttgtgctgcaccgcaagcggcgcataagtag

SEQ ID NO: 60289 - DNA, 1440 bp, Heterodera glycines
  Genomic contig location: Contig_ID=SeqID_745; Location=4891..6330; Strand=-
  SCN-specific regions: Sequence locations=1-6,54-72,141-757,792 -1100,1122-1280,1305-1440
atgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtattcttcttgtctgatggtcgtgggtgggtgtgaacgagcagaaagtgcaaatctggcgaaggaggttgcgtctgagaaaagttattagtggatttattcaaaattttagcaaattttgcacttttagtccttcgacctagcatcctcaaaaacacacaaaaccacttatagattttcttatgcgctgaaaacgatcgaacaataaaatttcacaaaaatttgtcagggtttgacccttttaaaaggtcaggaggccccacctttatcctcaatttttcgagttttaaacccgttcaaaaaccggtttaaagttgaagcgcgttaaattttttggattgttctatcgttttcagcgcataagaaaacctataggtaagtggttttgtgtgtttttgggtttgggagctcagataaatattaacaaagcgagctttgactgtgtgattaaaaaatatattatatttaaatataaatattcgaccatttttgtcgagaatgcgagaaaattcctaaaactgttgagaatgaaccaaatgcagaagtatatgggtagggaccggcgcgggattttgcgggactaatcccacgggattccgtcccgcaaaaaatgagttacaatcctgcagtcgggattaatgcttcaaaaaaaaattgggaaaaaggattaaccaaaagaaaatttagaaaagaacaaaatgattaaaaactaatgaacaagaaatttttgacaatttcgcgctcttcgctcttctctaaatcaataaatcgcgagagcatttgagatcaaaaattatgcatgtagaatttttaaaataaatacaaaaaaccctaaaaaatatttgatttacctaattaggaatacgttcaatgaaaaaaaaatgtgaaaaatttttaaaaaacttaaaaacacaagaagtgggctaaaaaagagatgattaatttattttatgataataaaacgaaagcataaatttaaaaaataaataaattgttctaataatagataattcaggcccataactcaaagaaaatgaaagaattcaaccgcattcatgaaatgaaaactaaagaaaactaggtaattgaaatttttatcaattgttaacttttttaatttttgaataaa

SEQ ID NO: 60290 - DNA, 726 bp, Heterodera glycines
  Genomic contig location: Contig_ID=SeqID_6088; Location=216..941; Strand=-
  SCN-specific regions: Sequence locations=1-726
atgggcgacgcaattcaacagctcacagcggcacttcagcaattgttggcgaatccgccacaaaatgctgcgcccgccttaaatgcgcatgctctgccttctcttccaaccatcgactgttccgagccatccgacgatagaagcatttcggattggttggagcgcttcaatttcgctctcgactgtgcggcaccgcaactcgcagatcaatcgaaagtcaaacttatcatgacgaaactgagcgaagcggctttcagccaatacagcaagtcgtgcctgccgaaaaaagtcatcgattttgacttcaaccaaacgtaggagcgactcaaatttgctttcagccggccacaatccatttggattgatcgttacgaatgcctgagggcctcaaaaagcgacgatgagaattttcgccccttcatcaaccgacataagcggcttttccgtgattttcagttcgacaagctcaacgagaaattttcgtgcctcatgcttttgacggcactgaagtcaacgaaggatgccgagctgagaaagcgaattctatcgaagcttgcagcggatggtgacttgatcgagtatgatggagttgtcgaagacctccaaatgtaccaatcaaccatcgctgaagcaaaagtcattgaagaacggccgatggcatcgcgaaatttgatggcggtcaaacagaagcagcggcccatgaaaccaacgcagaaagggaactaa

SEQ ID NO: 60291 - DNA, 2793 bp, Heterodera glycines
  Genomic contig location: Contig_ID=SeqID_6088; Location=2841..5633; Strand=-
  SCN-specific regions: Sequence locations=1-894,916-985,1009-2009,2031- 2511,2533-2793
atgggcgacgcaattcaacagctcacagcggcacttcagcaatttttagcaaatccgccacaaaatgccgcacccgccttaaatgcgcatgctctgccttctcttccgaccatcgactgtttcgagccatccgacgatagaagcatttcggattggttggagcgcttcaatttcgctctcgactgtgcggcaccgcaactcgcagatcagtcgaaagtcaaacttctcatgacgaagctgagcgaggcggctttcagccaatacagcaaatcgtgcctgccgaaaaaagtcatcgattttgacttcaaccaaacggaggagcgactcaaacttgctttcagccggccacaatccatttggattgatcgttacgaatgcctgagggcctcaaaaagcgacgatgagaattttcgcccttttatcaaccgacataagcggcttttgcgtgattttcagttcgacaagctcaacgaggagcaattttcgtgcctcatgcttttgacggcactgaagtcaccgaacgatgccgagctgagaaagcgaattctatcgaagcttgcagcggatggtgacctggtcgagtatgatggagttgtcgaagacctccaaatgtaccaatcaaccatcgctgaagcaaaagtcattgaagaacggccgatggcatcgcgaaatttgatggcggtcaaacagaagcagcggcccatgaaaccaacgcaaaaagggaaccaagttcagaaccaaactcaaagggtttgctggcgttgtggcaagtttcaccatgctccaagcgaatgtccaagcatcaaaactgtttgccgaaagtgcaacaaagctggacatttggaggcacaatgcgagaagcaccatgagtggctcaaccggaacaaaaacggcaaatttcaagggaaaagagcttgcactcttcggatcggaggtgtaatggtgaacattgtgaaccatccaacgaggctcattgaaattaccgtggaaatgaatggaagaaaagtgatttttgtgcttgattccggcgccgaggtcacagtgatcaacgaagagactcactgtctgattggaaaatctcaattgcgccgatgccaagaacaagcagcatatcacgacggctccaagtgcactcttctcggaagaggggaagcgaagttcaaatttggagacaccacgaaaaacggaacattttatgtgtccaaaagtggatcattgaatttattggggattgaaatgctggatgctttcggacttttggacgacattcgacaaaaagtcaattcttcattgcatttgaatgcaatcgaaaaagaaaatggtgaccaagcaacgattatcaaggatctcaaaaagatttttcctgaaattgttgccgacggacttgggcattgcaaaaaggtgaaggcacatttgtcgctgaaacccaatgcaactccaatttactgccgaccgcgtcccgtcccattcaacaccaaatctgttgttgaggcagaattggagcgacttcaatcgatgaatgtcatccgtccggttgaacacacaaattgggccgcacccattgtggttgtgaagaaggccaatggttcaactcgcgtctgtgccgacttttcgactggcttaaacagcgcactgcttttgcatcagcatcccctgccgcttcctgaagacatcttcgccactttgaatggaggccgaattttttcgcaaatcgactttcgggatgcttatctacaagtcgagttggacgaaaattctaaagagttgtgcacaattgccactcatagaggaaattttcagtaccaacgtttgccatttggggtgaagtcagcccccggcattttccagtcaattatggattcgatgttggctggttgtgcattcgcagttgcatatctggatgatgtgatcgtggtaagccgatcaccagaagaacacaagaagcaccttcaagaggtcttcaagcgaattgccaagtttgggttccgaattaagccagagaagtgctccttcttcaaaatggaaattaagtaccttggcttcatcattaataaggatggaagaaggccggacccagccaaaatacaggcgatcgctgagatgcctgtgccgaccaatttgtccacacttcgttcgtttttggtgatgataaaccattatcagcagttcgagaagaacatgcgtttcatccgccaacctttggacaatctgcttaagcaagatgtggtctggagttggtccaccgattgtcagaaggcctttgatcaggtcattcagattctgcaatctgatcagctattggctcactacgacccatcgcaacaaatcatcgtgtccgcagatgcatcagagcatggaatcggagcagtgatttctcaccgctattccgacggcacaatgaaagcagtcgcccatgcttcacattccctgtccccagcggaaaagaattattcgcaaattgaaaaagagggactggctttggtgtatgccgtgcagaagtttcacaaatatctttttggaaggcattttcttctacagacggatcacaagccattattgtccatttttggcaataaaaagggaatcaaagcgtgcaccgccaatcggttgcagcgctgggcaatcattcttctggggtacgattttgaaattgagtaccaacaaacattggagttcggccaagccgatgtgctttcccgacttattgcgaaaactccgatgccagaagacgacataattttggccaaactttctacgagtgctacaattgggaccctaaattctgttctgtag

SEQ ID NO: 60292 - DNA, 963 bp, Heterodera glycines
  Genomic contig location: Contig_ID=SeqID_29822; Location=33..995; Strand=+
  SCN-specific regions: Sequence locations=1-23,47-459,487-524,546-963
atggacatggcaatggcccgtattggtgctgttggtgacggtggtgatcgccgccgccgcacttggtggtaagaaaatttactattttggttaaatattttatggtaaaatttaacttttcagtgggtttgtggtgtcggtatcgccggtcgcggacggggcctgacgacgtggagtcgcaggcgcctgttgcggtaatcataatttttacaaaaattcttttagaaaaattcttttttgggtgggtaataaaaatgtggggttgaaaacaaaaaatgctaaaaaaagttgctttatatcccccgaaaaaaattttcagcgaccggaggaggaaaatggcaaggacaaaaagaagaatgaggaaaatggcaaggacaaaaaggaggaggaaaatggcaaggacaaaacaaaatgtcgtcatgcaaaaagcgacgaaaagttctggaaaatttactaatctaaaacttttttaagaaaaaatattatgaagtttttcttattagaaaattctaagaaaaaaacttagaaaattattatggtgaattactaagatttttcaaaaaatttcccaaattcgttgaaatttattgtgaattttttttgttagtaatttttttggaatttctggcgttttttggcacgatttacgacgttttgtcccgacgacgtttcggccgacgttttgtccggcgccggcgcacccttgcttgttcactttgctctgattgtgaattaatggtggtgacattggtgggtcaatgccagttcgtacagtaaaaaggtttacaaaattacacctaagactcagcttataggcctaagcctaaagttagggattattctagcaatacacctttctagaaacgtctattttacgaactgtcaattcaaaaaaaatttctgttttcggtggataatgagtagggctcggatttttatgtgctaaaaatcctgaaatatgta

SEQ ID NO: 60293 - DNA, 1005 bp, Heterodera glycines
  Genomic contig location: Contig_ID=SeqID_29825; Location=61..1065; Strand=-
  SCN-specific regions: Sequence locations=1-410,477-649,680-730,761 -815,879-1005
atggacgaacaaattgcgaaaaaattacaaaccagcgcaagctcaatttatagttggaaaaggcaatttggatatggtgagttcgtattaaggctacccgtaactggattttcaattatggtaatccgtgaatcgtaattacgacatacggaagtagtaatccgtaattacgagagtccaaaaaggcctttatttccgtagcgccgtaatgcgtgcaaccctggttcgtcgcgatccatttggtcaaatatttcattttaaataaaatcacatttttttttggaagcaccaaacgaatatttttttagtgtaattcgataggcattattttttctcgattacattgcaaaattttataccttttttaatagtaattaatagagcgtacttagtaagctagcgaatgaaactaaatttttatttttaaatattgtattaaaatttatttatataataatagaatatttcaatatttagttgaaaaaataagtcacgaacgcgatgaaaaacttcgaattattaagcaatttcaaaaaagaaagcaggaatgtgcggaggagccaataacaacaaataaaatcgccaaagaattgggcgttggccgaaatacaataagtcgatggaaaaaagaattgggactttcaagtacaaaaataaattatataaatttgaaataatagactacctatttttatacttaaacgaaagaaaaagtataggacttggttctcttattcaaatttattttaaaattgaaaaggttttgcattaatttagaaaatttttacctgtcttttaagggaatttattagacgaatttaaatttaaacatttaaaaaatctaaaatattaatttaataaattattaatatattttacatattcagctcataaacaatattcaaaacaagataagtttaatatagtgaatccaatttgaagaaagaaaaaaacaactgaaaagaaaaggacaaaaaatgccatgcattgaaatgggaaattaaa

SEQ ID NO: 60294 - DNA, 157 bp, Heterodera glycines
  Genomic contig location: Contig_ID=SeqID_29826; Location=270..426; Strand=+
  SCN-specific regions: Sequence locations=1-157
atgttcagatgggatcacgggcctatccgcccatcagattcaaatcctacagaagatttgggaacgctctccggaagtggagatctccgactgtgcccgcaatattatggcccacctcctccgctcaaatgcccaaatgtaccaattcttcgatttg

SEQ ID NO: 60295 - DNA, 697 bp, Heterodera glycines
  Genomic contig location: Contig_ID=SeqID_29828; Location=276..972; Strand=+
  SCN-specific regions: Sequence locations=1-697
ggtgcgtttggagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcggggggactgccccgaaaac

SEQ ID NO: 60296 - DNA, 997 bp, Heterodera glycines
  Genomic contig location: Contig_ID=SeqID_29829; Location=288..1284; Strand=+
  SCN-specific regions: Sequence locations=1-653,677-783,806-887,911-997
atgtaccgtatccgtgttcgagttgtacaaagtgggtacaggaacgaaaacaaacacatatgtgatttgctaatcatctggtaagtaatggacattaaaattcattttgacttttagggatactttttgggcggcatcgctttgtttgtgctgatcattggcgccagcattttctgcgtcgcttatttgatacagtatgcaaaataaaagaagcaaaaggccaaaataaaaatgggaaaaacaatttcaaatttagcgcaaaaattgttgacaagcgaaaaggcaatttgcagtggaaaatcccttttgcgttgttgcagcgacagaaccaaagagtgagtggacgaagaaagaaaattgtattattcgaccgaattccctttcgaatccctaaattcgaggctatgaccaattccttgggggatgaggtttaacatgaaagaaattcctttgcctgagaccgaagtcaaggagaagcgaacccattaaagccctaatactaattaaaggcccggattgattttactgggatccccgattatcgtttttagggtgaaatgccgaatgcgcgagtcacaagaaaacgaatttttaatctcggaatccctgtccattgcaaggctccgttcccagtttttttttcaaaatccgggatcaatcaataaatggggttgttgaaaaagccttatttgttttctttaattcagcgatctgaacggaccgccgaacggagtcaccactctctccgctccaaccaaacaaatatttccgcgttgacccatgcgaccaccagcagcagcttggcacagtcaaaaaacttcacactgtacgcttacaatggacaaatgtgcattgtacacgcgtacggcccaacaatgttggccatgccattgtctgccgaggggatggccgagtgccgaacggtagaagggaaattagcaataatcaataatatggtagactaaattgcaacaatacggtaagataattaacatta

SEQ ID NO: 60297 - DNA, 345 bp, Heterodera glycines
  Genomic contig location: Contig_ID=SeqID_29830; Location=590..934; Strand=-
  SCN-specific regions: Sequence locations=1-16,331-345
  Gene Ontology: Biological process=N-linked glycosylation
atgaagagaaaaaggaagaaggagaagaggaagagaaaaaggaagaaggagaagaggaagagaaaaaggaagaaggagaagaggaagagaaaaaggaagaaggagaagaggaagagaaaaaggaagaaggagaagaggaagagaaaaaggaagaaggagcagatgaagagaaaaaggaagaaggaaaagaggaagagaaaaaggaagaaggagcagatgaagagaaaaaggaagaaggagaagaggaagagaaaaaggaagaaggagaagaggaagagaaaaaggaagaaggagaagaggaagagaaaaaggaagaaggagaagaggaagagaaaaaggaaagtg

SEQ ID NO: 60298 - DNA, 769 bp, Heterodera glycines
  Genomic contig location: Contig_ID=SeqID_29831; Location=198..966; Strand=-
  SCN-specific regions: Sequence locations=1-95,119-150,207-207,297 -302,366-379,409-445,473-689,722-730
cgggtcgccgggccaccgggtggcccgacttaacacaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcg

SEQ ID NO: 60299 - DNA, 748 bp, Heterodera glycines
  Genomic contig location: Contig_ID=SeqID_6089; Location=185..932; Strand=+
  SCN-specific regions: Sequence locations=1-94,161-253,307-580,603-748
  Gene Ontology: Mol. function=extracellular ligand-gated ion channel activity; Cellular component=integral to membrane; Biological process=cell surface receptor linked signal transduction
atgggcaatctttacctaaaacggcgtattggcttcaacattgtacaatcatacattcccaccggtctaattgttattataagctgggtaattgaaaataataaaatattttacaatttttaaattaatttaaaaaatattttaaaatttaaataaatttgaaaggtctccttttggattgatcgccgtgctgtgccagcaagagttaccttatcatttacaactttgcttacaatgacgacattagtgcgtcaattttattatttattggaaattaattaaagatattaattaatttttataataccttttagggtaatggaatgcgatttgtacttccgcgtgtttcctatgccaaggcaattgattattggtttggcggtaattttattttaatttcccagtgtagcttattgcattttaaaataggaaactgaaatcttatgcttcaaaattaaggatttatctccatttattatttttttaattcgttttcgtgtgccaaaatctcttaatgtatatggggtctcaccccaaaacatgaactaaaatgggaaaataacttaaaaatcccaaatttaagggagcttaattttaatttggttacttttttcttttttgattccattcacaaatttcatcaaaacaaaatcataaaattttactctatttcaggtatctatttttgaagctgtgtattgtttctttgtgactcttatcatattttatgacctaaaaacaaagcata

SEQ ID NO: 60300 - DNA, 772 bp, Heterodera glycines
  Genomic contig location: Contig_ID=SeqID_6090; Location=72..843; Strand=-
  SCN-specific regions: Sequence locations=1-127,150-150,192-213,241 -379,424-469,494-542,568-697,724-772
  Gene Ontology: Mol. function=MHC class I protein binding; Cellular component=tubulin; Biological process=natural killer cell mediated cytolysis
atgtacacaaggggaggggagctttccctggctaaaccccctcttggcaaagattcggtcgtcccatcgccaaaagtgtcggatacggtagtggaaccgtacaacgcgactttgtcagtgcaccaattggtggagaatacggacgagacattctgcatcgacaacgaagcactttatgacatctgtttccgaactctgaaactgaccacgccaacgtacggcgacctgaaccacttggtcagcatcaccatgtccggggtcaccacttgcctccgttttccgggccaactgaacgccgacctgcgaaaattggccacaaagtttgtgtgcgggtgcgtgctgttccgtgcagtgtttggctcgcttcagcatggtgcccttcccccggctccacttcttcatgcccggcttcgccccgctcacttcccgcggcagtcagcagtaccgggcattgtccgtccccgaacttacccagcaaatgttcgatgccaaggttcgcttgaactttggactcgccctttggtgagtccttttcatatgacagaatatgatggccgcgtgcgaccctcgccacgggcgttatctgacggtggcggccattttccggggtcggatgagcatgaaggaggtccgctgggagggaatgcttctgcttcgctgcccttctttcttatggtgtcgttccctaaaggtcgacgagcaaatgctgaatgtgcagaacaaaaactccgcctattttgtcgaatggataccgaacaatgtgaagacggcc

SEQ ID NO: 60301 - DNA, 1123 bp, Heterodera glycines
  Genomic contig location: Contig_ID=SeqID_6091; Location=69..1191; Strand=+
  SCN-specific regions: Sequence locations=1-162,189-192,214-252,274 -476,519-732,754-858,880-941,963-1123
atggacagttcagcaacagtcagtgaggagttgtccgcagcagaaagccgagataagcagcacaacagcagcagaagagcaaaacaccggcagcagcaagcagtacctgtagcacaacatccacgacaacaaaatcatttgccaccaaatatgggcaatggcagcagcaggctgaaaaagtgcttcagcaatgccggtgaaggtggtggttgtggaaacggcatgcccaattatcatcaaaccaccactacgccgggaatgatgaacggttcatattatggtaatgtgatgttcgcattacggtagcatttcgactccaactgtgatttggcttgtacttttagtcttgaaaactttttatttcgggtttttgttagctaagtcaatgtgctggttcgtttcgaaaatcggccattttaatattttcgacaaacatggcataacaattttgcattcttggtatcattcgatagccgagatttttctttattgctgaaaatttccaaaaatttgttaaccttcgaaaaatgtatgaaaataagaagtatattattgatgaaaattatgccaaaaatagctaaaatgccgtaatttacgaaaaacccggccagaaacgcactcgaaaaaccaaaaaattttgtgacgctttgcgaatgcttcctgtaaaaactttgtaacacgatcattcttcactatagccaagttgattatcattcatttagacaacatgaattggtcactgaatggaagaaaaggtttggaggacaattttgtgccagaaaagttgaagaaaagtggcggcatttcggtggcatttgccatggacgaattggtcaaaggcagaacattgaatggaactccatgtaagaaattccaattagcatacctattcgttttacaatattaatttttgcttttaaggtgattacttgtttccggattttaatgggaaaaaagatttgaagcaaaatgacaaattacacccagacaatgcgatcaaatacctggaggtgaagcagaattttttttttttgattttttctatgggtcggggtcattttggcgcaggccattttggcgcagacaagtttaaagattcataacttttttttaattcgaccaa

SEQ ID NO: 60302 - DNA, 1122 bp, Heterodera glycines
  Genomic contig location: Contig_ID=SeqID_6091; Location=2006..3127; Strand=-
  SCN-specific regions: Sequence locations=1-42,69-305,327-330,353 -566,588-652,681-732,754-766,792-846,868-1012,1034-1100
  Gene Ontology: Mol. function=structural constituent of cuticle; Cellular component=extracellular; Biological process=cuticle biosynthesis (sensu Nematoda)
atggacttcgaagccaggatcaaagcttaccgcttcgtggcctactccacggtgtccttctccatcatttcgctgctgtccgtttgcttcactttgcctatgcttcaaaattacgtgtccaatgtcgctcagaatatggacagggaattgagtgcttgtcaggtgcgccaattcttgaatttttcactaatttcttaatgtttctcctcttaagggttctgcaaaggacatttggtcggaagtgaaccaactgaagagcatccccgtggtgggaggaaatcgtacggcgcgtcaagcggacggatacggaggaggaggcggcgcagtgtccggcggaggaggaggaggtggctcgtgcagtgaatgctgctcaggcggaggcccgggcccagcaggtcccccgggaccgccccggcaatcccggaaaccccggagcacccggatcaccaggacaacccgggaaatctgtttccgctccatgcgaacaagctaccccggtaactttaagctattattggctaaagttaatgtcgcaattcagcctccgtgcaaaccgtgccctggcggccaacccggccagcccggccctcccggaccgcccggccagcccggctcaccagggcagcccggaagtggtggcggaaaccccgagccaggacctcctggacctcccggaccacctggaaaccccggagggcccggccaacctggaggccccggtcaacccggacagcctgcagcatcagaagcagctggccctgctcctcccggaccgcccggagaagctggagccccaggacagcctggaaacgctggcccgcctggacaacccggaggacctggacagcccggcccgaaaggaccgcccggacctcctggccagcccggaaacgacggacagcccggacagcctggcaacgccggacagcccggaggagccggcgaaaagggcatctgccccaaatactgtgccatcgatggcggagtgttcttcgaggacgggactcgaaggcgttgaacattttgaaatctttggagaaaaaacaccgtcttctcttcacttaaatttacctgagtctgtattttggctcttttgtctttatataaattttaagaaataaa

SEQ ID NO: 60303 - DNA, 477 bp, Heterodera glycines
  Genomic contig location: Contig_ID=SeqID_6092; Location=1375..1851; Strand=-
  SCN-specific regions: Sequence locations=1-25,47-111,140-191,213 -225,251-305,327-477
  Gene Ontology: Mol. function=structural constituent of cuticle; Cellular component=extracellular; Biological process=cuticle biosynthesis (sensu Nematoda)
cctccgtgcaaaccgtgccctggcggccaacccggccagcccggccctcccggaccgcccggccagcccggctcaccagggcagcccggaaattctggcggaaacccggagccaggacctcctggacctcccggaccacctggaaaccccggagggcccggccaacctggaggccccggtcaacccggacagcctgcagcatcagaagcagctggccctgctcctcccggaccgcccggagaagctggagccccaggacagcctggaaacgctggcccgcctggacaacccggaggacctggacagcccggcccgaaaggaccgcccggacctcctggccagcccggaaacgacggacagcccggacagcctggcaacgccggacagcccggaggagccggcgaaaagggcatctgccccaaatactgtgccatcgatggcggagtgttcttcgaggacgggactcgaaggcgttaa

SEQ ID NO: 60304 - DNA, 469 bp, Heterodera glycines
  Genomic contig location: Contig_ID=SeqID_29832; Location=360..828; Strand=-
  SCN-specific regions: Sequence locations=1-322,364-469
atgttctaccaaatcattgccatgggcactttcgccgtctcttccctttgtgtactcactcaacttgtccttctcccttggctcaatcagcacacccaacagctgaagaacgattttgagagtcgcctccgtcgctttcacgtttgacagttgggcaatttcggttcagtgagtgcttctgtttaagcacaacactcgtctcttcgatgaacaattccgtcgggtcagccaattcgccgttggcagtggcggcagtctgacggacaatgcatttggacggcttgtcaaacgccaattagatgagtgccctcctcagcgagtgggccctcctgggccaccgggtgaagtcggaggtgacggcgagtcgggggacacgggggaagacggaccccccggactggacgccataacacttttgttggaagaagcccagaaatgcattatttgtgagttggaattgtttagctga

SEQ ID NO: 60305 - DNA, 848 bp, Heterodera glycines
  Genomic contig location: Contig_ID=SeqID_29833; Location=117..964; Strand=-
  SCN-specific regions: Sequence locations=1-483,506-848
tgggcgatgttgcaccgggaacaccactaccatcttttcacggcaatgctggcattaccaatgccacaacgcctttggccgttggaaatccctacggacccacgccgcatcaagcttttagtaaattaaacaaacatctgttaattttaaacaaagccatatcccgagtataatttttcagcccaaaaggatcttttccagtcttgcaaaattcaaataccgcctggaaaaccatattagcagatttttgacgcaaattagttttttatttttattaaagatgttgtttaggcgctgtcaaccctgttataggtgctgcgcctgctcagcaagacccttcggcttggactcagtattacaaccaacaacaagcgatggcaattgcggggggtccgccttcccaacctgcttcttttggtgccacgccggcacagcattaccaaacagtgcccgggactatgcaaactgctgtttcacaagcagcacagctccattcaacccaaatgcagcagcaacaaatccatcaacagcagcaagcgaccattgctcagcctcagcaagctgtttccgccggaatgggcgcagtttcttgtatattttatttgtataaatcgaatagttttctatatataaccgatttcaacacataaaaccgtttcctttgttcagcttctggcggacctgcgattaatccgcaaactggacaaccggactacagtgcccagtgggccgaatactaccgcaccatgggaatgcatgaacaggccgcactcatcgaagctcagatgaagcaaacccacgccgccgctcaggcacaacgtcctcagcaacaactttacatgcaatga

SEQ ID NO: 60306 - DNA, 254 bp, Heterodera glycines
  Genomic contig location: Contig_ID=SeqID_29840; Location=665..918; Strand=+
  SCN-specific regions: Sequence locations=1-254
aaatgaaaaggggacgaagtcggatgctcaacaacaaaatgagaatgggtctgcgatggcactcgaaaaagtgccaaaaatcgactggaaccaattcgaggtgggcacctcccccccccccttttgcccatttgttttgtttggctcaggtccaatatttggacttagtcagtgccctccattatttgctcaccgtggaagtgcctcgaaaccccgttcttggaaacaccgaattgaccgcgttgaaacgtttc

SEQ ID NO: 60307 - DNA, 3461 bp, Heterodera glycines
  Genomic contig location: Contig_ID=SeqID_6093; Location=194..3654; Strand=-
  SCN-specific regions: Sequence locations=25-314,336-768,790-1099,1137- 1369,1402-1716,1738-1997,2020-2409,2431-2516,2538-3038,3073-3209,3231- 3461
  Gene Ontology: Mol. function=methylisocitrate lyase activity; Cellular component=mitochondrial matrix; Biological process =glyoxylate cycle
atgtatccggaccagtcgctgtacccgtgcaattcggggcccgagttggcccggcgcatcaaccgtgccctgcgtcgtgccgatcaggtggagtgtgtagaggcggaggactacacggcacagcgcgactggtacgcgccaattgttgcggacgcggaggcgggcttcggcggtgcattgaactgcttcgagctgatgaagtcgtacatcgagtcgggcgtgtcgggcgtccactttgaggaccagctaggctcggagaagaagtgcggccacatgggcggaaaggtgatcagcagcagcgggagggacttgcaattaaatattggccgagattgttgaattaaccttttggccgcgatcctgaaatcagaaaatttttatgcgtttggcgtcaatgattttatgattcccggcctgagcctaattgcttcttttggtctcaactcttgggccatgttaattaagcagctaatgatcttttaattcccggtctaattccaattatttttttggtctcgcctcttgggtcatgcataattaagcaactacttagggtggaacataatttttgatacccaaattttttccaatatttaaaaattcataactccgttatttctgcgcctatttaaatgattctttttttattttgttcttcatggtgtcctcttttatatcttactatcgtttcactttttatttgattgatagatttttctgccttttttcccgaccatgccaaaattgaaaattggcccactaattttctcgaattttttatggtcaaaaaaccaaagctgatataacaaaatcttagtttttctatacaatttagaccagtagaatccgaatatggacttaaatgggacctatcttttcaacctgagcttgtactgctccaactccatgcatgaagttcgagctgtacaggtttgttgcgatcccagagaccaaatctaagaccatattcgaactcaacatacccgatttatcttgtttaattaaattcagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccattttcttacttaactctaactccctaaatacttttccattggtattgatctcttgccagaataatggcaacatattattgataataatggcgggtattttgaatcatgattgtgttttgttgaaattaaaaaaaatttttaataaaaaaaatttgtgtatcaaaaattatgttccaccctaagtaatatgagcatttaattcccggcctatttttttgtgcgaattaaataacaaggcaaatgataagggaaacactaatttaattgattacggaattttctttgcttggtctgatcacttcactcatggtcattacacatttgacttttgatcatttcaggtgttgatccctacggcgcaacacattcgtcatctgaatgccgctcgcttggctgctgatgtttgtttttttttaaattatttttcatatacacgaggataattaattttgtaaattgggtggagtgttttttaaaagagatattttttagatataaaattttccaaaaattaacgaaaaacatattctttaagaaaagaatagttaatataataagtaaataattgtttaatgacataaattattaagatttttcatcaaaaattaaaaacaaaaagataaattacaatggaacgcgtcttggtttttaaaagaattgacaacatttaaatgatgctgctgaacttgttgcggacgaattaaaaaaatttccgaatgtcttgcaaaccggaatttttacgtttcatctaacaaaattggaaaatagaaaaaattaagcaattcataggcaattctaacgcttcatttaattggaatttgttaaatcgatggtagaaagcaacggaacagccgaatgacgattgcgagcagatttgtgcggagagaagattggccaagcctccattctttgttcaaatcttttaatccccccccccctccgcctcgccatctcttcccatccaaattgttggttcagcatatgtattttatgcaaatgagccaattttacaaaaaaaaaaattacaaattgcacaaagagttagaataagaagaaaaattataaattactcgaaattttcaaaaaacacacccacctaattcgggatttcagaaaaacaaaaaatacacccctaagaatcgaataaaaaaaaataaaaatacacccctaaaaattgggtttttgaattcagccccccccccccccgaagccaagggtctggctacgcacttgcctcccaatttttgagggtcagaaattcgagtcccaaacaaatcaaaatcccctctcctccctcccaggtttgcggtgtgccaaccatcattgtggcacgcactgacgccgagtcggcacggctgttgaccacggacattgatgagcgtgaccatccgtacattgactacgccgccgggcgcaccgcagagggctattttcgtctgcgcgacgacaacgccattcagtcgtgcattgaccgtgccaaattctacgcgccccattgtgatctgatctggatggagacatcgtacccgaaactgtcggtggcacgcgaatttgcagaaggcgtgcgcaaggaggtgagccaaactcaaagcgagtgaatggaaaaactagtgatcggagaagcgaatgatcggaaaagtgagtgatctggctgctggttactctgctaattgagcctgacaaatcactttcgactcgagaaaagtctattgggcattccgttataattttggattttaatctcggaattagcgtttttttattttcctaaggaataggttatggcgaagcttttcttgcttaaaattaaatcaaattttatttgctaaaacagaaagctttcgagccatttttttttctaattgcattttaataagcattgaaaatctctttggaaaaggtgccaaaaccaatagtaaatgaacttgagaaattttgaaattctcgagtctcggaaaattcaattattacatgcatcaatagccatcaaatcccggttccgatcaggcttaatcagacctctatccgggtaaatttcgacccattatcccatttattttgcataaccccttttttgtttgttttttttagtttcctgacaagttgttctcctacaactgctcgccctccttcaactggcgtcagcaccttcggcccagcgacatggagaagttccaaaaggagctgggcgccatgggcttcaaatatcagtga

SEQ ID NO: 60308 - DNA, 61 bp, Heterodera glycines
  Genomic contig location: Contig_ID=SeqID_29843; Location=569..629; Strand=+
  SCN-specific regions: Sequence locations=1-61
aaaggctcaggaggcctttatttttgcgagtaaagcgccacacggccaaaacacaaaataa

SEQ ID NO: 60309 - DNA, 521 bp, Heterodera glycines
  Genomic contig location: Contig_ID=SeqID_29847; Location=1..521; Strand=+
  SCN-specific regions: Sequence locations=1-61,107-458,486-521
  Gene Ontology: Mol. function=structural constituent of cuticle; Cellular component=hemidesmosome; Biological process=cuticle biosynthesis (sensu Nematoda)
aatttggacactacggaaaaaataaatagaaattcttagtccaaaaattggccataacaagaatttttttattgtaaattttcataaattattcaaataatattttcgaaaattttttgtgtgcctattttttcaaaaattatttttgcgtcttgaatagaataaaaaaaaacaaaatctgctatatgaaattaaaattacgtaaaattaaaaaattgtaacaaaaaatgatttttaaaaagatggcgcaaaaaatttccaggacgaccgccaatgatctgtgaggagattgaaattccgccatgcaacccgtgcccgcctggcccacccggcaggcaaggcccaaccggacagcccggcacacctggcagatccggacctcctggccgacctggcaccaacggtgagtggagttaaaaaagtagtttttgttttttaattttacaattttaggcttgcccggacccccgggccctcctggaccgcccggcacgcctggacctactggacccgatggagag

SEQ ID NO: 60310 - DNA, 189 bp, Heterodera glycines
  Genomic contig location: Contig_ID=SeqID_29848; Location=244..432; Strand=+
  SCN-specific regions: Sequence locations=1-10,88-89,128-128,171-189
atgaaccacgggttcaagctgttcgaccagcaccataaacaaaatgtagcacagattgccgccgaagcagtgatgcaacacaatttcggagcagagaatatggaagaggaagtgcagaaaatggaattggccagggttaatggaaacgatcagcagacgataatgacgacgatggcaaatggaaataac

SEQ ID NO: 60311 - DNA, 459 bp, Heterodera glycines
  Genomic contig location: Contig_ID=SeqID_29849; Location=164..622; Strand=+
  SCN-specific regions: Sequence locations=1-244,274-459
atgggtgtttccggttcttcattgtctgcttacgtgcaagtcgcagtccacgtacgaaaagatgtttgacatgatcagaaaccgctggccgacatttgcaccgaaaaacgcatccatggacttcgaacaggcgatggtcaacgccctccgcgcaaaacatccacagagctcaatcaacttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcgtttgtgctgcttgaggacattacaccggcgctggcagcgctcgaagatcatcttccggatgagcttgagggcgttctcgattggttgtttgagtttaattttttttttcaatttcattag

SEQ ID NO: 60312 - DNA, 666 bp, Heterodera glycines
  Genomic contig location: Contig_ID=SeqID_29850; Location=66..731; Strand=+
  SCN-specific regions: Sequence locations=1-4,27-374,396-666
atggaaggaaaggaaaaaatcggaaatgaaatggaggatgaaattgggttgccgggaaatccgcgtgaagttcgatgttttaaatgtggacgttctggacattttgctcgtgaatgccgtgatgctggagaccgagaccgtggacgcagagtttggcgcaattggggcgacgctcgaggtcgaactggacgtggaacgtggcgaaacagcgaccagaacgaagtcggtgagggcccgtccacttcgacgtcatcagcgcacttgacggacttcggcacgttcttcaattacatcggaggaaaccaataaatgctaagcgatcggacattttcattattcattcaaattatcttactctttttaatctttaatttctctattttttaattgtattagtcaggaccggggacggtctattcggagggggccgatgatatacttaatttcttaattctctctttctctctcttatcctctgatcattgttcccccgtcaatgtcagcccggggggcggtccttcttttcactaatcgagactctttataagtgttcatccgcctcttctctctctcagtcttgcccggggctcccgcccatcagtctctgtccccgagaccgaatcgggttgggggttgcccattgtatcctgaacattggacaccaga

SEQ ID NO: 60313 - DNA, 618 bp, Heterodera glycines
  Genomic contig location: Contig_ID=SeqID_6094; Location=350..967; Strand=-
  SCN-specific regions: Sequence locations=1-22,110-255,292-358,417 -436,463-491,513-558,586-618
atgaatctcatgaaaagtaaggaattttaaataaaatttaaataaatcgatttatcctttttgataaaaatgttaaaataattatttgacaaattatataaaaaaaattccggcggctcctatcggcaccaggctgggcgaagctcggcttaacactcgaagccgaaggcgaagcccaatttttattcgaaggcgaagtccgaagctcgaagctcaaaaaacccggttttcgaagttttgaagccgaagccgaagtttttttcaaaattttttttaatttcaaaaatttttcatcacaaatttcggttagataccaaattgattcaattgacaaaactgctaaagaccaacaaacccgataaaaaaaatataatgaactttttgatcaatatattttgaaaatttttataatttttgagtattcacggttttgactcaatttaaaaatgaaatataacttttgggtgccgggggtgccgataggcgccgccggggaaaattttgaaattttagtgcgttttgttaatagattgaattcaaaaatcaaaacattttgcgattttaatttttaattgtattgaatttccgtctaaaaaaggaataattttgaaaaataaa

SEQ ID NO: 60314 - DNA, 1615 bp, Heterodera glycines
  Genomic contig location: Contig_ID=SeqID_6094; Location=1785..3399; Strand=+
  SCN-specific regions: Sequence locations=1-244,281-413,435-546,571 -924,947-1314,1337-1482,1513-1615
atgaaaagccacacaacgcacgaactgccatctttttatacagatgagcagttacttgcgtacatagacctaaaatttggtaatttaagcagttgtagagcacaaataaaatactttttaaggtggaataggtaatgaaattgctcatcatggaaatgtgcaaggtggaataggagatatgcaatcgattcgatctgccgcatacacatacgtaagttaccactaaataagttttctaaatagcttaaaattaataaaatttattcattaaaatttatatcgttgcgtctttctatcgcaaaatacttgtaatttagcctctcggaatttggaatttcttaaaaacaataataaaccgagggatcataaagagagttaagcaccctattattaaaatttttcaagattaaataggcaaattttttgaaaattttacaaagttttcttatatatctatttaaatttccaaaaatataactcaaaaatggaaaaagtattcgctttttggcaaaaaaccactataatttctgctttccgccccagcgttgctaattttacaaaaataaaattggataaaaaattattttcacccatagagcaaaaaaagctctttggatgccctccccgaaatttttttctggatacggcctctcgaatcgggcgtcgcacgaatcgtcaaccacacaaaaatttaaaattttgagttttaattcttaatttaatcttatttactttgttcaacttaattctaacagtatcctatcattaaattaaattcataattatcaatttcttaggtgatgaagcagatattcgcatttaaccaaattcgactgttggctcttccgtctgtagttagcgccgacgttgagagccaaatgcaaaaaatcattaccgaaagaaaatgtgctgtggttgctcgacttcaaaaaccagaaatcaaagcgaaaacagtgcaggtaataattggtttaatttggatgtgtctaaaaattatttcataaactgaggatgctctcaaaaatgtgatagccacgcggcaccgtttagaaacctttaatttatacataaagcggtgctagtgcacttcacaaaaaatactgatttgggcgctccacatatgcccaaagcggggcgcatcaaaaagtgcaaatttgggcagttaacaaattcaattctgggcgcttcaaaaaatgcaaaaaacaaaatctgatttttaatgttttttaccaatttttaaattatcaatatgtctaaatttgattgaattgatgcttaaatacccattctttctaaaagttttgctggatttcgaataaaaaataattaaattttactgataattaaatcattagtcagattactgttaatttttaaatattgattaattacgaatggactaaaatcaaaaaataccgatgaatggaaaattatctgtaaatgtatctgtttcatctctacgtggaatttcttgggccaaggtctatgctaaagctttatttttgaaaatttataggctccatgaaacttcaagatttaaaaaattctaagtaatcggttaatgatttttttttaatgtgcagtaatatttgattatttttttattcgaaatcca

SEQ ID NO: 60315 - DNA, 501 bp, Heterodera glycines
  Genomic contig location: Contig_ID=SeqID_6095; Location=714..1214; Strand=+
  SCN-specific regions: Sequence locations=1-136,158-342,378-430,457-501
atggacaatgccatggcctcaatgtgcgagggcgaacgtcgtcatgtagtgatcccagccgcattgggtgggaacccacgtttaaaaccaagggtccccggcacaaagctcatgaaaatttctggcttctttctccctgtttatttatactgtttctcctttgttataaaattgatttttttttattttctaattaggctatggcgacaagggccatgacaatatcccaggcggcgccagtcccaactttgacattgtgctacacaaactaatcaggccgagagcaggcgaactttgataagcaggacggacaaatgataacatggcacagagggaatcgtcaattaattaattattattaatttatcaatttatttccaaattaaaatgattgcttttacctacatttgatgatgtttttcaaatctccttttaatttctttatatatttcttttgatgcttaaatacccattctttctaaaagttttgctggatttcga

SEQ ID NO: 60316 - DNA, 541 bp, Heterodera glycines
  Genomic contig location: Contig_ID=SeqID_6095; Location=1934..2474; Strand=+
  SCN-specific regions: Sequence locations=1-106,128-158,184-268,291 -321,370-381,404-541
taacctatgcgtttggactcagcgacaattatcaggtcacgtttcagatcaaacatgtgaagttgtggtaatgcttctcgttctttccgtcaacctgtcaagcgaaagcaaataaaatattgtaaaattgggtagcgccgatgcatatattgaaattcattaaaaatccaattattaaatttgtccatcaaaattttggcgaaacaatataagccctgaattttacacattttcctgtggcggtatcaattttaacaattgcaaaatctgatgctcgacgttcatttttattttcctaactctttattaattctattttcttctctctcactctcttgctttctctctctctcctctcacttctttctcgttgatctcagtctttctctttctctttgtttttattttgtttcggcataatatttcggattgagcacgagaaacggcagcagcctcatgttgaaggagaaaagaccaagaaaaaggatggttgttccgaggcgattgtgcatcaggaaattacatcactcactggagtggt

SEQ ID NO: 60317 - DNA, 2057 bp, Heterodera glycines
  misc_feature (88)..(88): n is a, c, g, or t
  Genomic contig location: Contig_ID=SeqID_29853; Location=164..2220; Strand=-
  SCN-specific regions: Sequence locations=1-493,515-733,756-2057
atgaccccaacatttgtagttgacttttctaaggcaatggttgaaggcaaagatttggaagagctgaaggcattaattgaagaatttncagacgtttttagtaagtttaggtatgatctgggcttttcacagctgctgaacatcacattacaaccacaactgaggaaccaatcgcatctgcgccaagacgaatgccgtacaaatacaaagaggaattgaagaagcacattaatcagcttttagaagcaggagtcatggttgagtccgataccccatgggtaactccaattgtcattgtacagaagaaggacggtggaattcgtccttgtttagactttcgcaaactcaacgaagttacggtgcccgacaagtaccctctcccacgccttgatagcatcatggaaagggttggaaattgccaattttacagctctcttgacttggccagtggctattttcaaattaaattgagtgaagaaacgtcaagaaaatgtggaattataactgaagacaaagtgtaccaaatgattacgatgccatttgggctgaaaaatgcaactgcagcattttcgagggccatggctatcgttttgtctggattggaggatacttcattggcctacgttgatgatgtgctcattttcacaaaaagtccgaacttttcagagcacctaacggcggtaaggaaggttttggagcgttttcggctttacaatctgaagcttagcccgaaaaagtgcatttttgcctcgaatgagatgaattttcttggatttgttttaacagctgaaggttttaagccaagcttaagtcgaatcgaaattctcaaagaaatgcctgtgcctttaaatgttaaggaagtaaagagagtgctaggacaggcaggcttttacagacggcacattgagaactttgcaatggtcgtagagccattgctgaagcttacgaggcaaggcaataaattcgaatgggggcagggaacagcaaaacgctttcgacaagataaaagaattacttacgcaagccccgagtttaatttttccagattacgacaaagcatttcacattttcactgatgcatcatcgactggacaaggaggagttttaatgcaaaaggatgacgtgacgggcacattttctgccatttcctattgcagcagaaccctctctgctgctgaaaggaaatggccggcagttcaaattgaaatgagtgccattatttatgctttaagggaattcagaccattcatcttcatgtcggacattgaacttcacacagatcacaaacccctcgcgtttttgctgaaaaaatccgaaccaatcagcaattggcacgatggctcattgactacaaaattatcaggtcaaaattgtccacgtggcgggaaaagccaacactttgactgatgcactttctcgtgccgctgaagacaagcccttgtcggagatatacaatgtggatgaactcgaggatattatcgaatttccggtctgtctcgctttggcggcacattccagggtggtcgcggacccatttttgcacactttgaccatccgacacgaggatggaaacacttacaaagttagtttgttggaagagcaggcaggagatcctgaagccgcagcctacattgcgtttgtcagagatggggaatttccagctgatttggatgagaaagaaaatagttatttgctgtagcactgccaattacaaattgatttcgggaattctttattttgaggacaagggactccctccgaggatctatgtcccaatttcgttacgtggactcatttttgaatcacttcactcgtctcttttgggtggtggtcatttgaattacaggaaaacaattgccaaatgcaaaaaatatttttggcccaaaatgtactctgacgttttaacttgggtcaaattgtgtgtcacctgccaattgagacacaatccaacacccgcgtaccgggaagagatgctcatggtgccagccaacacactttttgccaaagttgggctggacttggccggcccctttccgatcacttaaaaagggaataaa

SEQ ID NO: 60318 - DNA, 1056 bp, Heterodera glycines; identical to SEQ ID NO: 29854
  misc_feature (960)..(960): n is a, c, g, or t
  misc_feature (1040)..(1040): n is a, c, g, or t
  Genomic contig location: Contig_ID=SeqID_29854; Location=1..1056; Strand=+
  SCN-specific regions: Sequence locations=1-857,879-1056

SEQ ID NO: 60319 - DNA, 375 bp, Heterodera glycines
  Genomic contig location: Contig_ID=SeqID_29856; Location=65..439; Strand=+
  SCN-specific regions: Sequence locations=1-177,199-375
atttaagccaacgtgtagaaagtgtgcgggaggagagcacgcgattgagggcggagaatgtcgtgttgggaaagtacatcaaaaatttgatgcgttcgacttcgctcttccaaccgacgaattcgaaggaacaaccgccaaagtaataagagaacgctttacatttggagtgaaatgtttgattgtgttttgctttgcagttcgaaaccattttattctgggttagaattttttgctgtcaatatcgctgtttttccatgccatatttactgaattagagcccccccccccatgtggctctattttcaactcccctcggaaggggttttatttcaagggtgattctaattcagaggggtggttttaattcagtaa

SEQ ID NO: 60320 - DNA, 624 bp, Heterodera glycines
  Genomic contig location: Contig_ID=SeqID_29856; Location=773..1396; Strand=-
  SCN-specific regions: Sequence locations=1-80,102-624
atggtccaacctcgaaaatgtgcaattcctaagctcaaactcaatgatgtcgagcaattccgaaattggtttcttaaaagtttaatttaattaaaaatattccgtttctttttaagttaatttgtgctcagaagtgcttgagatgttgcaaatgggaggagaggtgtataaaattattagatttttaatgatttatgtttttaggaccaatttcacgatgcttcgctttttgatatttttatgaacgaatacacagggaaatgactcaaaaacattaatttatgattgtgagtgctttattttcttcctcagttccgattttttatttttatggactgatctccattgcatataattattacaatcaatcggttggatgatcattggtcccttttccaaaaatcgtaaaacattttaacgtatgatgcccgaaaaattttcaaaaaataagacgaatgcagatatttgtatttgcatttagccggcaattgttgtgtagcttcatttatttcaccaaaattcatcgtaaaccatcttttcttgtgaatcgcgcctaaaactaattattaacaacaaaagctttattttgctgcaagcaaaaaattacaaaaaaaaaataataaa

SEQ ID NO: 60321 - DNA, 658 bp, Heterodera glycines
  Genomic contig location: Contig_ID=SeqID_29857; Location=107..764; Strand=-
  SCN-specific regions: Sequence locations=1-658
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttt

SEQ ID NO: 60322 - DNA, 662 bp, Heterodera glycines
  Genomic contig location: Contig_ID=SeqID_29857; Location=269..930; Strand=+
  SCN-specific regions: Sequence locations=1-662
aacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 60323 - DNA, 256 bp, Heterodera glycines
  Genomic contig location: Contig_ID=SeqID_29858; Location=35..290; Strand=-
  SCN-specific regions: Sequence locations=1-9,32-256
atgaacagacggtaagcaatttgaaaagtcacaaattcttatttgccctaatttactttcattatttcagttggatttgcaacgacgtttggatggacattttcccctcttttgaccgtgctcaactcggcctcaaattggcattgctttcgccacgtttcaatgcgttggtggacaaacattttgatggcaaaagcgaattgactatttggagaacgatcgaaattagcaaggacaaaggaccagaaacgaaact

SEQ ID NO: 60324 - DNA, 225 bp, Heterodera glycines
  Genomic contig location: Contig_ID=SeqID_29860; Location=219..443; Strand=-
  SCN-specific regions: Sequence locations=1-225
atgcctcagccccaattggtcgcagttggtcctcgctccgccctccaaataccgtactccttcctaccgttcgccttcgactttcacgtccttttgcaacgaccacaaaggaaaatgtatcagcagcagcaaggaacaacagttggagcagtacacggacaaaaacagcaacaagagaacgaagtgccattgctgagcattttggacatggccaacacaacactg

SEQ ID NO: 60325 - DNA, 398 bp, Heterodera glycines
  Genomic contig location: Contig_ID=SeqID_29861; Location=1753..2150; Strand=-
  SCN-specific regions: Sequence locations=1-32,54-104,158-249,293 -346,368-398
atgtgtccaggattatttgacaccaaaatgttctgttacattctgtgtctgctgcttgttcaatcacgatctggtaaaaattgtattataattaattagccttgttaattaacaaaaaaaaacaataaagaacatttaataattaataaaaaaattactttgcttaaattaagatgcaacaaaaaattgttatgcaggccaaaacagcgtattcgaaccgaagcaatgcggcaacgaaagttttggtggtaattttttgaaattattaaaatgaataaatgaaaatattaaagatgatgacacttttgtttgtcaaacctacacttgtgatggtggaaaatgtaagaatcttttatttgtgcttcgttaattgacctaaatataaagcattaaataaa

SEQ ID NO: 60326 - DNA, 926 bp, Heterodera glycines
  Genomic contig location: Contig_ID=SeqID_6096; Location=118..1043; Strand=+
  SCN-specific regions: Sequence locations=1-155,177-926
gtgtgattgcgtatgcctcccgaacgctaaattcttcggagcgcaattactcgcagattgaaaaagaagcgagggcaatcattttcggagtcgacaaattcaagcagtacttgtacggtcgaaagttcgtacttcaaactgaccacgagccactaaaagagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattggcgtgtccggaagagaaaaccatcgactgtgttggactggaagttcagcaagttcaagccgaaatcccatcgcaaaagaagtcaaaaaggatgaaattcttcgaaaagtgaaagaattcatcgaaaaaggatggccacaaaaagtcgaagaaggactaaaaagttttaatgtcatccgaaatgagttcgccttaatggaaggggcgccggatgagcggaaagtgccattgcatccgtgggaatcaccggaaagactgtggcaacgaatacacaccgatttctgcggaccattttggggatcaatgtgctgatcagcatgtatgccaaaagtaaatggctttaagtggtcagaatgcgaacaacaacggtattggccacgattgaggcgctaaggattgtcatcgaatggagccgctgagagatttgttcaaactttcaagcagggaatgaacaagctccaaaaggaggggatgaagcaagaaattgcattgtctcaatttctcctgaaatacggtgtcacaccgcacgcagcaacagaattggcgccttcggaaatcctcttcggccgcaggcttcgaactttgttggatttagtaaaaccaaccgcggcgaatgattttgaaga

SEQ ID NO: 60327 - DNA, 1421 bp, Heterodera glycines
  Genomic contig location: Contig_ID=SeqID_6097; Location=867..2287; Strand=+
  SCN-specific regions: Sequence locations=1-267,289-289,311-649,677 -734,781-905,937-1105,1127-1130,1160-1370,1392-1421
atggagaaattggcaccgcaaaattattgtctagccgattcaacagcatcatctttggcaaaagctgcccaaatggaattggacttcatccaaagcgttttgttgggcccacagcgaggaaatttgacggcaattgaatgtttattggcacaaaactttagcaaacagtcatcaatgatgccaaattatggcacggaacgtaaaaatgcaaaagtaccaaaattagaaatggaaaaggctggtggtggtgatgaagccaaattggacaatggaagcgagaccgatcaaagtgatcagaagcaaaagagaaaaggggtgggacgaccgaaaaggcatccgagtgaatgcaaagtgtgcgggaggaagagcttttactgttattacagtgtccgatgttgtgaaagtgagtgatggaaaaagaattaaataacgaaatcccgataatcatgtgggatccccaaaaaaagccacgtgatagccgggatcgggaaatgcctggactccgtcttgggatccctcccgatggttttccaaaatctttgggattgatcggaatttggtcgggaacccgactcgggatccctctgacaccagtggccggtctctagtgtgaacaggagttcggcggaagtacagcactttttgccgaaaagaaaactgaaaatggaaacatttttcaatggaccgaaaatggccatccctaatttgaaatgaaaattgttcagcagattctcttttaaattcattaatatataatatttacaaatttgtataaattaaggctgcaagcaattctttcgtcgtattgttgccaagcgaacattgttcaactgttttggagcgaaaaattgtcaaattggaaaaggttgataaagagaaaaaaactaattagcccaaaacattggaatatttatttaaaaagtattaatattttttcagatggcattcgatgccgcggctgtcgcctggacaaatgccttttggccggcatggacccgacaatggtcattgcaatgcaacaggaaggaatggcccaatatttggacagattggaattgcgaaaaaggagtgctttgttgtgaaagaattgcagagaagggaataatttgtttttgtgaccaaaattatgctaaaaaatttttattttattgtattgagaatttagaatatttttgtgattaggtctccaattatatgtaggaatccatatatgtttttatcctagactgtgagagacaaaaaaaaacaacatatttttagcttggttggaagcttttaggatgaatatctatatccatatttttcatatttcgcattatgtccataatttatattttcatatattatgcccaaaagttggtgagatcgtgtcaaaaataagtcaaagagttgaaaaattcgctttttagcttcttttttta

SEQ ID NO: 60328 - DNA, 586 bp, Heterodera glycines
  Genomic contig location: Contig_ID=SeqID_6099; Location=856..1441; Strand=+
  SCN-specific regions: Sequence locations=1-292,314-586
atggtgttttctattcttttggcattctgtcttgcggtaccaatccacttcgtggatgccaagtgcgcgtcggatgtcgtggagggaaacaaattgctttcaaaccgtaaaaccataatgaaaaacccacctaaagaaatcggaaagaatgatgatacggaaattaaacagtttgtgcgagatctgttggatcattacaacatggtaggtaaagtactgttcgtggatcagagccaggcaatcgattacagtgtgattgaagcgatactgtacaaaagtgaccagacaaaggtgatcagagaagatttttgggctaaaattgaccacttttttttacaatatgtatagttcaaattagggttgctacccaacttttggagatacaaaagtccgggatcaaaatttcgcgatggctggaagaaaattgaaaaaatgcaaaccaataatgatcattctagataagtgatttgtcaaaatccaattcaaatatcgaagaaattgtcaatgggattggaaagatcacgttgacaaagtttgataaaaaaggaaaaaatggtaaaaagttaaattttttgtatatctaata

SEQ ID NO: 60329 - DNA, 410 bp, Heterodera glycines
  Genomic contig location: Contig_ID=SeqID_29863; Location=1098..1507; Strand=+
  SCN-specific regions: Sequence locations=1-150,173-410
atgcattgtggagcggtcagccgatagtgcttcatcatccaacatgcgatcatgcaccccgtacggccaagtccggcctttaaagaaaagttgcaaaatttttgtggctcgactaaaaaaacaaaaaaatttttgggccattttttgataaattttacccacctccataaattcttttaaaacagtaactattgtaaattttcagctttttttttttggttacggcgccgccaaaattgatcagagaaaaattgatttaatgaaaatgccagcaaaatatgtgttaattattctcttacattttaatgcccatttgtcatgggttcggatccgcacgacagcttggtgatttattttgaattttttttctaatcatttttttgatcacttttggcgccgagaaatttaca

SEQ ID NO: 60330 - DNA, 1812 bp, Heterodera glycines
  Genomic contig location: Contig_ID=SeqID_29863; Location=1..1812; Strand=-
  SCN-specific regions: Sequence locations=1-87,109-543,566-1064,1104 -1126,1193-1196,1218-1245,1267-1812
  Gene Ontology: Mol. function=protein tyrosine phosphatase activity; Cellular component=nucleus; Biological process=protein amino acid dephosphorylation
gttcaccgatgctggctttgcacaccatgacttgtacttcatcgacggttcgacgcccaccgaggaaattgtgctccgatttttggatgtcgtcgattcggcgccgggcgcaattgcggtgcattgtaaagtcagtttcttttttttgtgtcaaaactagtaaaaaggcatggatttttatgaaatctctttgattttgagggtttttggtaaattttatggcatttttatccatttttgggccaaaagaatttaatcccccctcccatccataattcgtcatagagcatattccatttgtttattgtaaatttctcggcgccaaaagtgatcaaaaaaatgattagaaaaaaaattcaaaataaatcaccaagctgtcgtgcggatccgaacccatgacaaatgggcattaaaatgtaagagaataattaacacatattttgctggcattttcattaaatcaatttttctctgatcaattttggcggcgccgtaaccaaaaaaaaaaagctgaaaatttacaatagttactgttttaaaagaatttatggaggtgggtaaaatttatcaaaaaatggcccaaaaatttttttgtttttttagtcgagccacaaaaattttgcaacttttctttaaaggccggacttggccgtacggggtgcatgatcgcatgttggatgatgaagcactatcggctgaccgctccacaatgcatggtggtgctttttttctgtcaacaaattaaataattccgttgttttccgacggcggattttcgggtcaatggcatttctcatacaatataaaatttttctgggattgaaattgcaatttcctataattttcatttaactttttcaagggttggcttcgcgtgtgtcgtcctggatcagtgatcggtaggacgggaaaaaattgagaaaaaatgacatactactgtatttccgaaaactcaagctcccagtggatattttcaatccccctctaaatggattctttatttcaggggaggggtcttttttttgggctcccggacaatctgtcagtaatggacaatccgtcagcaaaatttatttttaaaaacaccacattttatttaaaaccaagtgaaatgaatttcaatcgctaaaaaaatgaattaataatttgtgttattttataaaaaaaaaaatatgaaataattattttttaacgaattaaatgataatttctatagatgatcaattaaatgaagtcttaaacaattaccaaatgttttaaaaacctagataatttatttgttgaatttaacaatgattttcgcaagatttttgatcattgttcaaaataaaatttttgacgaattgtccaccgacggattgtctgtccttcactggcggaatgtcctgatccctttttaatgggggggggacagtattttaggaaataccgtacttaaaaatcacatatcaaaggtcctcagcaacagtttctgatcgagaaacaggcgtggtgttggaatttgggcaaagccaacggactatggaatacaaacaggcaatggaggagtagtgggagggagggggggggacatgtactaaattttatcagaatttgttgaaatccaatccaaacttttcaataggggttctcatatgcccgttaagcgtggggtaattctttagaaaattttgggttaattttctttcccaattttcattaaatttgcaaaacttttcctcatcggcgcatatcagctgagctctaaattctgttaaattttcaaaatttggcttaaaattggtcatttctcatttatgtccaacaattaaa

SEQ ID NO: 60331 - DNA, 141 bp, Heterodera glycines
  Genomic contig location: Contig_ID=SeqID_29863; Location=1689..1829; Strand=+
  SCN-specific regions: Sequence locations=1-16,38-141
atgcaccgcaattgcgcccggcgccgaatcgacgacatccaaaaatcggagcacaatttcctcggtgggcgtcgaaccgtcgatgaagtacaagtcatggtgtgcaaagccagcatcggtgaacctttaactcacacattg

SEQ ID NO: 60332 - DNA, 216 bp, Heterodera glycines
  Genomic contig location: Contig_ID=SeqID_29864; Location=816..1031; Strand=+
  SCN-specific regions: Sequence locations=1-216
atggtctacgcctcattcacaacaaaaagggaactccatgttcggtccctcctcgatagaaggggaccggtaaactggacaccagaaaattggacaccggaaaatgggggaccggtaaattggacaccaaacggaaaactggacaccgtcggaattttggacaccaaaggaaaattggacactggaaaactggacaccaaattcctcttttaaaaa

SEQ ID NO: 60333 - DNA, 100 bp, Heterodera glycines
  Genomic contig location: Contig_ID=SeqID_29864; Location=171..270; Strand=-
  SCN-specific regions: Sequence locations=1-57,79-100
tgttcggtccccgaaatgtcgaatggacgaacaaataaatatttattgaagacaaattaaaataacaaataaatatgtcggaggacggcggaggagacaa

SEQ ID NO: 60334 - DNA, 554 bp, Heterodera glycines
  Genomic contig location: Contig_ID=SeqID_29865; Location=504..1057; Strand=-
  SCN-specific regions: Sequence locations=1-216,238-554
gtttcggggcagtccccccgaaccgatgcgcccagatttatggggagaccgaatccttccggaatagcttccctatagtctgtacttaattctgcgttggatttttgctccccataattgtttgagtaccccaaacggacacttgaaaaaatcgatttttttgttttcggggcagtccccccgaaccgatgcgcccagatttatggggagaccgaattcttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcggga

SEQ ID NO: 60335 - DNA, 77 bp, Heterodera glycines
  Genomic contig location: Contig_ID=SeqID_29867; Location=132..208; Strand=+
  SCN-specific regions: Sequence locations=1-77
ccttgatgttgagcagtgaacccgaggagcgtgccctttgcaaaaaacgcgacatcgaaccggaggacatgtattcg

SEQ ID NO: 60336 - DNA, 206 bp, Heterodera glycines
  Genomic contig location: Contig_ID=SeqID_29868; Location=205..410; Strand=-
  SCN-specific regions: Sequence locations=1-206
atggctgatctgaacaatttaacggtaattaacaaattatttttatgtgattattattttttaatgaatttaagttctttttggaattcgcaaatgaaactccaaactggaaactgatcagctttgctaccatatttggtttcatcgccactcttggaattgttcttaatttttcagtcatttatgtcaccattaggacaaagtaa

SEQ ID NO: 60337 - DNA, 737 bp, Heterodera glycines
  misc_feature (704)..(704): n is a, c, g, or t
  misc_feature (713)..(713): n is a, c, g, or t
  Genomic contig location: Contig_ID=SeqID_29873; Location=801..1537; Strand=+
  SCN-specific regions: Sequence locations=1-102,152-189,211-283,323 -350,373-493,640-737
atggcaacaattcaatttttgaaaagctttggcaaatgtacggcaaaggtgagttagggaatgccaacaaaatattatgatgataatgaaatatttacaatgtttatttcttaatatttttaattatttctacaatttgaatttttaaaatgtccaatatcaaaaggcaaaaatccaaaaaaaaaacatttaacattttaaaaagatcaacaaatgcaattgaccaacataatatgtgaagcggataaaatgtattgcattttggaggcaattaaaacggaagtaaaaattaatttattataattcatataaattttaatttctcaattaaagaaaccaatttgttgtaatttggtaaaaaatgatgaatacaattttatcaaaaagcgtatcacattaattaatcacagtgatccgccgttgagccaagtgatggacactttaattgttacactaatgagaattaaaaaggcaatggaatcgggtaaaaagcaaataatatttttattttaataaaaaaaactcctattattttgataatttttaatataactttaatttaaagttaaaataattttttattataaaaaaaacaaatttaaattaaaaattatttttttacataaatataattaatttcctcatataaaatttaggaaattttggcgattctctgattaaaatggtcaaactccgtttgaaanttgcactanaatttgctgcaaaacgtcatggaa

SEQ ID NO: 60338 - DNA, 721 bp, Heterodera glycines
  Genomic contig location: Contig_ID=SeqID_29874; Location=326..1046; Strand=-
  SCN-specific regions: Sequence locations=1-119,141-200,223-721
atgagctttcgaatgataccaaaattacccaatttgattggaaataccttcaaaaatgaatttcacaaatcgtcattttttaatttttttggacaaaaaataaataaaaatactcatgttgcacacggactcgaacctcaaccctttgtctctttaccatcttacaaaagccacttagccacacatgcaaatcttattggaactgaaaggtaaaattgaaatggtgtgtatataaggggaggattctttgaatcgacttattttttgaaccaatgcgtttttatggatgcatcctaaaacgtcgtcggccgaagcgtcgccggaagactttttgcaccataactttgttcattgtcaatcaaattaagcattctttggtgttgttcgatagctctatgtgtttattatttatttgcaaaatttcataaattttcgttaagttaaaaaagttatggccagaatgaactcaaaatctaatctttcgaactttttttgccttgttttttttgtacatgaataaaacttcttgaaaatttgcaggttaatagagtttttcaaatgctttcgaacaataccaagaatgtttaatttagttgagaaagaaaaaatttgtgttgcaaaaattcgtccggcgaaacgtttcggctggcgacgttttttcctggtccggtttttaatacctcgattcccttttctgtttaaaaaaccaaaaaaatcttag

SEQ ID NO: 60339 - DNA, 317 bp, Heterodera glycines
  Genomic contig location: Contig_ID=SeqID_29876; Location=497..813; Strand=-
  SCN-specific regions: Sequence locations=1-190,213-317
tttaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttaaaaaatttttttctccatcttcctttttgatactaaagcatcagagtgctaaaattgacttgtaaataaaatttggtgcgctttagagcattttctgaaaaaatatttatgaattaa

SEQ ID NO: 60340 - DNA, 609 bp, Heterodera glycines
  Genomic contig location: Contig_ID=SeqID_29877; Location=698..1306; Strand=+
  SCN-specific regions: Sequence locations=1-609
atgataccgaagggaacagcgaagaatggcacaaacggacggaaaagggccaatttggccaaggagccgaagggatttcacaaattcacggccgaatatgcgagtccggaattacacgtgatggacgaggagacgggggtaattaaagcgaaaatcaagtggcaaaaagcgaccgaatttcaggcgaaagtctcgccaaaatcggacatgtgggcattagggattatgctcattgaattgctaatcctgcaaaatccatcattttatcacctgagggaagaagaagagaaacgcgacaaattggaagtgagcggacaaaaggccaaaacggcacaaaagtcaactccattaaggcggatgttcggaaacggttgatggaaattggcgcactgtacaaagggtttactgtagacaatcgaagtgggcacattgtgccaattgaattcgaagaatatcaatggccatacgcattttgggatgcgctgtacgatattctgcgcatttggagacattttccgcgaacggcgcttctgattacggtaagtgggcgggaagggggaagggtacggtaaatggaaaggtgaattaagcattttgtaattagcatta

SEQ ID NO: 60341 - DNA, 1695 bp, Heterodera glycines
  misc_feature (1669)..(1669): n is a, c, g, or t
  Genomic contig location: Contig_ID=SeqID_6102; Location=143..1837; Strand=-
  SCN-specific regions: Sequence locations=1-130,171-185,211-218,240 -807,845-885,953-1223,1247-1325,1369-1507,1530-1575,1597-1695
atgccatcgtcattcgcttccgtgtggaagcattgggccaattttctgggcaatctttacctggctaaccagtgagtttacttcactttttttcaatgagttttggttaattttaagacgttgctatttgaattaaaatttaaaaataaaataaatttttgaaaaattttcctagcagattttaaaatttatgataaattattaacaatgcaattaaaaaatttcaaaattcaccactttagctctgagagttcagcactgagcaccggtgtgcaggccatggcgtccactttggagcacatttcgatggtcggtgcgcaaaaggcgcgcacttctgtcgccaaattgttgtggctgctcaaaattgcctccgcatgcccttccgaaaagctgatgaatgccgtggatgagctgctgttccgctacgtggacaccattcagccggcgaattggcttttttggtgtgaatggcacattttaaaatgggcactgttttctcttaatttgcactaaatccaggttgaacgaactgatcactgatgttcaacagcggaggggtaacgcgatggccgagattctaaagcgagtcggtctcctgcagccgcaagaagtgttctgcgcattgcgcgtcgaacttgggccaagccatgttggccgttacatccaacaatgttcgtaagacattcctcggagtgtttttttccattcaattttctatgaatctttggaagtgtcctaaaatttgagaaacctgtcgatacaagaacaaaaaaaaagtggaatttctttttctccctatttttttgcatattttttatttgaaaaattttaaaaacataattttgataatgaagcccagtcccgctcttctcttaaaaactgaacttttaaatttttcaaaaattcttttttattttattttttaatcattttttgttttaaaatataataagtttttcaaattttcagtcataaatcaacgacaactgcttgcttcttcgggtgcaaatgcctctgctgctactactgccgtttctcaccatccttccatggcattggcatcacaacaatcatcatcatccgctggtgccctaattagcggtgaaaaccgactgttcgatgtgttggatgccattctgaatcgccatttaacgcaaatttgcgtactgaaccaaatgctggacgaacttgacaatttcggcattggtccagccgaggcattcaattaaaatttatattttaattaccattttttctgaattttagttcacattgaacaaatttcgtcattttctctccatctgccatttgtaagacaaataatcgagcaatttgcaaatttatttactttcttttttaatcgatttcagtgatcagttcaccaaaatagccgatttgaccaacacaacatccgatcctcagctgctgaagagtctcgttgaatggctgcaatcacccgaaattgtgatggccgttaatgctaacactgacgaagggaaagtaagtgtaaatttttttatttttttattgcctatttatcattcgcttctttttttttctcgttctctgaaagttttccatcatatttaatgaatttaattgtttttttcacagatgttcaatgagttgctcaatgatttcgccttttgctgttccccatccttcctcnccacaacaacaacaacaacagcgtga

SEQ ID NO: 60342 - DNA, 1237 bp, Heterodera glycines
  misc_feature (1196)..(1196): n is a, c, g, or t
  Genomic contig location: Contig_ID=SeqID_6103; Location=61..1297; Strand=-
  SCN-specific regions: Sequence locations=1-179,202-374,396-771,793 -1100,1140-1237
  Gene Ontology: Cellular component=PCAF complex; Biological process =signal transduction
atggccgaaaaattggtggcacaactgaatgaccgcctgtcaaaaacgctgtcgtcggatgccatcagcggactttccaccgctctacagacggaacaaagggcatgggaagaatgctggaccaggtgagcaatgctcacaacccatttctatcgatcatatcattagcgaggaatttgaattaaagtaaaaattaggagacccctaattatttatgtaagagggtaagttgtaaattttcagttcatgtgtgcagttgaacgattgggcttcgttggaccattttgccaagtcggaagagatttcggatgccgccctggcgatggagtcggcttggcaccttcacgattggaaccagctgaagtgggcactttattattttttaaatatgtcaaaaacatattaatgcatttttgtaactaaaagcaatccttttgtttttaacacagtttaataaattttacattccatccatttttaagggatcgctttgcccaagtggatgccatttcgagcccacagactgccgtgcgatcaacaatgcttcaactgatgcttaatgtttgtagttttcacaagccattcacccattaaattatgcatttgcatccgtttaggtgaccaattttcggctgaacaaggagacaatcgaacgccaactgatcgatttgtacagggcactgattagtgaatggcgtcgactgccctcaattgtgtcgcatgttcacatcaacattctcaacgtgggatttgcacataaatcttttttccaattcctatccatttaaaaattactctacattcgggatcccgaccaagtttcaaaatgtagtcgtcggtaattggtgctatttaaaaatgggattactgttggattggctgacaatgagtcgcaactttcccatcaaaacattcatttcagaattcacatttgctccacgaaatttccgagtcggccaatttgctgtattcgaatttgccactgttgacgaattggagcggtaacagcaacaacgggactccagccagcacaaacagcaaccactcactgaacaacgccgtcaaacacctgatgaagacgtggaggtggagatacactgaataataaataaataaatcgtaaaaattttttaaaaaatccgttttttaatggatttcagaaatcgccctctgaccaccgtcgaccaaaactcggnctggtcggacctgttcaactggcgtctgcagttcttcaaca

SEQ ID NO: 60343 - DNA, 947 bp, Heterodera glycines
  Genomic contig location: Contig_ID=SeqID_6103; Location=1801..2747; Strand=-
  SCN-specific regions: Sequence locations=1-69,99-525,547-861,883 -904,926-947
atgggtcgctacgattggttggcccatgttgtgcatttgctgttgttgtccgaacatgctgtcgacgacgacaaacaacagcagcagcagcaccaccgtttggtggagttgaagcaatgcgctacgctggacaacacattggcacagattgttgctgctgcagattccgacacaatcgaaagggtacaactccagcagcgacaacaagttggagaagtacatggacaagctgttgccgagcggttgggggacagcccgacgaagcagctggaccaagtccgcgatggtggtgcagcgacggagggcacaacaatccatgccaagattgcttcactgcgcctttccgcaccggcggacaacattgatggcacatctccaccccaggcacctccatcgttgtcagtgccaagcggtggcgaagaatcgctgctggaggcggcgacggccaacaggaattcaccgcagaacagcaacaggacgacaatgctcgacatgcaaatcaggttttagaatattaaatacgttttcgggaaaatttggaaattcatttccggaaaaaaatggaaaaccgaatccaaattttttacaatttaattactaaactttttcatttttagccttctttcactggccactcaacttaccgtggcccaacttatttcaaatttggtcgacattttacacaccgacctggcattttgtaggaaaacgtttgttgaggtctaatctacatactatcctcctacaattattttacaattaactcgtttttgtttaagcttttctgctctctgtggaccaccttttctccggaagagcgagcacagattgaaagtgttgccggtccgttcctttcgtccgctgtccatttgtgccagagggactccccccgtgccgtggtcacctgtttcatggaggcgtttgttctttgctctccacccattaaa

SEQ ID NO: 60344 - DNA, 1393 bp, Heterodera glycines
  Genomic contig location: Contig_ID=SeqID_6103; Location=2857..4249; Strand=-
  SCN-specific regions: Sequence locations=1-92,126-193,248-896,923 -991,1013-1022,1045-1393
  Gene Ontology: Cellular component=PCAF complex; Biological process =signal transduction
atggtgctcgacattttccggcccctccaacgcgcgatgatttcgtgcatcagctacaccaactcacaggtgacagtagcaaaaacgcacggaaatttttttataaaatttaaactttttattttctaaaaacagcgtatccctgccctgaacatgtccaaattttaaaaaacgaaaatttttagttttctacaaaaaatttttttaaaaattcaaaatttttagcatttttttcaaaatttttaaagaaattcctgttctttgattaaattcccattttttgcagcaaattctgcgcagcacttacaatgtgctgagtaaactgttggagaagaccaaatgttcggctaacgggttggacgagttggacatgctcaaccaccacatcgcccgggtcatccaggactcgttcgcgaagtatgccggctcattgaacaacgcctctccaccgatgaccaccatcactctgttgcggctgatgcactcggcacagcccagttatttggaggcggtgtgcctgatgccgtttattaacctgctgcagaggtacgtttttggggggggagcagttcttctccccccccccccccccaatttttttcaaacttagaaaaatttcaagataaaatctttaaaaaaaatttaaagaaatttcgtaaaaaaaattcgacaaatttttatttaatggtgtaattttttggttattttttccagactcgtccgggaacacatcatgtccaatgtgggcacaaccggtgcacttgatcaggcgcaaaagctgatcagtgatctgctgtccatctgtatagaaatgctgtgcactcgaacaaaattcttaaggtgagtttctctcccatatttcctatacattttttctaccatatttttcgatatatgatactactttttaaaacaaatattttgttttaattaaacccttttcgttgctttttccagcgccgaatctcaacataacgtcattcaacttgtgctcctcccgctgatcgagaagggaacggtggacaaaatagtggaaaacatcatcaaagtggcgcaagaaattgtgacaagcgaaatcgcacttgcacaacaacaccaagacgggcagccgtcgcagcagcaacagtaccaccaccagtcacaacaaagtcagggtgcactcgtgcttgtcaagctgtacggcgcgatggaacaacgactgtacgccaacaatgaactgcaacggcatttcctgaatgttgtggttcaactatacgagcaagaacgcctgttactgtccgaaggcgacgccacactgaataaacttgagcccgtgttccactggggactggccagcccgaacccggaactcagaaacaggtccggaaagaacgctgaccttataggattataa

SEQ ID NO: 60345 - DNA, 184 bp, Heterodera glycines
  Genomic contig location: Contig_ID=SeqID_29882; Location=1..184; Strand=-
  SCN-specific regions: Sequence locations=1-184
ccgggactcaaatgtcccgctcaggccaaaatttttttctatttccgggaaaaaatcgaaatttttccgaaaaaaataccagtcgatagagctcgaaaaactatgttttggaagtggtctccgtttttctgggaaaattcgttaaaaaatcataaaattaaaaaacccgaaaaccgtttttagg

SEQ ID NO: 60346 - DNA, 57 bp, Heterodera glycines
  Genomic contig location: Contig_ID=SeqID_29886; Location=1507..1563; Strand=-
  SCN-specific regions: Sequence locations=1-57
atgcgctatttggcgttatgagcaattttgtctgacactggcgcgtacccatagtgc

SEQ ID NO: 60347 - DNA, 588 bp, Heterodera glycines
  Genomic contig location: Contig_ID=SeqID_29891; Location=383..970; Strand=+
  SCN-specific regions: Sequence locations=1-160,182-529,551-557,579-588
atgggacttcaaaatcaggtaactgtacgtacataaagcagacccgtgcatcagcaggccttacaacgcgttcatagttttggcccgagccaaatgagttcgggccggtcagggctctttagaagcgggcttttgcctaaaatctcgaggctaaaatttcaaaaataaatcaaatcaatcagagccaactattactgtgacccttttctgtacacccattaccgtatagaaaccacgcgaatacgaatcaatcagcaaaaataaacgtggaccattctttttagacagtccaattgtccccactttcttttcgccgatgactctttttgtttggtcgtttgtttttggtaaattggttttaccttcttttaattctttattttgaattttcagctcattttattgtggtgccgcttttctaggccactcttacggcacagtttggacgaatttgccaaattgacgaacatttttgtgtgtaaagaagaaatataagacagaaaaatgatgaattatttattcctaattaaaattttaattattgtaatttcaaattgcatttttaatgttcatattttcgaattttga

SEQ ID NO: 60348 - DNA, 717 bp, Heterodera glycines
  Genomic contig location: Contig_ID=SeqID_6104; Location=3179..3895; Strand=+
  SCN-specific regions: Sequence locations=1-417,439-526,548-717
atgctaatcgcaccgcctcctgtaaaaatactctattgttattccgagatgaacgattctgtgatcgggttaatgaaacaaggaattgagacacataatggggtaccgacccaaacgttggttcaaagtatgcccaaacccttacttttaatcctggacgacctgatgttgagtgtaaataacgattttttggatttattgttcacccgaggctcccataactgggatgtaagtgtgatttttgtaacacaaagtctctacggacgcaatattcgtaccgcaagagccaacagccattatttggttttaacccggaatccttctggtcaacttcaggtcagaacggtgggctctcaattgtttccgaagaggctaaactattttatggaggcatacaacgatgcaaccagcgaaccattcagctatctggttataaatatgcatcctaatgcgtccgagtctgaacgtttaacaactaaaatcttcccggatgaacagcgtgaggtgtacctaccaattgaataaagaaagggtataaaaggttgagaaaatctgtaattttcactacaaatgtatgaattcagtccatatataagtgaaaacgcagaattttttaaaaaaatcgcctccacgaaatcggaaaaaaagaaaaacatccttctgcgagacgcaacagccgaacaaatattaggacttgttgaaatttgtgcaaacata

SEQ ID NO: 60349 - DNA, 271 bp, Heterodera glycines
  Genomic contig location: Contig_ID=SeqID_6104; Location=504..774; Strand=-
  SCN-specific regions: Sequence locations=1-240,266-271
atgagacagatggacaacatgatgaattcgatgttgggcgatgcgtgggacatgctgaacggcttcggaatgatgggccccccgttccccaaccatcctatgctcaccgatggtctgaatcgtcaaaaccaagctcttcgtcgtcagcagcctccacagcatcactttggtcctgatacgatgatgagtccgtttggaggatttggccttttcggcggaatgatgcagcaaatggtccaattttaaaaaatagttttattttagttattaa

SEQ ID NO: 60350 - DNA, 1699 bp, Heterodera glycines
  Genomic contig location: Contig_ID=SeqID_6104; Location=4966..6664; Strand=+
  SCN-specific regions: Sequence locations=1-203,225-264,286-826,849 -1088,1111-1399,1421-1699
ctataaaaaccccaggattacaccgaacggaaccaaaacgcaaatttaaacctgaattatgggcaagactatagcaccaaagcagccgactgtggataaattattggaacaaatttattacgatttacgctcaccggccagctatgctggtatgctaaaagtttgggaggaggccaagagaagagatcctcgaatttccttacacaatgtctatgaatttcttcatcgccaacgcacttacacattgtttaagccacggagaaacaaatttcctaggctcaaaacggtgccgagtggcctgcatacagattggcaatgtgacctgtgcattatggatacgttaagggcgcataatgacggttaccgctacattttggtttgtatcgatgtgcttagtagaaaaatttttaccgcagagtcggagtcgaagaaaagcgaacacatgattgaagcatttgaaaaggtgttcaaaaaagccggtgtgctgcctaacaaactatacagtgatgcaggtttggagttccaagcaaaacggatgattgaatactggaagcaaaaggacataatcaaacacataatgtacagtcctagcctgcatgcgggtgtggttgaacgggcgaatcgaacactcaaggagcgcttatacaaatattttagcgaaaataacactctaaggtggttaggggtgatagataaaatcgcaaataatgtgaacagtactacaaatcgtaccattggtacaaatccagcttctgtaacctttaagaatgctccgacgttaagaaaacgcctatataaagaacacactgatgacaaggaaatcaaaataaacacaaaattcaaatttggtgatattgtaagaattagcaaagagaaaggccaattttcaaaaggttactatcccaattttaccgacgaactttttagggtccaacgtgtaaacaacacaaacccgcactcgtacagaatacgtgatttgaacggagaagacataaagggaattttctacgatcaagaacttgtaaagacaacggaaaacggtacccatcgcgcagaagtgctaaaatcgcgtacactaaacggagtcaaagaacatttcgtccgttgggttggcttgtctgacaaatacaacagctgggtccgtgactcagacctagtgaaacgtcgagcatttgaataaagctaaataatggaagatttttacattgtacttccctcgaacacacctggtccaggaaatactgcttcaaattttacggttagacttccgcacactttagagcttgactccaaatggtccgtcgcattatcggcattaatctatccatattcattcccatcgatcagtgtggacgaggatgactctatctctgtcaaactggttaatcctaactacagagaagatgccggaaattctgacgaggaatcgcaaaagtttatcaatttatcagtgaagattccaaatgtacaattccaaagttacaaagtttacaaaaaacactgaatcagataatccagaatgcttacgctacaaagtttggcggctcatcatcattaaatgatcccccctgggacccgtccctggcctccaccacaggtaaaggggggggggggggcggaggacccggccttcatctcgagaaacttatcgcttagtctcttttcttgaccatcgcttttgattctcggaaacagataa

SEQ ID NO: 60351 - DNA, 279 bp, Heterodera glycines
  Genomic contig location: Contig_ID=SeqID_6104; Location=6746..7024; Strand=-
  SCN-specific regions: Sequence locations=1-279
atgccaaatttggaaattgcggtgagcccggaaggcacttcgaaagtgcctactttggacttaaatgcgagccaattcatgcgaaaaagattggcaaagtcaggcgaacagcagaagacgcacaaaacggaactgaaagtgactctcgaggcagaactaaatgtgccgactttggatttgaatgccgcccaactgtcaatgaaacgattaacggagaaaaataagggaaaatttacgacggcggaagaagcgaaaaatgaaaaaaaggaaaagcaatga

SEQ ID NO: 60352 - DNA, 1227 bp, Heterodera glycines
  Genomic contig location: Contig_ID=SeqID_29892; Location=53..1279; Strand=+
  SCN-specific regions: Sequence locations=1-1227
  Gene Ontology: Mol. function=ribosome receptor activity; Cellular component=integral to endoplasmic reticulum membrane; Biological process=signal transduction
gtgagaaagaaggtggtgcgcaaggtggtgcgcaaaagcagcaacaaatcggacagtccggaaaagaacggaagtccggcaccggaagagccgccccaatcgccgacagtgaaggcgacgacgacgacaaatggcacagtgccaacggctggtgccaaaacaacggttggcaacaacactcagtctggcactggcgctaaaagtgtgtcggcaattattgccggaaggatggcgtcattgtttaataattgtgccgggaatggagtagaaggagcagctaatggcgagaacggcactggcacgaacagaaacgatgccgcgccggcaacgacgggggatgggggtggagcagcaatacatgagatcagtgtggcacggtttggcggcgacgaaccgacggcacaatccgatgaagaagcggctggcaataattccacgagaaaagaagcggctagcgatgccaaaaagggggaatcaactggcataaatgccaagagagaagaagcggctggcaataatgccaagagagaagaagcggctggcaataatgccaagagggaagaagcggcaaagaataatgccaagagggaagaagcggctggcaataatgccaagaaggaagaagcggctaagaataatgccaagagggaagaagcggctaagaataatgccatgagggaagaatcgtttgacactgcttgcaaacaaagcaatggtcctgacgtgacagagtccggaactaatcgctcggcttctgaaacggtgccgaaatccggcacggctgttgagataaagccggcaaaagccggtcagttggagtcggaaccaaaaactgatcacactgttgatgattcgccgccaattgttggcagccggcgagttggagcagtgtccaaaacatctaccgaagcacccaatgaatcagcagtgcctgaacattcgtcggcgatcaaagaacggcgcagccaatcactggacgggcatgaattggcgaatggcacgaccaacggagtcggcactttgcgcatgacggagtcgtcgtcagaagacaatggacgggtaagaaaatgaaatttttagaaaattaagttttaaactaaggcttgaccaactgtctaaatttaattgggtttgaccaagacccaagggcgtagccagacccttggctttgggggggctgaagtcaaaaattcgattttaggggtgtatttttttttttttcagtag

SEQ ID NO: 60353 - DNA, 182 bp, Heterodera glycines
  Genomic contig location: Contig_ID=SeqID_29893; Location=1..182; Strand=-
  SCN-specific regions: Sequence locations=1-38,60-104,126-182
gagaagtccaatcactcggcccaattaaattagccatccctttaattgtccttaattaagagaatttcatatctctgaattaacctcggcaatgcattctctcgcctttatttccttcgctttttgcctttcactaacggacgcttttcgtactcaatcgtccggcgtccgggggacacttc

SEQ ID NO: 60354 - DNA, 447 bp, Heterodera glycines
  Genomic contig location: Contig_ID=SeqID_29894; Location=684..1130; Strand=+
  SCN-specific regions: Sequence locations=1-73,95-128,151-234,256 -375,397-447
atgtcccttcaccttccacagaaatgtgaacagttggcgcagtgcacgcagtgtgaacagtacaagaaggagcgggacaagaagacagaagcactcctcgacaaaatcaaggagtccttcgacacgaagaagcagaagaaacaaatggagaacgaactgaacgaacagcgccaaaagtgtgcggacctcggcaaacagaaggacctgctgacatgcgaagtgtgttcactgcgcgaagagttggagcgggagaagaaggccaacgcacacttcgacgacgacctcaaagagttcaaacggcgtcgcttggccatggacgacgagctgaagcagttcaaacgtcgagagaaggacattggagccgagttggagcagtgcaaggaacagaaccagcaacttgtcgcggcagcagaggaacgcgaaagccgaattatggagctggaaagg

SEQ ID NO: 60355 - DNA, 1693 bp, Heterodera glycines
  Genomic contig location: Contig_ID=SeqID_29895; Location=139..1831; Strand=+
  SCN-specific regions: Sequence locations=1-487,509-511,533-591,620 -788,816-1526,1549-1693
  Gene Ontology: Mol. function=5'-3' exoribonuclease activity; Cellular component=nucleus; Biological process=cell growth
atgcccacgaaaccgttcaagccattggagcagttaatgggtgtgtttcctgctgctagcaggtgtgttgatatgttttgttttgttccccgactggcacttttataattattcatttgcagagctcatattcctgacgggtggcgttggctgatgaccgactcaagttcgccgataattgatttttacccggaaacttttgaaattgatctgaacgggaagaaatatgcttggcaaggcgtcgctctgcttccatttgtcgaggaaaaacgtcttttggatgcacttgactcggttttacaattttttttcaaaaaacaaaaaatattttaggtgtacgccactctcacaaccgatgaaattgcgcggaatgccaccggaccagaccgtctttttgtcggcaataaacacaacttgttttcgctcgtttatgaggtgcactcccaaaagacgacaattccgataaaagatgaactaacaaatgatgacacaaaagaaacaagcgaagggacgcgagaaactgaaggagaagccgaggaaactcaacaggcggaaaatggtaaattaaattttgactaccaatcatttgccatataaaattgttttttaattaaaaataggtgaaagcgaacaaatagcgaaagccgaagaaacgacggcacaagaggaacaagcgaacgaagaagctatctcaaaacctgaacaggcaccgaaacagggtaagccatttaaggcatttcctctttaaatatcgagatttagaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcatcggtcgctgttcagaaattcgttggagtttggcgacatcaaagtgagttgtttttacaaatagcctatgtttcaataaattgcatctcttcaggagaatacctgcattatggttcggtttttatcatttacaatgttcgatttatattttttgtgcacaggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcaggttcatcgtcaaattgttgtctcgtgagacaatgagcacttgacatttacagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccacggaatactcagcatcaccatcgcagaaacgacaacaacagaacttacaataggaaataa

SEQ ID NO: 60356 - DNA, 962 bp, Heterodera glycines
  Genomic contig location: Contig_ID=SeqID_29896; Location=111..1072; Strand=+
  SCN-specific regions: Sequence locations=1-962
  Gene Ontology: Mol. function=MAP kinase kinase kinase activity; Cellular component=cytoplasm; Biological process=cytoskeleton organization and biogenesis
ccaatgatcgaatcccattgttgtttaatgccaaaaaaatcgaacaaggaggctattatcgacagtatttaacttaattgcccgttctttttttacttttttaaaatttcagtcccgaaattattagtcaaaggcctgagggaatcactaccaaaagtgacgtgtggtccttcgccgtcgttctatgggaaattttctcgcgtgaaataccttacaacggtagagaacgaatatccatcccttctgttgttaatgggtttccgtgttttaggccttacggaatttaaaatttattcgataatttcccaacacggagttcgtctggttattcccgagacatgtccttctcaactcaataatattatccaaaactgttggcgcacggaacctgccgatagaccggacatgcgatacggttcgccacggtcttaggctatgtaaaagcgcatttttcagtgcttgccgttctgcaacagataggcaatgatgccgaattgcaacgcgaagttgcgcagtttttggtctttcgcaaggacgaatggcgggaaatgattcgcgagcagaccttcgcattggaagtaggcatctgagattgcttcgacatgaaatagggcataatttatccaggaactgaagttggatttggcccgacagatggaggatttacgaaggcgggaggccattgtccgaaagcgggagaacagccatcgtaattttctccatttggtaaacatcgctcttctaattaggtttattgcattcgtgagacttttaggtggacgtcatgaacgtggaggacgtttgcgaatggaacgaggattgtgtttgcgaatgggtgagcaaatgatcagcaaatttcagcccattttgagcttttgttttaaggtgcaaaacattgcggcaagtgccatggaagacttcagcgaggcgattgtcgatcagctcatttcgtgtattcttca

SEQ ID NO: 60357 - DNA, 705 bp, Heterodera glycines
  Genomic contig location: Contig_ID=SeqID_29897; Location=171..875; Strand=-
  SCN-specific regions: Sequence locations=1-86,108-705
aatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 60358 - DNA, 953 bp, Heterodera glycines
  Genomic contig location: Contig_ID=SeqID_29898; Location=312..1264; Strand=+
  SCN-specific regions: Sequence locations=1-3,26-221,246-457,479 -615,638-953
atgttatttattttttcaatttttctcatttatatacatttaaacgcttcgaacggatgtggcactgaactcggaatatgggaaaatgttagtaaaagtggtgccgaatttttaaaaaacattaacattgaagcaaaagtattggcacgccaattgtgccaacttgacgaagtcatcttgaaaattgcagaaaccccagcggaaaaggcatttttaattcgtttaaaaaattttaattaaaatttcaatttcagaaaatggtacaaaatcagttgcaaaatgatccggcacttttatacagtttggaaaaattatttttcatttatcaaatgctgaagagcttaaaaattggtacgtttcgggcttaatggaatttaatcgaaaaccgcacctaatattatgttcattataattaattacttgctgattctttctaagattggcaacaaattattgcaatatttttgaataatttaattcaacttttttttcaaaattttcgggactaatttttttttttgactttttgttgccaattaatttttttcaattttcgatggaaaggtggaggtaaaagagttttggggtcaaaatcttaggatcaagcatatattattaataaaatctacttaaaaaactatttttagatgccaatcgtcataaaaactatttgaccgcctcattagaacattctatgaccttaatggccaaccgttttggcattccgttcaacgaaatttcgaatgttgttgagccaagaaaaagtgcatttatgcttaaagaaatcacaaatttgttaaatgatcaatttgaaaatgagaggactggaaatgagcatgaaaaagaagaaaatgggcaggacggatatcggaaaaaccaaaaatggacatttcgccaactcagcaacaattcgaacaatttgtttgggaaatggtttaattcatttcataaag

SEQ ID NO: 60359 - DNA, 226 bp, Heterodera glycines
  Genomic contig location: Contig_ID=SeqID_29899; Location=1249..1474; Strand=-
  SCN-specific regions: Sequence locations=1-226
atgaccaccgcaattggcgacactatcattttgctgatcactttgatcgctttcccaaacgccgcggtcgaattccttttctatgccgtcgtaatggtggtggtcagtgccattttggcacttttggccatattttactacgagtacaacaattacacaacgacggacagcgaaatgataacgaaattggaagaaacagaagggaaaagagagccattgaaaggag

SEQ ID NO: 60360 - DNA, 2001 bp, Heterodera glycines
  Genomic contig location: Contig_ID=SeqID_6105; Location=2643..4643; Strand=-
  SCN-specific regions: Sequence locations=1-315,337-1951,1973-2001
  Gene Ontology: Mol. function=transcription co-activator activity
atggcggcggctgtcgcagcgcagtcgttcgatgtgaaggctgatctgcggaagcacactctgttcgtcgagccggtcgtcatcaatgagatctcaacccgaagcgttgtcatccaattcgtcatgccggtgccgagcattgaggagctcaccgaattgtgcaaaatctgggagatcgatttggcggtgggttgcaaagtcaatccggcagccaaggcaaagccttgtgcgcatgggtatgtgctgagcatcgataaaagggcgttgtgtgtaggatacgaaattgatgccaaagtcatcctttcctaccaggcagcgaaggaccaggatgcgcaggacgaatttgatcagatgcgttgtggagaactcgacggatgcgttgaactcatccctcagacgtccgtcagagccctacaggagcgaatgttcacactgcggtccaatgactgctcgaaagtggcgacggacgaaggaaaagaaaaggtgggccgaattatgtcaattttattgggccgaccggtaaaaccggaaagcccaaaggccaataacccattaatgacttttggggctctttcaaaattgaaagagggacagatcgacaccgcgctgtgtatgctcgacgaggtgccgcgcctggtcttccaacaggccgggcccggcaccggcaagacgttcagcgcggcatcgatcgtggccactgtcctggccacggatcccacggcacgtgtgttggcgctggccccgccgaatgtcgccgtcgtcaagctggtgctggagatgcaggacgcactggccgccggaaaccacgtggagccgatgcttgccttgttctccggcacaggtaagttgagatatgccaaggaagttgagcggatttccccccacctgctcgccaccgcggtggaggcacaggactttcaggaactcctacagaaggaccaagaccgcgtcaaggtggagcggtacctggacgcctgcgagcggaacccacgcctggcccaggaaatggcagttgccaaaattgtgcaggagcacaaaaatcgccgcctgtgcttcgccactttgtccttctgtgagcaattgccggcactgtttggggaaacgacgcatttgatcatcgatgaagctggacaggcgccatacgtccagatcctcaacttggtaagccaactcccctgcctaaccaaggtgctgatcaccggtgatcgccgccaacttcgtgtccatttgccctccctgccgatcgcaatccgcgaggacttcggcatggacacggtcatccagaacctggatgttgcacaagggacggacgtcacaactttgtcggtctgttttcgctcacattcagctctcgtccgttgcacggaggccggcttttacaaaccgcacggcgagctgttgacaccaggacgcgacgactccgagcgggcactgatgaccaaccaaacggcattcaaattgccgaaaaagggagtccccctcgttttagtccatcagagcacgcctgcgcaacgcgacgaagtgtccacttcttcggccaatcctggacaaacagacacggcgatgagagcactgtggcgtttggcgcgggccttccccggcacactcatccgctgcatctgtttctacgccgcgcaagcattggaaatcgaacggttggtggcccagcaagaaattcccgacattttagtgaccacggcggacgcgacacagggccacgagtcgtcacttgccgtcgtcgtcacaacatgctccgtcctcgacagtggagccgactctcagcctttctgggctgatgccgcgcgggtggacgtcgccatctctcgcgccagccatggaatgatcatcattggcgatttgctgctgctcaaccggacggagacatggcggcgctctacctggaccaagcgacaacggaaacgacagtggtcggcccggagtacttcgacttcgagcagttcaacaaccccgacaactattacgacagagacggtcagctga

SEQ ID NO: 60361 - DNA, 359 bp, Heterodera glycines
  Genomic contig location: Contig_ID=SeqID_29902; Location=547..905; Strand=+
  SCN-specific regions: Sequence locations=1-125,147-215,247-311,335-359
atgccaattctgttcagaactcgcttttggcttgtggtcgttgccggcggtgccgcctccgcctttggcattgttgccaatgcgatgctcacgcgtctgttcctcactcggcctgcgttccgccactcgcccttctttttcctcggcttcgtcgctttgtttgacactcttttggattccgtttacattttccttttggtcagttagcaaatgccatttttaatatttgaaaattaatttaaatatggaaaaagaaattattatcacgtttttatggcacaaagaattaaagctaatgctaatgaatgcttaaaattattaaagttttgttttcgttgttttaaataatatttgtgaga

SEQ ID NO: 60362 - DNA, 444 bp, Heterodera glycines
  Genomic contig location: Contig_ID=SeqID_29904; Location=153..596; Strand=+
  SCN-specific regions: Sequence locations=1-366,388-388,410-444
gttgttgaggaccgaattcgcattaatgaggcgaatggtggcatccgaaaggacggactaatgcacagcgaaggatcactgtacaaaggcaaaattatggcatttttggactttttgctgacactgcgcgaggagcaaaagttgagcacggagcaagtgagggagcaggtggacgcgttcatgttcggaggtgagaagaattagcagcaaaaatgccgtaaaagattgggtcggaaatgccaaaacttaataatgcatcatagtgaggacttggaaatttcccgaaaaagaatattgggcaaatcgccaaaaaatgtgatcatgtcaacaaaaaatcttttttattgaatttttttgttgttaaagaatttattttacatgaaaattcaaaaaatgccaaaataaatataattcagatcacaaattatattaaatgcaaggtca

SEQ ID NO: 60363 - DNA, 295 bp, Heterodera glycines
  Genomic contig location: Contig_ID=SeqID_29904; Location=728..1022; Strand=-
  SCN-specific regions: Sequence locations=1-182,285-295
atggcaatttgttcacatcagaggcggtcaattccagctcagtttccccctgagttgctactccaaaatggtcagcaatttcggcacgcaatttgtcttggaaatcgggatggcatgccattgaccacagaaacctggcattatagatggaaatattttgtgggcaggcatgtaaatgacgcaaataaatatttttttttaaatgaattcgaattttaaattttaatcgaagaaatttctttttttttaattcattaaaaattgttatatattttagattaattgctatgtataa

SEQ ID NO: 60364 - DNA, 571 bp, Heterodera glycines
  Genomic contig location: Contig_ID=SeqID_29905; Location=554..1124; Strand=+
  SCN-specific regions: Sequence locations=1-105,127-269,292-348,370-571
atgaatgaatttgggttagtttgcgaattttaattggcaaagtgaatacttagcgaaataaaattgctttacattcaaattaaatgattagacccgcccctctcctccagcagattcttcagactcgagtttttcttggttaaatttttacttcagcagtataaaagaaaattgccgaaaaaatcattttaaatacaaaaaataaatatcagttttcaatcttcaaaaatgtttaaaagagctaaccatgagaaagaattgaaactgagaaagaaggaacagaagcaaagagattaaccactaagccaacaattaacttttcaataatttttcattcctccaactttgctcaaaaatttgatccagaaccccatgcttaccagtgtacttttggacccggacctaccgggtcgggtaccgggtttgcaacagggttgcgcaaatcacccgaaaccctacattttctcgacccgaaacgcgacccgatatttttctcgacccgcggcaaccctggtatgcaatagagagactctaaaatttatattgtctatgagtgaaattattgggccaa

SEQ ID NO: 60365 - DNA, 258 bp, Heterodera glycines
  Genomic contig location: Contig_ID=SeqID_29907; Location=133..390; Strand=+
  SCN-specific regions: Sequence locations=1-258
atggaagccctaataatcgaagtctgtgcgagtaaatttataaaaattcaaatttgcgaccaccaaaaaagaaaaattaattgcaaaaagaattataaaataaatgagttttattattttgtgaatttgaaattagaagatgagagccaaccgaatattataacatcaatttggaggcatcagagacaggcatttaaactcagttaaactcagacaaaaataattaaagtaactaaaaatcaaagagtaattattaaa

SEQ ID NO: 60366 - DNA, 1251 bp, Heterodera glycines
  Genomic contig location: Contig_ID=SeqID_29908; Location=117..1367; Strand=+
  SCN-specific regions: Sequence locations=1-63,94-102,126-452,474 -903,925-928,950-1251
atgaccgaatccaccggttctttgtgctcctccaatttcgcctcggctgcccaacaaaatgttgtcccaccagcaacagcagcatcagcagtcgatgttcatcaacaacaacaacaacaacaacagccgatgctgcagaccaattctttccacgaccggcgccgtctgaacactttggccgagaaacggtcctttctcgtccgaatggtaagtgccgccgggatggcacggaattccgatttccgaaaattttttgcttctcggaatgccatcccttgtaagtgcgccgggagcggccctttgatgtttgcccgagttatcacagctaattagcattcatttgctaatcactcctttctctttcattaatcactaattatttttattttctcttttttcttttcattcctccgctattttcttatcattaattgacttttcccatgatgtttctcatctgttcacaggtcagtgacccgaagtgttacaatccgaaaattgtgcaccatttgaacatgcgcacgcacaaccaaacatcacaagacttattcagggacagaacattgaggtgtgcagcaggggaggaggacaaagtgacaaatgacaaatgggacaaatgacaaatgggaccaaaatgacaaattggaacaaatgaataagaaaactcaaaaatgggcatcggttgtgatttcgttagatttttggcaattttgtcttgctcctttcccccccccccccccccaaataggcatgcaattgaacaaagcagccgtgccatcggtggactgtgtgtcgcaactgctgccgcccaatcggcgccgtcgtcgtcctctaccgccccgctcaacagtgccaaccatcacttccatttgccaagtgccagggcggcacagtttcgaagcggaaaatgtttgtgcccattcaaaaggaatgccaatgatgtttcctcagatttgtacatgagcatcgatcagcaggggtcggacgacgattaaacggcgaacaaacaattaacggatgaattttggttttcgtctcggcgtattcaaaggaaaaaggtccgcaaaaactattacaaccgtattagaccaggaattgtgtttctggataattaccgttaattacccaccgcaagtatcattttattagccatgtatccattcatcattattatcattttgttccatcggtgcgtcgttcgttttgtttgttttttgaataatttctcccttttttggcatagtgtaacaa

SEQ ID NO: 60367 - DNA, 1472 bp, Heterodera glycines
  Genomic contig location: Contig_ID=SeqID_29910; Location=4..1475; Strand=+
  SCN-specific regions: Sequence locations=1-77,105-277,299-913,938 -1148,1170-1362,1384-1472
  Gene Ontology: Mol. function=myosin light chain kinase activity; Cellular component=microtubule associated complex; Biological process=protein biosynthesis
aagagaaggctaaaaaggatgccgaggataaagctaagaaagacgcagaagagaaggctaaaaaggatgccgaggctaaagccaagaaagaagcagaagagaaggctaaaaaggatgccgaagctaaagccaagaaagacgcagaagagaaggctaaaaaggatgccgaggataaaaaagccaagaaagacgcagaagagaaggctaaaaaggatgccgaggctaaagccaagaaagacgcagaagagaaggctaaaaaggatgccgaggctaaagccaataaagacgcagaagagaaggctaaaaaggatgccgaggataaagctaagaaagacgcagaagagaaggctaaaaaggatgccgaggctaaagccaagaaagacacagaagagaaggctcagaaggatgccgaggctaaagccaagaaagacgcagaagagaaggctaatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggaggaagaaatgaagaagcaaaaggctaagcccgaagaaaagcctgaggcacctgccgaaggcgtggccgtagtgccggaagcgaagaaggcggaagagacaaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaataaagacgcagaagcaaagaaaaaggaggaagaaatgaagcaaaaggctaagcccgaagaaaagcctgaggcacctgccgaaggcgtggccgtagtgccggaagcgaagaaggcggaagagacaaaggaaaagctgaaacaggaagagaaaccaatggaagtgccacaatctccagcagaaaagaagagaaaagaggctgaggagaagaaggatcagaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagagaaggctaaaaaggatgccgagactaaagcgaagaaagacgcagaagagaaggctaaaaaggatgccgaggctgaagccaagcaagacgcagaagcaaagaaaaatgagcaagaaatgaagaagcaaaaggctaagcccgaagaaaagcctgaggcacctgccgagggcgtagccgtagtgccggaagcgaagaagcggaagagacaaaggaaaagctga

SEQ ID NO: 60368 - DNA, 59 bp, Heterodera glycines; identical to SEQ ID NO: 52421
  Genomic contig location: Contig_ID=SeqID_29911; Location=161..219; Strand=-
  SCN-specific regions: Sequence locations=1-59

SEQ ID NO: 60369 - DNA, 59 bp, Heterodera glycines; identical to SEQ ID NO: 52421
  Genomic contig location: Contig_ID=SeqID_29911; Location=291..349; Strand=-
  SCN-specific regions: Sequence locations=1-59

SEQ ID NO: 60370 - DNA, 59 bp, Heterodera glycines; identical to SEQ ID NO: 52422
  Genomic contig location: Contig_ID=SeqID_29911; Location=421..479; Strand=-
  SCN-specific regions: Sequence locations=1-59

SEQ ID NO: 60371 - DNA, 59 bp, Heterodera glycines; identical to SEQ ID NO: 52422
  Genomic contig location: Contig_ID=SeqID_29911; Location=551..609; Strand=-
  SCN-specific regions: Sequence locations=1-59

SEQ ID NO: 60372 - DNA, 59 bp, Heterodera glycines; identical to SEQ ID NO: 52421
  Genomic contig location: Contig_ID=SeqID_29911; Location=681..739; Strand=-
  SCN-specific regions: Sequence locations=1-59

SEQ ID NO: 60373 - DNA, 59 bp, Heterodera glycines; identical to SEQ ID NO: 52421
  Genomic contig location: Contig_ID=SeqID_29911; Location=811..869; Strand=-
  SCN-specific regions: Sequence locations=1-59

SEQ ID NO: 60374 - DNA, 1335 bp, Heterodera glycines
  Genomic contig location: Contig_ID=SeqID_6107; Location=812..2146; Strand=-
  SCN-specific regions: Sequence locations=1-326,348-397,419-1014,1037 -1335
atggacatttggtcagcagcaattacaatttatgagattgtgctcatcaatttcctgaacggttcttggtcatcaaattcgatgccaattaatatggcggactttagggtaaggcattaacaattcaaaactcacactaatggcataattaaaagctggtcgctttaaacttggtcaagtcctgggatgtgtagtatttgactgtgactccaaatttctgagttcattttggtttctaatttcgaaaaccgagaaaaattaactattttagcttactaatttcaaaattacttgtaaggaaaagcaaaaaatcctcccttcccaacttaaaaatataatttttattactctatttttttcgtcaaatttttaatttaaacttaccatattttcgagaaaatggatatttaaaatatttcgccgaaaatttgttaattaatttttacctattttaacatttttgggtttttttgtgcattttggcgcccattttgctagttttcgttgttttgcatctttatttatcagttccctcatcagctcactccgaaactcaaattagttcaaaaacgagcggaatcgatgccaaaagcataaaatatgaattagggtgcgcttgccattttcatgagataattagggtgcaccacaaaatttcgacgggacataattcgccgacgaatttaaaaaaaaattagaaatttagaaattttcagaaaaaaatcttagaaaatttttcaaatgacaaatatcaatggaaaaaacttttgaaaaattttttagcgattttttgtccaggcaaaatttcggccagcaaaattttgtccagttcccgaaaattagcatttttctcatcgttttgggccgtttcaaatcgattccaaccgttttttgatcttggataaatttatcttgatttgaatttacaaaattttcagccaaatatcgaaaacaaagtgaaacgaattggcgaattgtgtcggtttgcccgactatatgatggcacacttaatgaacaacaacaacaaatgatgatcattaaactgggtcttctagaaggggcttttaagccaggctctgaagattggtggctacggtattcgggagtggtcatcaacattctcgacatgtggggcaacaaatacggaatgccagacattgcctaccttttggtggtaagagcgcgggaaaattggaattaaattacacaatttgtttggatattgaaagcattattggcacaaccactcaataatgaatgatgccatactcccaatttgtcacagacaatttgtacaaatgctaatagattctaatatagcaaaagcaaataaa

SEQ ID NO: 60375 - DNA, 718 bp, Heterodera glycines
  Genomic contig location: Contig_ID=SeqID_6107; Location=2979..3696; Strand=+
  SCN-specific regions: Sequence locations=1-196,265-530,552-718
atgccaaagttaggcattataaaagtcatcctaggcaccccaaaccaagcggaaaatgcgtttttcgtgcttatttgtgcgtattaaatggctcccggtaaattggacactggaaaattggacaccagaaaattggacactaaaatactggacaccaatggaaaattagacaccggaaaattggacactattgtacataaaataaataagttaaaaataaataaacaaaaattttaattgaaatatataatgttattattatttgtagcatcagcagcagaacgccatcatacattcataacgaaaaaagttttcattttgatcgggttcccattttttgcgtatttttggcacattgaacaaccatcgccaattttctacattttttggcatcttaatcaatcatcgcctaatttcgtacacttttttccacatttgatcaatcatcgtgcctatttaatgtttgattcactctaaatgccttaatccatttatccacaccaattatttttcaagctaattcctgtgtttattttttaaaagaggaatttggtgtccagttttccagtgtccaattttcctttggtgtccaattttctggtgtccaatttaccggtccccgtattaaattgcgcaaaaattttaggcatttgcctaaaaatcgcatccctactaacagagcccggatttttatgtcctaaaaatcttgaaatatgta

SEQ ID NO: 60376 - DNA, 917 bp, Heterodera glycines
  Genomic contig location: Contig_ID=SeqID_6108; Location=102..1018; Strand=-
  SCN-specific regions: Sequence locations=1-160,182-315,336-519,542 -549,572-724,770-881
atggcatttttggggtcgctgatcacgaatgtgacattcatttcgaacaattccgaaaagtgttatgatcagggagccaactctgctgattatcatcatcattttgctgatctcaaggggtcaaagatgattttttttatgattatgatcattaaagcgcaaataaaaaatgtttgcttataactttactaaaaagcaatcatattttaaaattgatatcatcgatagccctaaatgttctccattaatcctgccaaattccgaaaaaatttcgttaattttgcaaaaagttatgaacaaaaatgtactaaaaacttgttgttgttgttgttgtttttttttgagttcctctggccataacttttttccaaagttaacgaatttttttttgaaatttagcaggctaatagagtacacttaagctatcgaatattatcaagaattaaatgttcggttactcttgagcgatgtcatgaattaaatttttgtcaaaaaaatttccatttgatcgtttttgagtccagcaccgttttttcttcttctaatttattgtttttaaataataatttgcggggaattgcccaggttagcagggatgacattccgaggctccaaaaatttttcggaaatcggaattccgagggtcaaatttttcggaaatcggaattccgtgtcatccctggtccatatagagccaatgcttttttttctcttaaagcatttgtaataataataacaattaaatattaaaaattgaaataaatttttagatttttgtcggttattatgcgggcgaagttatgccgtcaaacagccaaagcctgccgcccaaaagcaaatgtgttaccatcaaaattcattatcaccaaaagctcccctacattattaattatataaatattataaacataaataaa

SEQ ID NO: 60377 - DNA, 168 bp, Heterodera glycines
  Genomic contig location: Contig_ID=SeqID_29912; Location=254..421; Strand=+
  SCN-specific regions: Sequence locations=1-168
cgccaaaagcactccttcaaagagtttgccatcgtattactcgcacaattcgccgacaaagacaacctttggcgtcaaagagaatgtgccaatctcttccccgttgccttgcggcacacaaattccaccaaagactccgccgttgggttacatggatcacagaataaa

SEQ ID NO: 60378 - DNA, 84 bp, Heterodera glycines
  Genomic contig location: Contig_ID=SeqID_29914; Location=37..120; Strand=-
  SCN-specific regions: Sequence locations=1-84
atgcgcacccgtccgatctggcaagttaagcaacgattgctgactagccaaaaggttcggtgccgtgatgaaacgaaccaacag

SEQ ID NO: 60379 - DNA, 777 bp, Heterodera glycines
  Genomic contig location: Contig_ID=SeqID_29916; Location=89..865; Strand=-
  SCN-specific regions: Sequence locations=1-50,72-74,119-348,371 -398,448-482,525-668,730-777
atgaagaaaggatggataaaaacgatgtaaaaatcatttttgagggcacatttttgggttttttaattgaataattgggaaaaaccaaagccaaatgatagtttattttcatttttctaaaaaaattattattgctctttgaatattttaagtgatttccaaatttcgcagttccattttgagaatttaagggaatcttttggcaattccgacgctttgttcgtaattttgtcggcaaaatggaacaaatacaaatacgaattgcgcaacattgaggacgaattggagcgattgtctggggggaaattgcgcgttgaatatgttccgctgttggaaggatatgagaagtaaaataaatttaaaaaataaacgaatatttttgaggttttaaaatctgcaaaaaatataaaaatcaacattaattaaatatatttattcaatttaaatgctaaattagagaaaaacaaattctagcgctattgattttttataaacaaattttttgtttaacaataatttttttagcttttcattggccgatgataattcgcttttgctaaatggcaaaatcgttggcgttgtgtattcagggctttccgcacttggctatcaagcaaatgaaaaggaaatgcacacgcggaaaatagttgaattgtcgacagcaattgtaaaataaaaaaatataaaattaatcaatcaaaaaatagtcaaaaaaaaattatttaaaaagcggcaagagagagattaatgagatttttgtaatatgatttaaataaa

SEQ ID NO: 60380 - DNA, 351 bp, Heterodera glycines; identical to SEQ ID NO: 53910
  Genomic contig location: Contig_ID=SeqID_29918; Location=552..902; Strand=+
  SCN-specific regions: Sequence locations=1-20,51-351

SEQ ID NO: 60381 - DNA, 279 bp, Heterodera glycines
  Genomic contig location: Contig_ID=SeqID_29919; Location=1315..1593; Strand=-
  SCN-specific regions: Sequence locations=1-279
atgataatttggcgttccgctggctgctattccgattttgcttgggctgctaaagtagagcccggagcaggaccggatcctgcgcaggattttgcaggatcccagtacgcaatcctgattgcaggatttgcaggattaatccggccggatccggtcctgcaaaaatttttgaattccaatcctgcaacaggatccgtaaatttgaaatttccgggctctatgctaaagttcggaacgcaaatgtccgatttacagcaggcagcaattcggggtcgttga

SEQ ID NO: 60382 - DNA, 304 bp, Heterodera glycines
  Genomic contig location: Contig_ID=SeqID_29921; Location=20..323; Strand=+
  SCN-specific regions: Sequence locations=1-77,111-202,236-304
atggctatctcttttttgagaattttctatgcaacaaacgctctcgaacatgaaacgaagtgcggtgcgccatggccattttatttttcaaataatttttatatttaatagatattccagaaaaatggctatctctttttttgagaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatga

SEQ ID NO: 60383 - DNA, 235 bp, Heterodera glycines
  Genomic contig location: Contig_ID=SeqID_29921; Location=646..880; Strand=+
  SCN-specific regions: Sequence locations=1-79,113-204
atggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaagctctcgaacatgaaacgaagtgcggtgcgccatggccattttatttttcaaataatttttatatttaa

SEQ ID NO: 60384 - DNA, 900 bp, Heterodera glycines
  Genomic contig location: Contig_ID=SeqID_746; Location=165..1064; Strand=+
  SCN-specific regions: Sequence locations=1-69,91-430,454-536,558 -731,753-900
atgcgtgtaacaattattgctggtgaaaatgttgcttcattggagatttcggcagacatggaactggaaaacttcttggccttgtgcaagttcgaactcccctccattgccgacacaccaatcgaaagaatcgcgctcaactgcagcggtcggcaattcatcgccaatgctggactagcaaagaaacagcttaaggttggctgtctgtttattgttgaacaatgggtgattacaaatgcttttaaaaccaaaatcttgtctctcatctcacaactggccaattttaatgcattttttataatttactattgtccatagactcaaatttacagctttaaggatttcccccaattatcgtttttcaggagttgaacattcaacatgaagacgcgattcatttcgaaacgatcaggttctttgattgtcaaccctgtttccttttgacattttaatacggcactccaccgaaacttctttggtatttgaaaatgtcaaataaaaagaggggggggggtatcatcagaaaatgttaatggaccatcacccaaattgctttccgttgctgacctcactctgttgttcatttgatgcatttgctcttttcgttcagtgcttcttccaccgcccaaaccccccactcgtccctttccacgccgtcctcagccgcttcgtcctccctcggcgctccgctgcaaacttccaatttgatctcttccctcgtccaaaacatcaaagtgccccagaagcaaaagagcgtggcggaagaccgcgccatgtccgaccaaatcttcaccatgctccaacacccggcacggctcgacttcctccgggtggaccaccccgagttggccgctgcttatgagaaaaaccaacggacagaggttcttgtccatcgcatca

SEQ ID NO: 60385 - DNA, 1181 bp, Heterodera glycines
  Genomic contig location: Contig_ID=SeqID_747; Location=367..1547; Strand=-
  SCN-specific regions: Sequence locations=1-20,42-478,500-1181
  Gene Ontology: Mol. function=lectin; Cellular component=extracellular space; Biological process=cell adhesion
atgtccgaaatttcgcccggtcaaacactgaacattcatggcaatgtgaacgcggatgcgcaccgtttcgaggtcaatttgttgagcaattgcgtcgaaattgatgcccacatgggctccgcgccgctgcacttcagcgtccgatttgacgaaggcaaagtcgtgctcaactcatttgctgtacgtgtactgcttgctctccgtttttgtcgatacatttattgggggaatgaatgctttcgattgcatgttttgaaattttaggccggagaatgggggaaggaagagcgccactcgaaccctttcaccaagggacagcccttcgacctgcgattccgcgtaattcattttgttttccccttgcaaccgatttcccgcccattttcccgtcattaggtccacgaagatcgaatcgaaatattcgccaatcaaaaacaaatcaccgaattcaaacatcggtcagtggcaattttggggagggaacagttgtgaagaaaatgtttaagaatcctttacaccaacgttgaccacattcaggtaattgagaaatgtctttttttttgctgtttgttggcgttgtgccctttttaaaacattgacaaatggccattcattcccccgcccgaggcacttcaatttttaaggtccgtggcgacgtcacattgagtggcgttcactggggcggtcgctacttcgaacttccattccaagcgaatttccacggcacttctctcaaaagcggcacgtttagcaattgcaacagcacaaatgttcctttccatgtttgagtgggtccgttttttcaggccaacgtctttttgtctatggcattccgaagggcaatttcagcatcaatttgatcggtgccaacggggacacacttttccatttgaatccgcgttttagcgagaaaaaggtgtgggcaaatggaaaggaaatgctttacagtctcaacagattgtccgcggctcccaaaaagacggcgtgtggggcgaggaagagcgcgagggcgccttcccactgaagaaggaacaggcggcggacatcgccgtgttcaacgagccgtactccctgcagattttcatcaacggccaccattactgcgcatttgcacaccgtgtggagtcgccgaacaccgactacaaatttgtgcgcgttgaaggagacattgaactgacggg

SEQ ID NO: 60386 - DNA, 131 bp, Heterodera glycines
  Genomic contig location: Contig_ID=SeqID_747; Location=134..264; Strand=+
  SCN-specific regions: Sequence locations=1-42,65-70,92-108,130-131
taaaaaaagggatttattcattttatgaaagaactatgcttgcattgataaaatattagcaaaaggcatttaggaaaaagccaagttaaaagttgttggaaagatagaaaagtgaaaaccttactcatttt

SEQ ID NO: 60387 - DNA, 1051 bp, Heterodera glycines
  Genomic contig location: Contig_ID=SeqID_747; Location=3695..4745; Strand=-
  SCN-specific regions: Sequence locations=1-160,182-213,235-1051
  Gene Ontology: Biological process=coenzymes and prosthetic group metabolism
atggcacttccaacaaaaatccaccaaattcccaatttactcacagttttcatttcgtcgtcacgttgtatttacgagaatctcgcccttgaggaatggctttttcggaacaatggcgtgaaggaggacggtgattctcttctcatttggaggtcagtccaaaaaatatattatatgttttaatctactgattttatcccaaaaatcagcaaaattttgccaataattatttttcaaggaattctccagcggttgtcatcggcaggtatcaaaatccgtggttggaaagcgatgtccgtttctgtgcggccaatggcattcgaatttcgagacggtacagcggcggaggcgctgtttatcacgacgaaggtattttcgaggaagaacggagtattttgccaagaaatgcccaatccatcttttttataaataaatcccaaccttaaaaattctctttctttgaggtaacctgaacattagtcttatgaccacacatgaacggcattcgcgcaaaaagaatttgcaaattgtggccgattttctgaatgccaaattgttcggcggttgtgcttctgccaccgctccgcgactgatcgcaaacgaacgcgacgatttgctaattgagccaagcggtgccaaagtgtcgggcacagccgcacgaattgcacgcggacgcgcataccatcacttcactttgctggtggatgttgacattggcactgtccgacgcgcactcaagtcgccctttgatgatcagcggattcaaaccaatgcgagccgaagtgtccgcgcaaaatccgtcgactgtttggcacgacatttaaaacaaaatgtagaaggaaatgccgaaacggtacggcacgaaataattttattttcgtaagaagatcaatttggagtttcgagtcttatggcactttaaaatattttatcagttcacaaaatgatgaatgcctctacaaaaggtggccgattctgttctcaaagcgttcgttttgcagtacaaaagcagcgaattggttcggtggaacggcgaaatggacaaatttga

SEQ ID NO: 60388 - DNA, 130 bp, Heterodera glycines
  Genomic contig location: Contig_ID=SeqID_747; Location=4916..5045; Strand=+
  SCN-specific regions: Sequence locations=1-130
atgcccaaaaaacatacgcaatcgaataaaacgaggaaaaggtcgggaagagaccttgacgagatccatgctgatctgatcaggcccgacaaaatgcaaagaattcaggtccttttcatcagtcattggg

SEQ ID NO: 60389 - DNA, 636 bp, Heterodera glycines
  Genomic contig location: Contig_ID=SeqID_748; Location=614..1249; Strand=-
  SCN-specific regions: Sequence locations=1-288,311-636
atgttcggctgcaacggaggcgcacacattcccggctcactggtaactgggcgcattttggctaataccttagcctctcatttcatcaaggtgtatgtcaattgggaggaggacggaaaaacgtaccaagcctattaccggggacaaagcccgcgcaaaaagtacaaggtcaagctgtacccaccgttgagcttcgaaatgaaggaacggagaagggcagaagaggcggcggaggatgggggcgaaacgccaaaaaataaacggagagacgacgaagttgaggtgattaacaaatgcatcatcaaaaatggaaattggaatggtgacttaaattccttttcttcccaaggtcacttccgaaatgatcttccgccgtgacgaccttttccccgaatacattcgccaagcattgctcaaacgaaagtcgggcgagtcgatcggtcagcctcagcacggaaggaacagctgacagagcggaagcacacaatctttcgtatcagaagaataagctttaatttccaaactgcttcttcataatgttcttccatcattattttttgtgctttcgtttttcgctccttttgtttgttttccttcgccatctcaattctgttttttactgctgtcctcattaaa

SEQ ID NO: 60390 - DNA, 240 bp, Heterodera glycines
  Genomic contig location: Contig_ID=SeqID_748; Location=4..243; Strand=+
  SCN-specific regions: Sequence locations=1-192,214-240
aggtcacaagcgtcgcctgcgcgccctcggagaaaaaccgtacacgcaaagagaggcggaattggccggcggattgggcgtggaagagcaaatcaaattggaaagcctggcggatttgacattttagcacccatttcttatagggtgaatttatgtttttttttgttgttgtttttgagttctttatcatacaaacagaaaataataaataacattttcgcaaaacaaaatatcaaacaa

SEQ ID NO: 60391 - DNA, 624 bp, Heterodera glycines
  Genomic contig location: Contig_ID=SeqID_749; Location=397..1020; Strand=-
  SCN-specific regions: Sequence locations=1-624
atgtccgttcgcagaggttcgacctcctcccaacccgcgtccaagtcgggcagtgtggagacgaataacagcgacgacagtttgccagtgccgtgcacaaagcgacagaaagccattttcaaggcacgcaaactgatggacgcactttgggccaacaaaccggtggatttgtacgcggaaaaggtgcattttcaccacgcattgcaaaaagtgaacaatcactaaattttcaaacatatttattatgttgttggatagtaaaatttaatttataaatcaaatgctcggaaggtgcacaactcgcgcagcggacgactgtacccgcactgtgccgtctgtcaattctttttgcaacgttccgtttggatgaagggcacaccggtggagaaagtgccggaaaagtcagtgccctttaatcaatcaaatctttaaaatccaacaaaaagaattttctttcgtgttcaggtcaaagcgatttgtatccgaccaaatgttcgagaaggattttcggatggacacgttggacttgggtcgttcgaaactgagggacgaccaactgagggaatgttcgaattgcaaagtggtggtccacgttgggtgttatccgagccaatgcacccttaa

SEQ ID NO: 60392 - DNA, 1119 bp, Heterodera glycines
  Genomic contig location: Contig_ID=SeqID_750; Location=1183..2301; Strand=+
  SCN-specific regions: Sequence locations=1-82,104-347,369-456,487 -534,556-825,848-977,1000-1119
atgaaatgccacttgataaaactgatcaatttgcctgttttagtacctttccaattcggtgaggtcgtaattcggttttggaggacgaaattgcttggagagtgccatccgccggaaatcgccgacgcgcatttccttccggtaaacggtgttgttcttgacatagcatcccgtgctcgagccgccctcaatccgttctttcctgaaaggcttttattcgaaacgttttttagcctaagcaaagttgcgaaaattattaaatacgagaaaaacaaaaaaaattatgatttttcaattgatcagcagaaggggaaattctttttgagacagcggcgacacaattcggtaagcaacagaactcgccgccctcccgtcgtccgtccgttctgcggtcgtttcccccttcccctgccccccccccctttcgtcgtcttcccttacggcgccattgcgtcggtctgtctcttttcccttcccttctctcctcacttcgctttgtctttcctttgctcgccatttttaatgaaaaaattattttacttaaaccaaaaataactgcaatcactcaataacttttcaactgttgttatagtattattatgacagttgattaaaaatccaagtttcagatgactattattttttgcagaatgtgcagtgctcacactgggcaatgaatgacgaagtcgttcagatcggagtaatcggacggatttttggacggacgcgggtgccaaccgggcggaggaatgacctgtgaaagaaacaagttttgtggcaatatgtaacattgaaaaaataattagcaaaaaaatgacaattaaaaagtaaaatatccgacgaaatgtccgaccttacaaacgccagaagataaatgcgctctgctgcgctcgatagtttcgatgtatttgctgaaattcgaaaactcctccatcgtcggtcgaaaaaccattatctctccgtccgctgtgcccgtgttgacccattctttttccttggtgtaaatgggtctataagctgccattcgaactgtgaaaagattaaaaaagaactggtttaagctaaatgtaccaaaaaggcatttaggtaattaaacaaaagaaagtaacataaaaaaca

SEQ ID NO: 60393 - DNA, 2215 bp, Heterodera glycines
  misc_feature (2206)..(2206): n is a, c, g, or t
  Genomic contig location: Contig_ID=SeqID_750; Location=1..2215; Strand=-
  SCN-specific regions: Sequence locations=1-34,57-478,500-547,578 -665,687-930,952-1184,1245-1438,1460-1505,1530-1654,1676-1880,1902 -2010,2032-2215
  Gene Ontology: Mol. function=specific transcriptional repressor activity; Cellular component=nucleus; Biological process=DNA repair
acagttcgaatggcagcttatagacccatttacaccaaggaaaaagaatgggtcaacacgggcacagcggacggagagataatggtttttcgaccgacgatggaggagttttcgaatttcagcaaatacatcgaaactatcgagcgcagcagagcgcatttatcttctggcgtttgtaaggtcggacatttcgtcggatattttactttttaattgtcatttttttgctaattattttttcaatgttacatattgccacaaaacttgtttctttcacaggtcattcctccgcccggttggcacccgcgtccgtccaaaaatccgtccgattactccgatctgaacgacttcgtcattcattgcccagtgtgagcactgcacattctgcaaaaaataatagtcatctgaaacttggatttttaatcaactgtcataataatactataacaacagttgaaaagttattgagtgattgcagttatttttggtttaagtaaaataattttttcattaaaaatggcgagcaaaggaaagacaaagcgaagtgaggagagaagggaagggaaaagagacagaccgacgcaatggcgccgtaagggaagacgacgaaagggggggggggcaggggaagggggaaacgaccgcagaacggacggacgacgggagggcggcgagttctgttgcttaccgaattgtgtcgccgctgtctcaaaaagaatttccccttctgctgatcaattgaaaaatcataattttttttgtttttctcgtatttaataattttcgcaactttgcttaggctaaaaaacgtttcgaataaaagcctttcaggaaagaacggattgagggcggctcgagcacgggatgctatgtcaagaacaacaccgtttaccggaaggaaatgcgcgtcggcgatttccggcggatggcactctccaagcaatttcgtcctccaaaaccgaattacgacctcaccgaattggaaaggtactaaaacaggcaaattgatcagttttatcaagtggcatttcattttttgttttattgagtaattaacccgacttactttatgcgatttgttcggttgggacaacaaaaagcagagagatatttatcgattaagatagttaacagcaagtaatttcaatttctttacaaaactcaattattccctcagttttttcttaaaaaacataatctttaaaaatataatttttaaaacctatagaattatatattttaatccaaaatgttagttagtctttatgcatcaaactaatcattggattaagacatttttggcgcaatttgctccaccacgagcccatctacggggcggacacgccgggctccatctacgacccgggtgtctctcagttcaacatgaacgggttgggcaccattttggacctgctcaaagagcaagaggttggccaaacatggaagaacaaagttttaatttgacatttcattcagctcgagatcaaaggggtgaacacggtttttctctattttggcatgtggaaaacgatgttcccgtggcatgtcgaggacatggatctgtactccatcaattacctccattttggcgaggttaaaaaaactcaatgaagttcattttcaataaattttgatgggagtgtccatgaaattctcttcaatttttccttatttaagcccaaattttggtatgccattcctccgtccgcggcggcaaaatttgaacgattggcggctcaacgatttccggacggtctccaaatttgcaaggcatttctccgccacaaagtgtacatcgtctcaccgtcagtgctgcgcacgaatggcgttccgttcggctcaatggtgcaataccccggagaatttatgatcagtaagcgagcagaatgggagggcagaaaaatggaatggttgaagaaaacggcaaaatcaaacgtggagacaaacggaggatggggtcgggagatggatcattcgaatagaactggcgtcgatttgattgttttgattctgatttctaattattttatttctccagcatttcctcgaggttatcacatgggcttcaatttgggttacaattgcgcagaatcgacaaactttgcgctcgaacggtggatcgattacggtaatcagaaagacccctaattttcacttttcaaaaatgcaggcaaaaatgcggtgctgtgctattgtcgaaacgatntgtgtggag

SEQ ID NO: 60394 - DNA, 388 bp, Heterodera glycines
  Genomic contig location: Contig_ID=SeqID_751; Location=454..841; Strand=+
  SCN-specific regions: Sequence locations=1-388
cggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccg

SEQ ID NO: 60395 - DNA, 986 bp, Heterodera glycines
  Genomic contig location: Contig_ID=SeqID_6109; Location=98..1083; Strand=+
  SCN-specific regions: Sequence locations=1-676,698-986
gcccgaaaagtcgggggtattaagagataatcactttcagattcgttacgaaccctacgtcaaagtggagccggatgagcttagcgtaatgcaaaatctttggaaaccgtaaatttgctcctcaattaggcattggctcaccgacgacttgtcgccaccgttgacacaattgaacatttttgcgcactgatggaccttcataacatcaaagatagggttggtctgagggggacaacgaggggacctaattaagggcaattagggggtggtgaaataataattttctggccactattttccatttcttagctggcgttggtaaaggcggcgttcgctccgctgactttgttctgtgccgtctcttccaccgcacgggtgagtttttcgtcttcctaaattccttttccatttttttagcattttgtgccattttccgcgttatttcatttttcttgacttccccccccccctttctcttaggtcacccgtaaccgtgacattctttgcctctgcaatttcggctacgtcccgcgcggtgcccacctcagttacgccgagccatagttgttaattgcctcaaatggtttaaaaatggcatccattttcagtcatttttccaatcgattggtggacagagcgctggacgaattggtggagccgttcagaacgttcaacttcaaagagcaggaaattgtgctgatgaaggcaattgttgcgctgaatccatgttagagagcgatgaaaaaagcaattaattattttgctaattactcattaagacctgcccaatttgtcggcagaagccgcagaacaagtggccgacttcagagaccgagttcaggtgcaacaaattacttaaaaacagccaaacaatttgtcaatttgaacaggaaactctgtacaacgtggtgagagaaagtcacccgaaggaagtggcttcttcccgatttggcaatttgcttcttttcctccccaatattatggta

SEQ ID NO: 60396 - DNA, 810 bp, Heterodera glycines
  Genomic contig location: Contig_ID=SeqID_6110; Location=3217..4026; Strand=-
  SCN-specific regions: Sequence locations=1-35,57-142,166-810
atggtcgacggcgactcggacttggccggctcggcggagatggaagaggcgagggaccgaatggcagatactttgccatcgatggcgccgcaaaaaatggcatggctaatgcaacagagtacaacagcaacagaagcagcgaaggaagaggaggaggaaaatgaacacgtacagatgggaggggggacggccaactgaagaagccaaactccaacaattggacatcgatcgtcgtttaaaaacgctcaatactctctttgatttcatatttacatttgcctacctctaacaataaatgccattcgttaaaccatttaaatacatatccattaaattggttttacatacaatttgtattttattgttgaaaatactcgttcaatacgtttgttttcgttgttggtttcgtgttaattgcatgagcagcaacaccccccaaaatcagccgactccgtttgattgttcttcggtcgttcactctttgaaaaaccttctacagttgaacagagctgtccaaaacattctcgaaagcactgacaaggcccaacctgagcttttcggtcggatcaatcaggtccgtccatatccgattcggttaattattttcattttgcgattttgcaggtgaccaattcgttgcgatcgctgcgcgaaaacgttggacaaattgaggacatcgatcggagtgaggaagagcagcgcgaactgatcgaggaccttcagcggcgattgaagaccaaaaatgacttcttcagaaacatcggcggagaaaatcggaacggagaagggacagcagcagacggagtttag

SEQ ID NO: 60397 - DNA, 1581 bp, Heterodera glycines
  Genomic contig location: Contig_ID=SeqID_6110; Location=1..1581; Strand=-
  SCN-specific regions: Sequence locations=1-8,50-50,173-347,408 -494,629-988,1010-1139,1162-1366,1389-1581
  Gene Ontology: Mol. function=transcription factor activity; Cellular component=mitochondrion; Biological process=regulation of transcription, DNA-dependent
tcccttttagcctccaaaaacaacaattgtgtcgactcaaatttcaattgcttcgatgcgtttgacttggacagccaattgacggaggaagagcgcactctgagggaccaagcgcacgcgtactgccaggaaaagttgcagccgcgggtcacgcaggcattccgcgaagagagtgggtagaagtggtcaaaggggaaatcggcagaaaaattggatgaaatttaaggggaaattaaaacccataatcgatgggttattttcagtagtacaattccaaataaatgccttaaatcaaatcctacttttgctactgactcttttttcactggcttttccctttcctccagagttcgacccttctcttctgcccgaactcggtcggatgggttttctcggcgcgccttacaaagtgagccttcgctgtctttaatttttttggcattcgcccgctaagtgtccataaaaatgccaattcgggcttcattcggctatagggttacggttgtgccggcacttccttcgtcggctacggtctgttggcgcgtgagttggaacgtgtggacagtggctaccggtcgattgtgagcgtccagacgagtttggtcatcggtccgatcgtcacttatggcaaacattggcaaagggtccaccagacgcccaaactgaacgctttgttaaggttccgaggctcagaaggaaaaatttctgcccaaattggcgagcggtgaattgatcggtgccttcggacttactgagcccgaccacgggtcgaacccggcggggatggagacgaaggcggagtgggacgagcagcaacagttgtacaggtggacacggcccattgagaggccaaacgcaatgccaaccgaacccaaaaaggctgagcggctctaagtcgtggatcagcaacgctccggtggccgacctgttcattgtgtgggcccgaagtccaaagcatggaaatgccgtcaaagttggccattgtcactgtccagttggcatttttccattattcagggttttatcatcgaacgtggcgccaaaggactaagtacacccaaaattgagggcaaactttcgcttcggacttcgatcacagggcaaattgtgatggtcggttgttgtcacgacgaatctttaacaaaatgaaccaaaataaaatggaattaggacgaagtgccggttccggaagcgaatttgctgcccggtgcccagggactcagtgggccgttcggctgtttgaacagtgcgcggcttggcatcagttggggggcgctcggcgcggccgaaagttgtttcgccgctgccagggaatatgccatggacaggtgtgagagaaatggcattgtttgggaaataacggggtgaaaaagggagagaaagaagaaattcagaccattcttgacaaattttcataacaattccatggccatgtttatcagtaccgccgggccccaacagtccaggaaattttcaaaatttgacccaaacaattaaaattttatcacagccggacttttgaccatcgagcagaattaatttgcagaaaacaatttggcaagccaatcgcagcgacgcaaa

SEQ ID NO: 60398 - DNA, 577 bp, Heterodera glycines
  Genomic contig location: Contig_ID=SeqID_6111; Location=228..804; Strand=+
  SCN-specific regions: Sequence locations=1-577
atgtcgaatgcgtggaccgttctcttccggcaaagatcgtcaagggacgccgcccaaacaccaacgccggcggcaaagccatggagcagcacaaagggacacggactttggggatggtcagaggacggtttaatggtcagcgtatgcactgaactgttccaaagacgaaccttaggacggaaaattgtgaattatgattattaaattcaaattccaaaaggaataaaaaatagaaaattcaaaaataatttcccgacacaaaataaagggtaatcacagtaattgatttggtgctgatgtgtgtccgaactctgctgagtaaacggcgttccgcgtccgcaagtctgaccaacgaagactgaccccaacggaaccacgaactgcaaagggtcaccaattattaatagaggagcattactatgtttatattgactcaaaattccaagtgccttttttttgctttcggcctttaaatgtcaaattgaaggtgccatgggcgaaaaaacagcaaacaatgaccaatttcgcagtatttgataaaaatttaagggtaattgtcgtccgacggtgccgataa

SEQ ID NO: 60399 - DNA, 304 bp, Heterodera glycines; identical to SEQ ID NO: 51570
  Genomic contig location: Contig_ID=SeqID_29922; Location=108..411; Strand=+
  SCN-specific regions: Sequence locations=1-304

SEQ ID NO: 60400 - DNA, 202 bp, Heterodera glycines
  Genomic contig location: Contig_ID=SeqID_29925; Location=205..406; Strand=+
  SCN-specific regions: Sequence locations=1-202
aaagggtgaaaaatacagtttggaaaaagggcatgccgaacttttgttccaattcaaatggtccaataatgatgatggttcagcagaggagaaattcgtgttggacttgaccccaacacagttaaaagatggcaaattggagttcacaattgacagcaaaggcattgagctgaagaggacttggtaaatgatgaaaaaaata

SEQ ID NO: 60401 - DNA, 1396 bp, Heterodera glycines; identical to SEQ ID NO: 29926
  Genomic contig location: Contig_ID=SeqID_29926; Location=1..1396; Strand=+
  SCN-specific regions: Sequence locations=1-164,186-285,308-733,755 -1396

SEQ ID NO: 60402 - DNA, 461 bp, Heterodera glycines
  Genomic contig location: Contig_ID=SeqID_29929; Location=660..1120; Strand=+
  SCN-specific regions: Sequence locations=1-461
atgcttttcttaaagatgctgaacagcttcctaactcatggctcttcttgggagcacagtgggcactttcctcgcgtcactctttgcgacctgaaggtaaaatttcctaatttgagcaccattactaataaatttccgaattattctgagtgccaattaacttcatttttccgaatatttaataaatgggaattaatttaccaaaagttatcaactaataagattttttcgaaccgttcagatccgtcaaccaaacgaacgctttcacgagttcactgtccaatgtgtgctggtggcgaattttgtcagttaaatgcacttgaaatatgggtcaatttagtctggtagttttaagtctgctggaatgcctcaaaacgatcttttttttaattttaaggccgtaactgtttgtaaatttacaaattataaattaatgggcatgtttcgaggtagaaacatta

SEQ ID NO: 60403 - DNA, 62 bp, Heterodera glycines; identical to SEQ ID NO: 57164
  Genomic contig location: Contig_ID=SeqID_29929; Location=1190..1251; Strand=-
  SCN-specific regions: Sequence locations=1-62

SEQ ID NO: 60404 - DNA, 459 bp, Heterodera glycines
  Genomic contig location: Contig_ID=SeqID_29931; Location=46..504; Strand=+
  SCN-specific regions: Sequence locations=1-70,92-251,274-325,347 -380,411-459
atggtaaaagcggacaatgaaaggcattcgcgacaattacaaatggcaaaaaatgtgcaaaagttagactcactaaatggaagaaaatcaaagggaattgaaataaaagagccgacacaaaaagtgccaaaagtggagaaaaatgacgagggaattgaggcgaagggcaaggaaattgtggaagaaaaaacgaagaaaacgaagccgaaaaagaaaaaaggggatggaaaaagtcgaaagtcgaaggacacttctgttgataaacataaagcagaaggggaaggaatggacgaaatttgggctaagataaaatcagatcaaaaacaggaggaggaggaggaggaggggaaaggaacggacaaaaaggacggaaaggaagaagtattggaagaggaggaggaggggagtggatcggcaatgttgcgcgaactcagacaaaaaaggggaaaactgaagaag

SEQ ID NO: 60405 - DNA, 218 bp, Heterodera glycines
  Genomic contig location: Contig_ID=SeqID_6112; Location=195..412; Strand=-
  SCN-specific regions: Sequence locations=1-57,79-145,168-218
atggcttctttagcattgtcgaccggtaggtttcgggtttaaggtgtaataaattaatagtttcagtgaaatgcaagaagcgtggaaacttctcaacataggcgtcccttcgctaaaggatatatgcaccaaaagcatttctgagaatgagaaagctttggaagaatttcgatcgttcccatttgtttttaaaaaaatatttacacgtttttaataaa

SEQ ID NO: 60406 - DNA, 2020 bp, Heterodera glycines
  Genomic contig location: Contig_ID=SeqID_6112; Location=1542..3561; Strand=-
  SCN-specific regions: Sequence locations=1-386,408-560,583-646,669 -706,728-887,910-1062,1084-1316,1338-1401,1423-1537,1561-1605,1628 -1721,1752-1947,1976-2020
atgagagccctctggcgtttggcgcgggccttccccggcaaactcatccgctgcatttgcttctacgccgcccaagccctggagatcgaacggttggtggcccaacaagaaatcccggacattttagtgacgacagcggacgcgacacagggccacgagtcgtcacttgccgtcgtcgtcacaacatgctccgtcttcgacagtggagccgactctcagcctttctgggctgatgccgcacgggtggatgtcgccatctcccgcgccagccatggaatgatcatcatcggcgatttgctgctgctcaaccggacggagacatggcggcgctacctggaccaagcgacaacggaaacgacagtggtcggcccggaatacttcgacttcgagcagttcaacaaccccgacaactattacgacaaggacggacagctgatctcatcctcaaggtggcactcgggaacgcactcgtggcaaagcctcaacttttggtgcgcgcagacgaatgaaagccaagctgtacgacttcagccatggacggcaactgcgcatggacctgcttccctcttcattcaattcccctcacgttttaccattttccttttgttttgactctctctttctcactctctctcgtcatccatttcttttaaaattatcattcattttgtctttatttccgaactattaatggcctttctttcccccaattcaaatttcttaaaaatgcgtcggtttcctcacactttctctgacccattctctctctcttctctcatcatgcttttacatctcgtccccaaaccggaatgacccctggttgcttttctccgatttcccatgccatccatctgagatgaaggtggaccgctgctcattattgtaatgcgcagcttggccgtggaagttcggattggagagacgaagggcgaatccgagagtttggtccattcattcactttcacttcatttttcatttaaggatcggggacgatcctaagggaagggggaagttgtaagtattattcgacgcatttccctcatttaattattccttattggccattatcaattcaatcacatttatccattttcacacgtttttccttttctcattgtaatgtttctccgcccattctcttcgcatttttccttccccagtgatcagtcagtcagtaatgatggaacagacttcaattattattccgatttctcgcttcgtataaatccaacaacgaatgaataaagacatctttaacagtcaatgagtcgtttgggggttcggggcttggtcaaaggcgccttggcttttccccattccctcccaaactccatccgggataaacggtgcatagttggtctgggggcatagtgcgcatccctcactatggtgagactgtaaattatacggtgttttattttatttttaggacaactagtgctgcacgtttagttttatataaaaatatggaaagggtatttaatacgccgggctgtcgtcttttttattgcgataccggtatgtaaaaatacaaatttagttgatttttattttgttcagattcattagttattgcccaccctccgaactcatgtcctcttaaagaaggaaaattttttggggaaatgactagagaatatgcggattccgatattattgagtatgtttcgggtggtcctaaacagtatgcattgaaattaaaagacgggaaactggagaaatttggtataaaaccaaaatacgcgggataactttggatcgtaataatatttgattatgaaacttttaagaaaatgattttaaaatatagagacggagctaatttcaaatttacatacccggacagttttaggtagtgttaaaaaaatttctgaattaaatttcttttattaaggcccggccgggacagtttaatcattaatcgtgaggttaagaaagactataaaccgatacagaagaagggcattattgatgccaatttaaacgtactgccttttggatatttttgagtaaaataaa

SEQ ID NO: 60407 - DNA, 2136 bp, Heterodera glycines
  Genomic contig location: Contig_ID=SeqID_6112; Location=3922..6057; Strand=-
  SCN-specific regions: Sequence locations=1-195,219-288,310-1355,1377 -2000,2022-2136
atgcaaaaacctattccttcaaatcgccccaactcttctgtctccaaaacccttgcctgcgggcttgaaaaaatggtgaatgcgagtggaattgagccactcacggtgccggtgctggcggatcggagtgatccgctggggctcaagtcggttcaacccgacccggtgccaatggaaagtgccaaggctggcacaaaagaaatggaagtgatggaagtcgatgaaatgagcggagaaaaagggaaaaagggagaaatgggtaaagaaaaggtgaaaagtggtggaattgaagaggaggaagaaagtgagggcagtgagggtgaactgctaggagacggtggatttggcaatttgcaactaaaccccagcctgagggcgggaaataaagcagttgaaaaggaagataaggggaaatcctatctggtcgcccaagtgagaagcgacggtgtgatcgcggcacggatgaaacttttctgggatttcccagaattggtctttgtcccttttagcctcttcgacaacgcccagccgatcgaaatcggcgatttgttccgcttacataagtgtgagtggacgaagagcgaaacaggatgggaagagcgcggagattggctgtatgaagcaaccggacggctgaactaccaagctacggcaacggacgtgagccaattgcgccagcgcatccccactctggccgtcggcattttggtcgatgtgcaaagagcccgtgaccgacacgtcaaagtggccatggtgtcagcacctgagctgagctgcgtgatgcgcgcctaccgtcgccacttcccggccgatttcacggataacgacatccgctaccgctccgttgttcgtcttcaacttcggcagatcaacagtccgccatgggtgctgtattcacagcagtttgcgtatgttttgccatctgattttggtaaaaaaaggggcgatgaactgctcgttcatcacgcaaacgtcattgctggcgttgagcctgagccaatgggctatgagttccctttcagtgccgaactgagctgggcgaaggtccagctgggtgagaaggtcatggcggcggctgtcgcagcgcagtcgttcgatgtgaaggctgatctgcggaagcacactctgttcgtcgaaccggtcgtcatcaatgagatctcgacaagaagcgtgatcatccagttcgtcatgccggtgccgagcatcgaagagctcaccgaattgtgcaaaatctgggaggtcgatttggcggtgggttgcaaagtcaatccggcagccaaggcaaagccttgtgcgcatgggtatgtgctaagcatcgaaaagcgggcattctgtgtaggatacgagatcgatgtaaaagtgatcctttcctatcaggcagcgaaggagcaggatgcccaggaggaattcgatcagctgcgcaccggcgaactcgacggatgcgttgaactcatcccgcagacgtccgtcagggccctgcaggaacggatgttcacgctgcggtccaatgactgctcgaaagtggcgaaggacgaggcaaaggtgggccgaatcatgtcgattttattgggccgaccggtaaaaccggaaagcccaaaggccaataacccattaatgacttttggtgctctttcaaaattgaaagagagacagatcgacaccgcgctgtgcatgctcgacgaggtgccgcgcctggtcttccaacaggccgggcccggcaccggcaagacgttcagcgcggcgtcgatcgtggccacggtcctggccacggatcccacggcacgtgtgttggcgctggccccaccgaacgtcgccgtcgtcaagctggtgctggagatgcaggatgccctggccgccggaaaccacgtggaaccaatgcttgccttgttctccgggacaggtaagttgagatatgccaaggaagttgagcggatttcccccccacctgctcgccaccgcggtggaggcacaggactttcaggaactcctgcagaaggatcaagaacgcgtcaaggtggagcggtacctggacgcctgcgagcggaacccacgcctggcccaggaaatggcagtggcgaaaattgtgcaggagcacaaaaatcgccgcttgtgcttcgccaccttgtccttctgtga

SEQ ID NO: 60408 - DNA, 468 bp, Heterodera glycines
  Genomic contig location: Contig_ID=SeqID_6112; Location=7336..7803; Strand=-
  SCN-specific regions: Sequence locations=1-69,91-468
atggccggaaatggaaatgagttaataaaaagagaggatgacgaaaattctgttaatttcatgaatttgtttgaaaatctggaattgatggattctgaaaaactagccagtctaagggacattgagaaaatatttgcggacacctcaccgccgccaactggtccatcgccaattgaaagctcagttttgggggttgtgttcatctcacaccccatactgtgggcactggtacaaccggacattttgggcgaacgaaatgagctattggaccgaaaaaatctaagcttagaatcggatcaattagtcttccaaagtacaccaagttatgtgacgacaattacacttgaccctaacaataactggccacatttcacacaaatttcgttgaattggttcgactatcataccgttacctatgtgccgccatggacttgcaacaatcaccaaaacgcagatgaattgatttaa

SEQ ID NO: 60409 - DNA, 806 bp, Heterodera glycines
  Genomic contig location: Contig_ID=SeqID_29932; Location=48..853; Strand=-
  SCN-specific regions: Sequence locations=1-806
atggccagagattgggggacgttgcgatcgtcggactcggcggtgggtcgttggacgcattccttcacctcaaaattccatcggtgccaacgacggaattgggaggaattttggggaacttgctttgttcagctcaacatcactgtctacgagagtgactcagttgtggtcgaattggccaaacaatggttcgaagtttcggacgatcagacgcggagaacggtggtcggagacggagcggccgcaatttccgatcacgtcaaaaggggtgagtggtagaagaactgcagaaaagtgacccacagaaaagcggagaattcgccaccatcccaagccgtgtattaaatccgatataagcctaacattgacgtcatatctttgatttttctggcgttaaaagtcagtcctatgacctttttgtagccacgtcggtgcaccccaaaactccgccgataattcactattaaattttgaaaaaattcgctggaaattgaggcaatcgcttcgacgcgatcattttggacgcgtgcgactcgtcccctcacattccgtgcccagcctcgccattcatcgctttgaaaatgctcggaaatgccaaaagcgcacttcgaccacagggtttgccaatcaatccacgatatttgtgttggtgccttcaaatttgctaatcccttaaggcgttttcgtaatgaatgctctccccgccagcgaacagaacgagcagaagactctcgcccttctccaagacaaattgctctcagtgtttccgctttgcgttcggatgacaatgggtcgtcaaatgaatt

SEQ ID NO: 60410 - DNA, 433 bp, Heterodera glycines
  Genomic contig location: Contig_ID=SeqID_29935; Location=46..478; Strand=-
  SCN-specific regions: Sequence locations=1-433
atgccgtttcatcatgtgctgctgcttgtgctcgtgtgcttctttttgctttttgcatttttaaattttggcaatgcacaaatttttggcttcacgggttcgtttggattcgtttgacgtttcgacaaatgaatattcagtaaccccggaaacacatggaaattcttaattttccgaaacgccctaaatttttgttaagaaatgatttcatcattttgaaggtataggaatcggattctccggccccgaaaatctgagtttggaagtacacagtaaacgcctgaggcattgaaaccggaattacccatgtctaaaatttagaaaaaaattttttactgtttatcaatatgtgtttcttttttgagcccagaaattttgagtttctggtcctgtatgtaatgaatgttagcagataaattttaacaaaaataaa

SEQ ID NO: 60411 - DNA, 49 bp, Heterodera glycines; identical to SEQ ID NO: 51181
  Genomic contig location: Contig_ID=SeqID_29936; Location=760..808; Strand=-
  SCN-specific regions: Sequence locations=1-49

SEQ ID NO: 60412 - DNA, 658 bp, Heterodera glycines
  Genomic contig location: Contig_ID=SeqID_29940; Location=320..977; Strand=-
  SCN-specific regions: Sequence locations=1-658
acaaaaagatcgattttttcaagtgtccgtttggggtactcaaacaattatggggagcaaatatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 60413 - DNA, 240 bp, Heterodera glycines
  Genomic contig location: Contig_ID=SeqID_29941; Location=58..297; Strand=-
  SCN-specific regions: Sequence locations=1-14,200-240
  Gene Ontology: Mol. function=protein binding; Cellular component =axoneme; Biological process=eye photoreceptor cell development
atggaacagaaagtggaagagaaagtggaagaggaacagaaagtggaagagaaagtggaagaggaacagaaagtggaagagaaagtggaagaggatcagaaagtggaagagaaacagaaagtgaaagagaaactggaagaggaacacaaagtggaagaggaacagaaagagaaagcggaacagaaagtggaagagaaagtgaaagggacagtggaagaggaacagaaagtggaagagaaa

SEQ ID NO: 60414 - DNA, 291 bp, Heterodera glycines
  Genomic contig location: Contig_ID=SeqID_29941; Location=421..711; Strand=-
  SCN-specific regions: Sequence locations=1-81,258-291
  Gene Ontology: Mol. function=protein binding; Cellular component =axoneme; Biological process=eye photoreceptor cell development
atggaagagaaagtggaagaggaacagaaagtggaagagaaagtggaagaggaacagaaagtggaagaggaacagaaagtggaagagaaagtgaaagtggaagagaaagtggaagaggaacagaaagtggaagagaaagtggaagaggaacagaaagtggaagagaaagtgaaagtggaagagaaagtggaagagaaagtggaagaggaacagaaagtggaagagaaagtggaagaggaacagaaagtggaagagaaagtggaagaggaacagaaagtggaagaggaatag

SEQ ID NO: 60415 - DNA, 1450 bp, Heterodera glycines
  Genomic contig location: Contig_ID=SeqID_6113; Location=928..2377; Strand=+
  SCN-specific regions: Sequence locations=1-227,249-407,430-606,630 -663,685-714,765-796,819-978,1000-1082,1142-1283,1336-1450
atgaggtggacagcgaagtggaaggccgagtgttggccatcaattttggccgcaaggaataccgcgagttggagcaggtggccaaaccgggcgggggcatggcatttggaattgaagggcggcatggcaatcggagtcttttatccgatcacaaacaattggcttagcttcctgatcagtgattgcacaaataaaataaccacccaatatcaattagttttgctaactgatcttgaagaaatttatttctgtccaattttgaaattaaattttcaaaaaaatggggacttacatcgaaccttagccgaggggtaattaattatcagggttcttctgggttcgtatttacgatttgcgactcggtaaatttctcgagttttcgcttcacgatcccgactcctgtgttcatttcccggggtcatttttcctcaaaattctcgggtaaacgaatttaccgcaatgcccacgtaattttcggggacggagacggtcccaaaaaaatcgggggcctcagagttttggggaaacgcataatttttccatttttatagcttcatttcgagggccaaactggcgaagtgtggcgagtggtgaaaaagcatttgggaaatgaagcgtaaatatattttttggaaatttttttaccattaaaaactaaattttagcctcataaaatacatttacgcttaccgacaagctcaggtaaaaaaacggaaattaaaaaaaattaattgaattaaataagtttaataagtttaattaaagagccgattgacatcggcattcagtgccatcgaagcaaatgacatgcgcaaaatgaaaagtttggtggacgatgagattgtacagtcgcgcgactcaaggggtacggtaatgtaacaaacagacaaatatactgtattattaaaagcaattaaaaaaaaaatttgatttcaattttcaatttaaattcaggcctgacacctttgcatgtcgctgttttaaaggtgaaaaatcattcgaactgctcggcaacgagaattgattgatcattaccaaagtttacagaaaaactcgatgtttcttcgaatcgataccgagactttttaatttaaaaatttgtaaaagaaaaagtgtaaaaaaaaaatttaaaaaaaaaattctcggagtttttttaggaaaactaaaaaaattcaaaaaaaatgcaaaaatctttgtaaaaaatgaaaaaatattttttaaagcccaaaatccacaaaaaatattattgtcaattacatactttttaagatttccctaagcaatcatttatttttaaaatatttgtttgcttttaaaacaaatttcaaaaaatccagttttccaggccttgacaagcctggattttttctggacctgggttttcatgaatgtttgtccagaaaatccaggtccaggttacaaaatgtcgagccttgtcacaattaattaa

SEQ ID NO: 60416 - DNA, 2613 bp, Heterodera glycines
  Genomic contig location: Contig_ID=SeqID_6115; Location=933..3545; Strand=+
  SCN-specific regions: Sequence locations=38-207,229-660,688-696,729 -881,903-995,1070-1090,1200-1291,1410-2081,2106-2166,2332-2613
aaaataatatttaaaattttctttcaattttttttttctcgccacagatgcgccttcggacgagcaggtgaagcgatggctgaccattggcgaagtgtcacagcttgaacaaattgtgctcgacggacgtgcccatcttttggccgacaaaacgtcaaccaatttggcatccgccgaatttttgcagggggttcggaaaattcgaggaaattttctttttccaatttcgtaatttttttctaggtatcccaataccaatccaaaattgatgccatccacaagggtaagtgccatgtgaaattcagtgatgtcgccggcattttaacctatttttcaaaaaaatttaaaaattgtatttccaagtaaccccctgggttttcaattttctgacgacccatggctgttcgtggcttcgaattttttttttttatcattttctgccaattttttcacatatcctctcacaaaaacaaaattcctaaggaaatactccaaaattatttcactcgattaccatacgatacccgtgagtaattaattaattacatgtcctcattaccgtatccagctgttgaggagggcgatgttcgccgtgtcaaatcgttgattgaccgcaattcgttggcaaccgcccgggacacacatggtcaggcaaaagaaaatcaagattttatattttatatatttctatccccctaggaatttaaatttttaaaaattctcaaatttcaggggcttaatggctaaattttagactggcatatattttgcgggaattttcaaaaaagcctaattttcaccaaaattcaggcatgacccctctgcacaaggcgctcctttacggtcagacaaatacggtatttgtatagaacaaaaaatgcaaaaaaaaaaaaaaaaaaaaattgaaacggtttttcattattttttgtaggtgcgctttctgttggcgaaatatgcgcactgtgtcaacgaagctgatcatgttataattttggataataatttattaagaaataaactaatataaattaatttttatttttaattaaattcatattaaagttatttacaaagaatttttgtcctgaatttatttaattattttaaaatatatctatttattaattaaaaaattaaacaaaattaatttacgaaaaaacaatatttaattaattaattgattagttgtaatctaattatacatattataaaggaatattcaaattttaggccggtcgtactgcgcttcattacgcagcagctgatgcaaatggggagcatatgattaaagtaaaaaatattttaaatgaaaattgaaaattttaattggaaaaaatatcgaaaacttaaataattaaaaataaattttaattaaattcaaaaaataaatataaaaaataataataattgttaggtgcttcaaaaggccgggggagatgcattcattgaggaccgatatgggcacacgccatttttctaccgaacgcacggcaaaaggctgaacattcgaacactgaaagacaatgcggtgagatcaaaggaatgaaaatgataaaaaggacgggggacgagtgatcggagtgatcaattggagtaacgaacaatcgataattttttgtaggggaggtgagtattttgtaataaatgatcgaactgatcaaagggattaatcaaattggaaaaggtgaacagattgatcaaagggagtaagcgagttcgaatgatcggacaaataagaaggataagaggaattaagcaattgtaaaaagtgatcagagtgacgaaaggaataggcaaattgttgcgagtttgaaaagtgattggactgagaagcaggttaatagggatttagcaaattgttgcgagtttgaaaaggggccggattgatcaggcgctagcaaaatgattaaactgatcagagggatagggttttaaaaaaaaattgatttactcatctggttccaaaaaagaatcaaagctccaaaggtgatcaaccatctgatcgccggccaattgaaccgcactctgttgcaagacttggaggaggacatcaccgattgggtacacacgggcaacatcggcaagctggaggagctggtgctgaacgggtacgccgacctgttgcttggccgaaaccatcaagtgaaccaataattatcataacagatcaattaatcaattaaggcatcaattaatcaattatttgcccatcaaaaaaccaattagtaatcaattggagcgtcaatcaattagcccaaattatcggcatcattaatttataattagtccataaaaagtcaattagtaatcaattggaacattaatcaattagccccaaattacaagcaattaggcatcatttaatttttcaggttgaggatgccgaggccatcagtttcttggaagtgttgccacaataccaggccaaaatacacgccatccacaaggccattgagcagggcaatctcagagcagtcaaactgttgactgaccgcaaaaagttggcattgtgccgtgacggccggggattggtcagttctagagaatactcttcgactgaccctgctgatcagctccccgtaattctgtctgattttttttccagttggcaaa

SEQ ID NO: 60417 - DNA, 1103 bp, Heterodera glycines
  Genomic contig location: Contig_ID=SeqID_29942; Location=37..1139; Strand=-
  SCN-specific regions: Sequence locations=1-352,395-453,475-1103
atgccaaaagaaccttcgtcccgcgcatttcttttcaaaaaatgggtttccaattacatgaacgatgtttacacaactgattcaaagataatttattgtcaagcatgtcaaatagaggttttaaggaatatgcatttggaaattaatactttaaatttatatttgaaggtaaaatgcaaaaaaatgggccatttggagcaacacaatcaaacagcaaaacatatcaaaaattgtgatcgttttttgtcgtcaaaacaaaagcaaccattgatcagtcaaccgtttgttgttgataaatttgctgctgaattgtgttcaatgctgctttcagcgaatattcctctttttaaagtgaatacatatattcattttttaacaatttaactttatttaaggtcaataatccttcattcaaggcttttttggagaaatattgtggaagatccatcctacaccatgaaaccctcagaagcaattatgtgaaaaattgttttgaaggggtaaaatttgaaattttttgattgaccaatttttttcctttaggttttgtcaaaaagcaaggacgacattggcgaaaatggattcgtttggtgttcggttgatgaaaggacagacagaaatggacgctgtatggctaatttgcttattggacttctgaatgaacgttggaacgcgccgcatctgatttcggtgaagccactgttggacgaaaatggtgacccaaaagttgatcatcaaacggttgctcgttttgtggatgagggtttgggtgtgttagacatattaatgttttgattttatttattttagcggatttgctatctacaggagcaaagaaaaatcggcttctttttatggtgacggacagcgctgaatacatgaagaaggcggctcggaatctgcgtgttttctatcccaacatggtgcattttacttgcctcgctcatggactgcatcgaatcgctgaagagatccgcaatcagtttaaagacgtcgacgaattaatttcttctaccaaaatggtgtttcgcaaagcaccgtcacgtgttgctttctacagaaagaagttacctacagttcctctggttcccaaacccatctag

SEQ ID NO: 60418 - DNA, 1131 bp, Heterodera glycines
  Genomic contig location: Contig_ID=SeqID_29946; Location=1..1131; Strand=+
  SCN-specific regions: Sequence locations=65-109,131-158,183-362,396 -411,433-564,591-848,888-906,929-1067,1091-1131
  Gene Ontology: Mol. function=betaine/GABA:sodium symporter activity; Cellular component=integral to membrane; Biological process=transport
aatttaatttttaattaattaattatttttaaataatcattttatttatacatttttattaatagtcatcgcgtattgggcatcagtgaaggcattgaacatgtgggttttaaaaaattcaatgtttattctaaaaaaagaatttgtatttttttgccaaaaaatttttttttaaaaaaaatccaaaagaaattttttttacaaaattttcattttgaaaaatccaatttccgaaaatttttactaaaaattttcatttgaatttaatgggtctgtctttttttgaaaaatattttctttaaaaattctcgtaaatttttttttgttttttcaaaatctttttgaaaatttattccgaaaggaatttttatgaaaattttatttttattttttttgaaaaatcatcgtttctctcttcaaaaatttaaaaaatttctgcaaaggtcggttctcttcgacaagacatggcgctgtacttgctgatctgctggatcatctgctacttttgcatttttaaaggcgtcaaatggacgggaaaagtaaaaaaaaaaaaaaaatttcaaagaaaatttcttgaaatttttaggcccctaaattttgttcctccctcggccaaccttttaaaaaaaattttgatcgatttcccatttccacctctttttcttgtccaaaatccgggaatttttcttaaattttcggcccctaaattttctaagtcctccggaattttcaaaaaaataattaggccccttaatttagtcccccctcgccccttctctacacttctcatattatcctaatgcaacttgttcatttattaggcttaaagaattttgtaaaaaaatttcgcaaattttgtaaggcatcctaaaaattttcaaaaaattgtttaggcccccctaatttcctttcctctcaggttgtctatctgaccgcatcatttctctatttgatgctgttctttttgcttttgcgcggcctttcgttgcctggcgccagcctcggcctcgagtaaggcccaaattttcaaaaaaaaaatttctataaaatctatcctctaagattttatttgaaacccaacttttccaaactgctggagagcaaagtttggattgacggggtcacacaggt

SEQ ID NO: 60419 - DNA, 388 bp, Heterodera glycines
  Genomic contig location: Contig_ID=SeqID_6116; Location=313..700; Strand=-
  SCN-specific regions: Sequence locations=1-19,126-269,304-332,364-388
  Gene Ontology: Mol. function=electron-transferring-flavoprotein dehydrogenase activity; Biological process=ethanol oxidation
atggaaactgaaggaaaggtaatttatttgattaaagtttaatttataatttagttatattatttaatttaattttaaggtttaataaaatatttattctatatttttatttatttttgttaaatatgaaaatattggccaggtaatttgttgtcgtgccgccgttgcatgggagccaaataagccattagttattgaacaaattgaagtgagtccgccaaaagaaggtgaagtgcgcgtaaaggtaagggacatttgaaaaaaaacacattttaataaaaaaattaaatatttttatttttagattctcttcactggcatatgccatactgatatttttgtaataattttatttatataaatcagttgaaatatgtattttaataaa

SEQ ID NO: 60420 - DNA, 625 bp, Heterodera glycines
  Genomic contig location: Contig_ID=SeqID_6116; Location=2350..2974; Strand=+
  SCN-specific regions: Sequence locations=1-625
atgttcacgaagaatttctttttgtcagtgcttattttgttggtgcttataggtgtgaagaatgtgagtctgttataaataataattatttcattcaacattaattaataccaccttaaacagtgtgccgcatatggaagccgtaaagcgtcggcatttgtgccggaaaagggctttctcgcttttgagctcattaagcacagaagcaacgatgcggcaaccgactcacaaaaagcgccttacacagttagcaatgatccatgcggaattaagctgggcccaacttttagagtaatttataactaattaattgaccatttaccttgataatttaccaattgcggctttatcttctttaaatgattaatatatatttgatttaggttgaacatgggcatgaggtgatggtcttgcacggaccgggtcagtttagtctggccggtttagtctggtcgttttagtctggccgttttaggctggccagtttagtcagagggtcggttttagtctggcaagctgtttttgcccataactcttaaaatgtttttttttgtcaattataaacaaggaaaaacttaaaatatctatgtttagctacaatataaatgaatatcccaattagaaa

SEQ ID NO: 60421 - DNA, 907 bp, Heterodera glycines
  Genomic contig location: Contig_ID=SeqID_6116; Location=3303..4209; Strand=+
  SCN-specific regions: Sequence locations=1-546,573-806,850-907
atggccatttatggcttatgtgtcgatcgcctgtaccgtcaatggccacaagcggacaatacagtactgtggaggactacggcagcacattgtaccgacgtcaatgtaacactgtttgttgagaacaaatgcgccgaaacaaatcaatttcttatggatctacgtttgcgttataaaccggaagaaatgtatggcagtttcagtaaagttttaaaacttgaattattaaattattctgataaagcgaaaaatacacgccaaagaatcgagtttttttgggaattaattaaatacaccttaaaaatcgaaaaattttgaaatttttgtaagaaattttgaaaaaaaattgttgatataaaaaatgtaattttgtttagcatttaaaaaaaatcgaaattgcatatacaaattttgaaaatcaagttttttgaaattgtctaaaaaagcttatgcatttttttttgatggttaaagccatttttttgcagtttttaaggcatattttactgcatatttgggtattgttcgggttttcagggcattttgaggggttttattttatattttatgcacatatttggcactttttagggcatagaacttaaccctaattatcaccttttccttcatttaggcatgaagtcatgcacgattttgtgttgccagtcaaagcatccgagatgcaagtgaccgttgggagcaaagacataacaaaagggactgttcacgaggtggcacggataaaacgacacgaattctacagactgacttcatcagcaaatgacattactttattagaagtacagttttaaatttttaaaaattaatgaatttaaatgaattttatttgtttagctaaaagatgttttggaatttggcccacaaattaacagaatttgtcttccaa

SEQ ID NO: 60422 - DNA, 759 bp, Heterodera glycines
  Genomic contig location: Contig_ID=SeqID_6116; Location=4360..5118; Strand=+
  SCN-specific regions: Sequence locations=1-126,161-456,496-584,608-759
atgtcggcacacgcggagctgatcgattcgaagatattacgacaggatttggtccatttgtctccggtgtgtccacaaggatttttctgtcagtttagtgccatccataagacgtctcatgtaagctatttatttgttttataaaatattctataaaatacatattctcgaagacttttttagcatttctttaattttcgtatatattacttttgaattttttaattgaaagcttgttttaatagtaaataataacccatgttttttcatcacaaatcaatgattttatacagtaaccaaaagaaatcaaaatattatttataaccaaaaaaagtagaattaaatttatttttgtttgagggagacagcggttcaccattgttacgcgaaattgggggcagtttgtatgcaattggaattgtacggggccatgagtcgaagaaaagtaagtgcggaaattgatttaaattgaaatttttattgacaaatttttaattatccttcaaatccaatataaattctcaaatatggaaagcatatcttaactgtgatattttagatttgttcgcaaaaatcagcccatattgtgattggttgaaagaaaaaagccgtggagaagtccgttgcagctgaatattgaatgttttttgctgtgaatatgaagatgcaagacgaacagtccggaaaaccaacattcatatttttcagcgctaaaatcataaaaaaacttgtgtcgtaaaaattcttatattttatgaa

SEQ ID NO: 60423 - DNA, 774 bp, Heterodera glycines
  Genomic contig location: Contig_ID=SeqID_6116; Location=5525..6298; Strand=-
  SCN-specific regions: Sequence locations=1-241,280-346,384-471,526 -568,597-604,630-637,659-774
atggccaaaccaagcagcgattggagaaccattgaaggtttgatcagtaaaaagtacaacaaacggaggtccgtgagaaactgcttttaattgctacaattaaaaatggtgcattaaaaaaaactacgaggagtcatattttgtcaatagcaaacccatatcaaaatattttaatttctgtagagggattgaaccatgggaaagaagtagaaaatcaagaagattcgattggcagtgttactttaaaagaatatattaattattatttttatattttttcctctaactccaatttgcatcactaatttttttctcaaacccccattattaccagtgcttgtttttcccggttcccggttgccctaccgggaccgggacctgagattttcaaaacccgggaaccgggacctcggaggaccgctgcactctagttttaataatgaagccccttttctatatttaaagcgacccaattttttaaattatcattattttaaaatcaacattacaaaaatatttttatttgaaacaaagttttgtttttttaacaattatgtgtttttttcaatttcaaaaattaaagcaaataattttagccagctcgttttaaatttaaaaattaaaaaaaagcaatttatttgtaaatgaaaaaatgaaattagtgaatttatatgactaggtgatcactgatcgaagcttcgcaaatgtttttcatccaaattggttcggcatctgattgcacttttttattatgttgatggcgtaacaaataaa

SEQ ID NO: 60424 - DNA, 683 bp, Heterodera glycines
  misc_feature (32)..(32): n is a, c, g, or t
  misc_feature (69)..(69): n is a, c, g, or t
  misc_feature (80)..(80): n is a, c, g, or t
  Genomic contig location: Contig_ID=SeqID_29954; Location=1075..1757; Strand=-
  SCN-specific regions: Sequence locations=1-29,118-130,152-153,201 -331,353-355,397-454,537-573,596-660
atggatacaagtatgtaaacaaattcgacatntaaatattataaaaatagtgagaaaaataagataatntaaaaataatntaatatatgaattatttgatttttttaattttaaattcttgattccattgaaaatctaattactaaaataacctataaattttcaaaaatatattgtttttatagatatttttttataaacagcggctgaaataatcggagttacacgagaatgatgaagaaaagattcctttaaaaactcaaatatgaataaattttaaaaaaatagtaaaggaatttgcaaaaatttttgcatcaaatttttgcttattaagtttaaaaaagatagaaaaacctaaatatgtaaataaaaattaaattcaaatttaattatattgggaatttatgaacataagttcatcagagggtgaattgtggctttttctataggtacgaaaatatataaatattaaattaatgataaaattaaattgataatgtataaacaaaaaatcgataataaattaaaaataaaaagtcaaaatactaaacttcagataaggaacagctaagagttttttcggtgaaaattgacataggagatgaagagttgtcattggcaaaaccatcaacaattttcagaatagccaatttgaattttcaggaagaaaataaataaataaa

SEQ ID NO: 60425 - DNA, 737 bp, Heterodera glycines
  Genomic contig location: Contig_ID=SeqID_29955; Location=1..737; Strand=-
  SCN-specific regions: Sequence locations=1-28,50-493,515-549,571 -647,674-737
atttattcagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatttggtg

SEQ ID NO: 60426 - DNA, 308 bp, Heterodera glycines
  Genomic contig location: Contig_ID=SeqID_29956; Location=162..469; Strand=-
  SCN-specific regions: Sequence locations=1-171,193-194,220-308
atgtcggcacacgcggcaatgagcggtgccatcgcattcagtggagcaacagtaagttaatggcaaaaaaggagagggagggagtcaaaaatggggggggaaggcacaccacgaggccgcgaagcggccgagtgagtaccttcggtgcaggaaaattattaaggaagagagttcattatttatttgttttttgcataattaatttataaatatttttttcagaaagggttctgaaacgcaccaaattttatttacatgttagtttaggcactctgatgctttttctatcaaattgggagatgaataaa

SEQ ID NO: 60427 - DNA, 365 bp, Heterodera glycines
  Genomic contig location: Contig_ID=SeqID_29957; Location=733..1097; Strand=+
  SCN-specific regions: Sequence locations=1-274,310-365
atgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataa

SEQ ID NO: 60428 - DNA, 559 bp, Heterodera glycines
  Genomic contig location: Contig_ID=SeqID_29957; Location=931..1489; Strand=-
  SCN-specific regions: Sequence locations=61-63,91-98,174-245,313 -448,484-559
aggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 60429 - DNA, 4216 bp, Heterodera glycines
  Genomic contig location: Contig_ID=SeqID_6117; Location=388..4603; Strand=+
  SCN-specific regions: Sequence locations=1-342,364-1265,1287 -1327,1349-1965,1987-2526,2548-3642,3664-4216
cccgtttccaacgggtgccattctctttgctcctcaaattctgtccagacgcaggcccaaacggagtttcaacgcattcaagcagcttctctgcgatcgacgcacgaccaaatggtacgaatgaattggaaatcgccggggaagtccttcttttcagagggcgtgtattagcattgatttgttagtcgcgtgccaaagggaagtgaactttttgcgaatgatcgacaggtgagggacaaattggacggggggggggggaaatcgcagggaaaaaacgaacaaatcgaacggacggaggaaacttttcactaaggaaagcgccggtgctttacgaaaaagtcgttgtggagaatgccatccgacgatatgagatgtgttggttgccggcacaagtgagacggagcaaatcacttgctaattaaggggagaggccattgattaatgggattttattgaattgcgagggtttccccacaaattatggaaaagccaaagagaaaaaatgacaaaaaagtgaaaataataaggcacaaatccaattcaggctgcaaagccaaatctgcacaacattccgccgttggatgtgagaatttgaagagtttgtgaaaatgaatgactttcccttaaggtccattggatttggcacacccacgtccgttgcttttcctaatgattcaaatttgctgcgctttcagatgctttccccaacgcattaccgcgaagattgtttggccatctgtgggacagtggtcgaccacaaattgctaaatgcggacgaaatccagcagagatatgagcaggtgactggcaatttgtgccaatttccgctgccattttctcttcgtccccttggctttctcctctctcaattcgttggtgtctttggcttcggcatttgcccccccccccgccttcgatttgttcgtctgctcatcccctctttcctgctcagtcggtgtcctcgtggagcgaattctgtccggaagaaccgtacgactttctgcaaagtaacgaccgcgtccgcgagcagtaccaacaaaaaagcaaatacaacttggcggaagcggtgcaacgacagcgcaacttcaactaccaagtgggtggtgcggtgtttgttggtcgccgtccaaactccgtcccttggcacaggtgtctttgccccatttcaccgccccgcgctttctgaccgatgccatcgatcgctacatcaaattcctgcagctgaagcagacatacgccgaccattttctgacgccatgttacgacttcgacttggtgtggcacactcaccaagtgcacccgttggactaccacagagactggtcggactttgcttgttttgccaacatcgctaaatccaaatttagcgtggccattttcggggcggtgcttaaacacgacggtgagtcactcggaagtcaccaaagtacaattactgtgaaaagattccgtcaacgaccgatccaaaggcagcaaattgttgaaaggtaaaagaacgagcgaaggaatgatgagagaagaaaagcatttaaaggcgaaacgatgacgaaaaaggcatggaacacgcacttcaaagagagcttttggagacgcggatgcatgtacaggtggggacggagagaagaagcgaatccaatgcaaatgagagagagagagagacccatttgctaatgggactcggctaattgaatttgatccacagaggacacgtggcaccggcttttttggggtttgagtcccaagacaatgcggtaaaaacaaagggttaaccttttgttgaatgacacccattaagacgattacatatgggcacattcacattccttcgatagcactgaaagagattccggtgcagagagagcaacttcggatgaagctcaattacggaggtgagcaaaaaggaatttgtgaagagtgattattaattggggggggggggtaattaattaatgggcgcaccgaagggaaactgaaaaagaaatggcaccctcaggcaagaagatcatcactttcaacgccgacttgtgcgacaagccggtcagagatgcgtttgcggttgcgttagcttttccttggcaggtcactcgttcctccttttccctcgtttggcaaccgaatgccaccgccaattcggcgtcgcccaccgacgcccatccgccccagcagcagaacgggtgctcgtccggctcttcctccgccacttcctccggctcttccgcttcttccgtccccctcacttccatcgtcaaatttcccttcgagcgcaaaacaccggtgccttttgctcttcaatttgctctatttcgaagcatttcagcacgaccttctcatctcgttggacctgtggaatcgaactttgatacacaagcgtgacgtcgtccgacttttggtttgatcacccaaaagcccaaaacattggttggtctttcttttcatagggccgtcttccgctcgaacggttattgccctcggaaaatacgaagccccagcagcgagtggtccaagcttatttagaaagtgttaacagtgccatcgccacagaaggcgaatttcgagctcgggtgaacgtgactgccaggcaagtcgaacgtcgcctggggcatttaattccctcgccaattccccgagacaattcgcccgcccgctcaaattgtcacagggaaaaacggcacttagtacttagtttatatataataagcgaaagcctctccctcccttaagcgtctcgctgaatcgggagcttgagttgttggccggtgattacgtcgagcagagtttgcagcccgactcgcgactttgggccctttgccaaagcgcggcacttaacagaagccaattgcatccgggcgtccatgtttttacggccattcacacgtcaattgggggagggttgggaacggacaaaacgaaacgcaattggctatttcagactcgtggatgtgagagacggcaccaaatatttcgcacaaattgtgcactcggcgccactgcttctgtccatgatcctcatttttggcacggaacaaagtcagctgtttgtcactaggcttaaactggcgatcgatttaggactgctgagcatggctcatctgatcggagccgactctttgccctccaaggaacagttggactccaatttggtttggtctcccaacactcggcgaagggcacttctcacggcctttcctattagcaatttcttcctcatttgtcttcgcccgatgagcgagtgcttctggtgctgaaccgggagggcgacttcggcatccttaaaggacggtggcacggcttcgtgcgacgacagacgggcgacaaacgcagaaaagtcggggaattgcggtgggggcgaacgaaatccgaaacttaggggaaaagcggaagtgcgggcgtactcaacgtggagctgttcaacctgctcaagtcggccaaggagagaaccttttgactgtttccccattcagaaacaccgtgcagaaattccaagtcccaaattcggacggtaagcattggaatttcggaatttgctaattgcccttttaaggctccactctctttacaatcgggggtttcgtttgcttgtgaagcgtcccaaactgctcaattttcagatgcccaagcgcgccttaacggacgccgaatggtttttctgtttctttgaccatcaaatttttaattctctaaagcattgtcgcaccactcaaacttcggaatatttgagttgcattttcggcatcggcactctgttcattctttgcaacccggacaaagttcgagctcggtctgagtcaacgacacctgtcagccatcaagtaaaagggctgaatcagtaaaacgaaacccaggcctaaattaagtgtcagaaatggccgatgacattggcgtgtggttacggtaatttttatggactttttgaattggcgttcccgaaggcaaagctacgccgaggaacgaatccgcgttttaagagtcaccaaaccgaacgaaggaatcattgacccaaaaccttaatacctttgaggccgtcccgtgccgtcaaatcgaattttggctgcgcaacgctaccaacaaaacttcacttcagccgaagttgcccctatgcttttgatgatgaatgccatgactgacggcactttctccggctgtgacggggccgcaagttgcggtagtgtcacagatattgccaattgttgacatgaaccccttgaacttcttgaac

SEQ ID NO: 60430 - DNA, 1642 bp, Heterodera glycines
  Genomic contig location: Contig_ID=SeqID_6118; Location=44..1685; Strand=-
  SCN-specific regions: Sequence locations=1-361,388-459,486-532,565 -806,828-1016,1044-1337,1361-1642
  Gene Ontology: Mol. function=hydrogen-transporting ATP synthase activity, rotational mechanism; Cellular component=proton -transporting ATP synthase, catalytic core (sensu Eukarya); Biological process=morphogenesis
tttcaattaaaaagttgaataggtcaagaatcttacaattagagcattagttgtttatcattgttttttttagggaatggcacttaatttggaaactgacaacgttggtgtggtcgtctttggaaatgataaagtgatcaaggaaggtgacgtggtaaagcgaacaggttcaattgtcgatgtcggcgttggcgaggctttgcttggacgtgtcgttgacgcgttgggcaatcccatcgacggaaaaggtccaatcaatgtcagcaaacgctctcgtgttgaagtcaaagcgccgggaatcattccgcgtgttggtgtgcgagagccaatgttgacgggggtaaaggcggtagactcattagtgcccattggccgtggacagcgtgaattgatcatcggagaccgtcagactgggttagtggtatccacacattcactcggttttacgtgaaattaaggaaaactgccattgccatcgacaccataatcaatcaaaagcgtttcaactcaagcacagaagaaaagaagaaattgtactgcatttacgttgccattggccagaagcgatcgacggtggcacaaattgtgaaacgactcactgacacggacgcaatgaagttgcttttcatcgtaattaaatatatgtattaaatgaaaggtacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccaggtattattctgttggtacgttgatggtatcgatctgtataaaggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggttatttctcgactatttttttatttatagtacaaatgaatgattaggtcgccggttcgatgaagctcgagcttgctcaataccgcgaagtggcagcctttgcccagttcggatccgacttggatgcctccacgcagcagttgttgaaccgaggagttcgtcttactgagctgctcaagcagggtcagtacgtgccgatggcgattgaggagcaagtggcggttatctacgccggcgtgaagggacatttggacaaaatcgacccgtctcaaatcacgcgcttcgagcgtgaattccttgcgcacattcgagcgcatgagcaggaattgctgaaggtattctaataaagtattcccagggaaatactctctctctttaggtcatccgagaagaaggccaactcacaaccgcgactgacgaaaaactcaagaatttggtgacttccttcttgggaggtttcaaggct

SEQ ID NO: 60431 - DNA, 478 bp, Heterodera glycines
  Genomic contig location: Contig_ID=SeqID_29963; Location=142..619; Strand=-
  SCN-specific regions: Sequence locations=1-42,64-202,224-406,429-478
atgctagagactatgaatattattaggtaaaattttaaaaatttgcgcccggaaggtgtgccgtgaatttttttggcatttttatgcatttgtaacagattttgcctaaaaatgccatttttggacatctttgtgcccaaatttttgcatcaattaacagaattgataatcttcggaagcagtgccgacgacaggcgccgccggagacataatttcaaatttagtgcttaaatgggttcataaaaaatatttatcctcatttaaaaattttcgtctccaatcccttcaaaaagccacaaaatgcggataaaatatcctcagaattcacagctttgctttaagcggtgttcgtatcacaacttaaatttcacagcctcccctccctgaacattaagctttcccacacaagcaaaagcagcttttcccaacatctgttcacacacatctctgtttactcatattattttttctaaataaa

SEQ ID NO: 60432 - DNA, 473 bp, Heterodera glycines
  Genomic contig location: Contig_ID=SeqID_29964; Location=747..1219; Strand=+
  SCN-specific regions: Sequence locations=1-141,176-230,252-290,323 -375,398-473
atgcgaaaaactttttgtgggcaaataattgaaggaaaaggtattgaaaatgcgacagaaaaagtaggaaaaatgtcaatagaattggccaaagaattggagaatgataaaactcttaaagaaaatatacaaaatgctttgaaaaataaaaaagataaatttatttttaaattttcaaatgcaattgaattgaccgatcaattaacaaataattatactcaagaatatttggaaaaactcaaaacaactttttatttagagcttgccggctttttaaagtcatccaaaggtaattatttttaaataataatttaatttataacagaattaaatacttcaatcagcgctctcaattgtcataattaaaaaattgtatgatttaaatttcagcttcaatagaaaatttgtgccaaaagcaacaaattgcgtttgctccacgacggcatcgacgtgcagatttcgccgacaaataa

SEQ ID NO: 60433 - DNA, 603 bp, Heterodera glycines
  Genomic contig location: Contig_ID=SeqID_29966; Location=554..1156; Strand=-
  SCN-specific regions: Sequence locations=1-83,105-194,219-238,269 -273,295-339,361-603
atgctcgccctaataataaataatacaccatattttctttacagctcggatttttggatcgaaatcagaaattcgatgaaaactttaagaaatttggaattttacttgaaagacaagaagccacgttttttacttctttttttgggtggaggaggggaaatgcaacaaattgatgaaaagcatcagtaagaacaatttgtattattattttttgttcataagtctttgcaatatgtttaataaattaatttggaaattaaatggtaattttttagcaatttgaaaattagccaatcattcaaatcttttcaaattcagatgtttttgcttgcaatagtaatgcttttaagtattatttgttcaaatggaatttacgaagttagacagaatgaaggcaatgatttatttggtgagttgcggcaaaatgctatcattggcggaatggaacaatttggaaacgaattcaaacacaacggaatatgcaaaggcataatgtcacgctcgtccttactcttctgattcaaaaacttgtttaggtttaaaaccaaattttgtctgttaattcacttttctcgtggttggctgaacattttctggaataaa

SEQ ID NO: 60434 - DNA, 878 bp, Heterodera glycines
  Genomic contig location: Contig_ID=SeqID_29967; Location=38..915; Strand=-
  SCN-specific regions: Sequence locations=1-878
  Gene Ontology: Mol. function=calcium ion binding; Cellular component =mitochondrion; Biological process=glucose catabolism
atgtacgattgggtgtccggaaagcgcattctgaagaactcttattacatcgacaaggaaaaggcgttggagcgatttccgatgctcaaaaaggaatcgttaaagggagcgcttatttattacgacggttcgctttcagtagaacattcatttctcgagttttttgtttcattggtaccaattaatcccctccaatttcaccccattttaggccaacacaatgacgcgcgcatgaacttggccatagtgttgtccgcaatacgaaacggtgccaaatgctgcaatcacgtggcggtggaacatttgctgaaggacgagaacggcaaattgtgcggtgctcaagtcaaaaacatggttctttcaattagccactttttcaaatctcccccccccccctccaacggtcagttgactggcgaattgtttcccatccgtgccaaatgcattgtgaatgccaccggtccattcaccgactccatccgtatgatggccgatccggacacggagccaatctgtcgtccgtccgccggcgtgcacattgtgttgcccggctattacagtcccgccaacacgggccttttggacccgtccaccaccgacggacgagtgattttctttctgtgcgtttttgtgttggaatgtcctcataaactgtcgtacatttttagtccatggcagagaatgacggtggccggcacgacggactcgccgtgcgacgtttcgttttctccgaagccgcgcaacagtgacattgagttcattctgggcgaaatccgtggctatttgaacaaagatatttcgggttggcagtgccaaaaaagccaaatttaaagtgaaaattcaatttcagtccgtcgcggagatgtgatgagtgcatg

SEQ ID NO: 60435 - DNA, 507 bp, Heterodera glycines
  Genomic contig location: Contig_ID=SeqID_29967; Location=1..507; Strand=+
  SCN-specific regions: Sequence locations=1-507
  Gene Ontology: Mol. function=calcium ion binding; Cellular component =mitochondrion; Biological process=glucose catabolism
tgaaaaaacaacaaattcctgatgacaattcacaaaccatgcactcatcacatctccgcgacggactgaaattgaattttcactttaaatttggcttttttggcactgccaacccgaaatatctttgttcaaatagccacggatttcgcccagaatgaactcaatgtcactgttgcgcggcttcggagaaaacgaaacgtcgcacggcgagtccgtcgtgccggccaccgtcattctctgccatggactaaaaatgtacgacagtttatgaggacattccaacacaaaaacgcacagaaagaaaatcactcgtccgtcggtggtggacgggtccaaaaggcccgtgttggcgggactgtaatagccgggcaacacaatgtgcacgccggcggacggacgacagattggctccgtgtccggatcggccatcatacggatggagtcggtgaatggaccggtggcattcacaatgcatttggcacggatgggaaacaattcgccagtcaa

SEQ ID NO: 60436 - DNA, 355 bp, Heterodera glycines
  Genomic contig location: Contig_ID=SeqID_29969; Location=36..390; Strand=-
  SCN-specific regions: Sequence locations=1-147,176-289,311-355
atgtctataactcaaaataaagttcatattcatgatcagcgacccaaattacgtaagaaaatatgttttttttaaattttagagcaaaaaaatgtgtccatgaaatttccaaaggggtatccctttgaattttggctccaaaatcagttttatttttataactttttttaaaaaagcgataaaaatatgaaataaattcctacttgtagagaaaaaaattgcggattttatcaatatttttttataccttagcactttgtttggagtgagttattaatttttatgtgaaaaattgaaatcttcaagtttttcaggaataacttttattgtttgcaagatagaaatcccaaataaa

SEQ ID NO: 60437 - DNA, 1916 bp, Heterodera glycines
  Genomic contig location: Contig_ID=SeqID_6121; Location=2308..4223; Strand=-
  SCN-specific regions: Sequence locations=1-90,134-658,689-801,830 -890,912-917,939-970,1013-1184,1281-1572,1594-1878,1900-1916
atgccacaatttattgaagcgcggaacttgcataggccacacacttttgaaagtcagcaaaatgagaagaattgggattatccattaaacatatttatttttagaaatatttttattttaaatttataaaattcctttgtttaaatagttgatgcaactgcggctggctcgggcaatttggaaattgtgatcaatggcgggcgagtcgcgtgccgcgtgcgtgagacaagcccaaggtgccgaaaaacccacaactaattagaatctattattttataatcattttttcaattaaacattttgttttaaggaattttttggccgaatttacgcccgtccacgagaccaaacacacagtggaaatgcggtgatttgattatttcttgccaacttaaaattgaatttcgcagtttcaacggcgaacacgtgcgcgactcgccctggcacatccaattttcgggggcagtcggtcctgcaagttcgcctgcactgtcatcggaccacgaagagcatgtggcacgcaatcttgcagcgttacgccggcatgaacagcgtgcagctgggggcgcgctgaacgggagagacggagtcgcggaggaatttgtcaacggaaatggcgaagacatgtgaggggaatattaattattggtcaatttagatttttaaattaattatttttaattttattgcttttctttttatttgtcattatcatagagtgcgggttttaagctttcaaaactttgaagcattgttttgatgggagaaacacaaaagcacatttttcaaacctgtttcgcgttttttttttaattttgattattaaatagcagtttaatcaattaccaatattataattttttgattttatcatattttgggaccttggcaattaaaatattttatttattccgcagttttcatttatttttcttttactggaaatttgagaaaaatggccatatcaaagttttaataaatatttgttcaaataaattttaattattttatagtttgtgcaaataaaatcttttcattaattactcgggcttccttttttaggcacaaaaaatcgcgaaataggcacctaaaaaggcataaaaaaatcgcaaaataggcattaaataggcacaaaaacaggcaaaaaattttttttattaacgcttttttggtattaagacaagtaaaattttaaatatttcaattgtaaatgaaattattaaataaggacaaaattttaaaccaaaaattctttttaagaaaaaaatatattaaattttgggatcattttttttgaaaattttttcaattcttaagggtgtattttctcaaatttttttcggtcatttcttaggggtgtgtttttcgtttttattgcatttttcttatggattttttcaaaaaccccaaaataggcactttatgcacaataaacccgatataggcaaaaataggcattataaaagtcatcgtagacaccccaaaccaagcggaaaacgcgtttttcttgcttatctacacgtattaaatgtgcaaaaattttaggcatttgcctaaaaaaggaagccctattaattaccaatattttttaataattgaaaactgttaattgctttattattattaattgttttcattttttagcatcactgagttggtcggccctggccttaaccgtgcggctgtcaatgaattggcccatttttccatccattcaaatcagcgtttgcggtgttaattttgttttattttacatttaatttttttgtttttcggtcctcaaatgttgtcgttcgaattgtcgaatgtgtctctggacgtcctgtggaagcacaaattgccgagcgcgggcccggcaccattcattgcgagtacactttgccaagggtgagagccaattgaattttagcaataaa

SEQ ID NO: 60438 - DNA, 67 bp, Heterodera glycines
  Genomic contig location: Contig_ID=SeqID_6122; Location=64..130; Strand=-
  SCN-specific regions: Sequence locations=1-67
atggcacgcattgtgccgcaggaagcggacgggacagtgcgcgttgaatggaagccaattgaagcgg

SEQ ID NO: 60439 - DNA, 941 bp, Heterodera glycines
  misc_feature (43)..(43): n is a, c, g, or t
  Genomic contig location: Contig_ID=SeqID_29973; Location=842..1782; Strand=-
  SCN-specific regions: Sequence locations=1-180,205-307,329-347,396 -432,535-540,566-566,589-614,660-669,730-838,883-887,910-941
cgccgttgtgacaatgtgtgtgatttgggcatcaactcattgnaaggcctatttcacttcactccattactttggccgtgccaaacgcttcttgggcatgagcgaagaattgcgcgaaattgtcacactgttaggagttttgaggagaaaaaagcatggaaaagttagggcaattttttgaaaatttcaaaaatttttaacccctaaaattttcactcagatcacctgggatgatgtgtgcaattttctggaaaatgagctctacaatcgtccatttgaaccacatgaattactgatgaaggtaaggcagagaaaaaatattaaaaatggaattttttttctggtgcaatacaattttaaatttaatttaattgaataaaaattattttaatttattatcgttaattaaaaattttttgtctacagtaacgcaaatttttataaatttattttaagttagaaataatattttaaaatttataaattaaagataatattttaaaatttattaaatgaaaataattttaattttatgatagctgattaaaaaatattttattcattagatcaattaatgtgtaaaaacaatattaaaaaaacttacaaaaattttatatttaattatttatttaatttttacttaaattttatttatttatattttttacctaataattaaaaaatatatttatttacctaataataaaaatttttaataagtttttttttgttaaagttacgatttattgacgagaacacactgagttctgcactgtccaccatgcgccacaacagtttccaatctgattttttgcgtgatgccgaatacttgcgcaggtaaaataattcattttaaaataaattaatatttaaattaattttgcccaatttattttaaaattaggcttcgtgcactccgtccagaccaacctgcctacctc

SEQ ID NO: 60440 - DNA, 453 bp, Heterodera glycines
  Genomic contig location: Contig_ID=SeqID_29974; Location=19..471; Strand=-
  SCN-specific regions: Sequence locations=1-118,141-166,227-453
atggtgtgtatacgacctaatctttttttcctcatcaaaaggttggtgttttgtctttggtgaatattcgattttattaaacaataactcgtccaacattttttattacgaaatttcggtcaaaaatatgaaaaagtaaatgcttttttgaatgttcaatgatcagaaatattaaaaaattattgttaattattattaattgtcattctttttttaattaatttttcgtttttcagttacattttcttcggattcaccgtcaaacggctgatgtatgaaagcatttctgcgtatgatagtgatggcttggctcggaataacggagaaattaaaaaaaatgccaaacattcctacggtgttggcgatactgttggaattggcgtcaattctgccactcggcagatctttttcaccaaaaatggaattcgtttgggttggcaaataaataaataa

SEQ ID NO: 60441 - DNA, 589 bp, Heterodera glycines
  Genomic contig location: Contig_ID=SeqID_29976; Location=647..1235; Strand=+
  SCN-specific regions: Sequence locations=1-248,270-389,452-454,477-589
atgaattcccagcagcgccaggcagaacgtgcccaacttcgcgcaagattgaacttgcttgtcgatgaggtagatattgtggtgcaagggctcatcaacaattatcaggccgatgggttgatcaatggggtaagttttctttattttttatgctgtttttgcttttttttgaattttaatcttgattgaacaggccccgcatgagggacagctgatgggcatggaccatggacaaggtctacagcatgagcagcagcagcagcagcagccatgggaactggatccaccaatgcctgcacagcaattggaaattgggccacagctcccggatgcgtgggaactggttccctaccagccgacaccacaatgggaccaagttgcacatgtggaacaacaaccgcagcagcagcaacactaccaccaccagcaacaacaacaacaacagcagcaaggcgcgtgggatgaggaatgggaggggccgctttcgccaaatgcgcttgctcaaatccaggacgaagcggacgggctgcgtcaggatttgagtaaggattttgggtcggggtccctccataaaacaaaaattaagtga

SEQ ID NO: 60442 - DNA, 1501 bp, Heterodera glycines
  Genomic contig location: Contig_ID=SeqID_29980; Location=183..1683; Strand=-
  SCN-specific regions: Sequence locations=1-102,124-126,165-516,585 -916,938-1144,1166-1268,1291-1375,1399-1501
  Gene Ontology: Mol. function=protein homooligomerization activity; Cellular component=cytoplasm; Biological process=intracellular signaling cascade
ttttgaaaagcaaaaaaaaaaagggtcatcggcggcctatcccccttcgcagaaatttttaccgaccccccccccccccttttttaatgtatgatgaaaaagaataaaatttttaggtgaaaaaagaataaaaattatttattacttttatctatttaaaaattgtgccaagaatgatgatgacactgatggcactttgtttcaggtgcttggcacggttgtgatccacgaggtgtacccggacggggcggccgcaatcgacgcgcgtctgaagcccggcgaccaagtgttggaggtgggcgccaaaagtgtttaaattttgaaatttaagctaaaaatattttgtaagtttaagtattttaaaaattgaaaaaagttgtgaattttttgtacaggtcaatggcacttcacttcgcggcacggcccacgaacaggccatttcactgctgcgccgaacgcccgccaaagtgcgactgctcatttacagaggcaaggcaaattgaaaaattaatttccatttaaataattaattatttcgatttatttttcttttaatttttttttgaaactttaatttaaataaagcaaacattttttaaaataaagaattcctttttgtgagataatacagcttttcagacgtcaatctgcagatgagcatgttggacccggcccaaatttacaacattttggccatcgaattgaccaaaaaaagtggcaaaggcctcggcgtttccatcgtcgggcgcaaaaatgagccgggcgtttacatttccgaaattgtgaagggcggcgtggcggacaacgacggacgactgatgcagggcgatcaggtgaaaaaagggaggctgatcgttgatcagagagggaggaaatgatcagaaaggatgaaggggagaagaagctgatcggagttggggagggagagaagaaaaaagcgactgatcaaggggacgctaatcagagaggagaactgtggaacgggagtagggtgattgggtcacagggacgaagctgatcaggcacagcgggagaggttagaactgatcaggagggaggaaaagaaatatatatttggaagatcaagactgatcgcaaaagacgaactggcagcggaagaaggcgggaggattatgaaaaattcggagggcggaggggcaggaaattatgaaaaattcgcagggcgggaggagggaaatctacggaaaattccaaatataattgctaaattaggatcattaggaaaataattttgggatttgtttaaatggagtttttcagattttggaagtgaatggccaaaacgtggccaactgtttgcaggaggacgtggccacccttttgaaggtgtcaaacatcccattcaaattgaaaagtttgtttgtttttctgttagacttgcactggtcgcgtggtgctcaaagttggccgttggaaattgaacgaaactgcgcaaaaggttcggtccgcgcagccgccgaatggcacaaatgccgtcgca

SEQ ID NO: 60443 - DNA, 1131 bp, Heterodera glycines
  Genomic contig location: Contig_ID=SeqID_6123; Location=351..1481; Strand=-
  SCN-specific regions: Sequence locations=1-8,33-51,73-213,235-243,274- 371,393-411,433-856,878-1131
  Gene Ontology: Mol. function=chaperone activity; Cellular component =nucleolus; Biological process=protein folding
atgttcgccttctccaccttctcctccctatcctggccattttcacctccaattttgctgctcttctctttgttgaccctccaaaattcgctgtccgtcgatgctttgttcggttggggcgacaagtcggaatccgcggaacagtcggacacctctctttcgataaacttggcattgaaccaccagcacagcagtgtctcacaatcggatgaggacgaaacgcaagaaaatgctgaacaacccgctgtacaacaacagcaacagcagcagcaatacggtagtggcggatacggcagctactccagcggtggttacggtagcgggagttggtcaaatagcgctgggacaggaacggcgtccgcctcaagctcggcacaacaacagcaatctgggtcccagccatcgaaggaaagtgacgatgacagtgaggagacaataccgtatggcgacgatatgatcactggtggcgatgctggtgctgatcaatcagttgatggtcaacagacggtgatcagttcgggttccgagatcatctactcttccaacatgaacacgagcgacgtcacaaattacgcatcggggtcctatgataacagttcaaataattatgactccagcagcaatggcacgggtggaaacaatgcaattccacagcaaccgttgatcagccccaactccggctccatttcttcatcaaagtcaaattacaattactcatccgtgtcatcatcggttcaaattgactattcctcgtcccaaaatgggggcggcggcacaaattatttggaggagcaacacaattcggactattcagcttcctccaattctaaccaaaatggagacaatgctgctgatcagcaaaatcaacaacaacagagccaagagtacactaattacctcaattccattcgcacggcgttgaaccaaacgaatgggcaaacgcagcagcgccaagcacgggctcgtctcgcggcatgtgtgcacgcgatcagcgtactgttgtggcaggggtacgatcaattgttgcaaaacaacggcacgagctgcagaaagaacggcgacactggaaatagtggtggtgaacaggcaaacgatggttcttcatcatgcacggtgaaatcaagaaattga

SEQ ID NO: 60444 - DNA, 1033 bp, Heterodera glycines
  Genomic contig location: Contig_ID=SeqID_6124; Location=535..1567; Strand=+
  SCN-specific regions: Sequence locations=1-520,543-897,950-1033
atgaaaattttatttgtgctctttttgtattttgccattttgacgatttttttccaccgcttttccgctgctaacgagacaaatgagcatatttcaacagcagttgatgctgatgcagaaattgagaagctgtcaaaaaagcacgtcacttttgccgatccgatcgaaactgaaatcaaaggacgtgtgacattggcggaactgatcaaaaaggaacgggacggggaaagcacagcactgatcagccaagagggaccatcagcagcagatgatgctgatcaactgatcaaaaaggatgaacggataagagagaaacaatggctaattaagggaagtgaaatggaaaatgcagcagaaaaaagggacgaaaaagcaattgctgaacaggtcgagaagactcataatagcctatcattaacacaggaggaatcagccgacctgctcaaaacagaacgtaagccaatgatcaatggaagtttagcagaaaatcccaaccccaataatggcacaatatttgctgatgtgattgaggaaatggaagcgaaaagggcacttaagcgcaacgcattagtaaaactgatcgaaatggagcaaaagggggtacatcagacggatccggcaccaatgccaaaagcggaggatggcattcgtgaatcatcaacaacagatgtagctgatcggattgtagaggagcagaagaaagcggcagatggaccgaaggcaccgatcgcaaagcaaacgctggccgaactgttagaaatggaaagaagcagtcaagaagaggcaatttgatcaattgttgatttgaagtgatttgatcatctttttcttctattgtaattcttgttgaaataatcccgaaagttctttttctcgaccatgccccatcaaaaaaggatattattgatttatactaaaactaaaaatttatttttttgtaaaaaaatttcgcaaaacttctacttgaattttaaaaatgcgctgcgaaaaattgtccgaaaggcaaaaaaaggtcgcaaatttctgactttca

SEQ ID NO: 60445 - DNA, 2175 bp, Heterodera glycines
  Genomic contig location: Contig_ID=SeqID_6125; Location=342..2516; Strand=-
  SCN-specific regions: Sequence locations=1-335,357-466,488-639,669 -732,755-866,888-1337,1359-1534,1566-1624,1650-2175
atggcttcttcggctgatgcttttccgaacggcgccgttgccattgaatgtgagctgcaacttttggcaaaacaaattgacgaaacgctgactacggcacagcaaaaggaggcgacgacggcaaaagtgcgttttgtgagcagagacattttttactggatttaattttcatatttagcagaaaattaaaatatttttcatattctcagttgaatgggtcaggtaggaccaggccgggagttcctgcctttatgaggtcccagcaaatacataagcgattttttgaagtgacatttaattaccactaatttgacagtttaaaaaaataattaacatgtttttctattttaaaaatagactaagatccacaaattttggtgcaaaatctgttaaaaactattcaaaatcccaaattcttctccgattgcgactgtcagctccgcctgacctcttccttccgctgattttttcttaaatgactcaaaatctgcaaaattttattagaatttaatattccctttattatttcttagaagattttcctgaataaaacagatttaattaaagtaatactttttgatccctctaaaattttcaaatttgggtcgaatgttcggtaatacgccgatttcttgttccattttttaaaaaaaatctttaaattttttgaaaaagtaaaattcaaaaagtttcccccaatttccttcatttgtcagctgattgctgcttctccctcgtcttcctcttcttctgatggcttctcccattgttccgctgtttccgtgccaaactttgcgcaaattgtgcagtccattggcaacacaatgaaagtgcaaaacgaactttgcttcaaattgttacaaattggaagagatttggtgaagagcagcgaggaattggcacaacgaaatgacaaattggagaaggaaaacggcaaaatgaaggccatgaaacagtcgttggacgaatcacaggcagcatttcaaaaaaaaaaaaatcattttggaaaattaggattgatcctgggcagacaccgatcttcgcttcccatgttttcgtcgaaaattcaaaaaagtccaattgtgtcccggtgggaccggcactaaaacagaaagtggcaaaaatggggtctgattttgagtctcttgaatcactgatttatcattttataattactcgccccgaccacaggaaaagcataaaaatggaacttcgtcttccttttctgtgctcctcaatttcgtctaataaacaaaaagggcttaaattttttaccttaaaatgattggcgtaaataaaacatcacctaatttaaccaaaggaaacgttcattcattttcaggacaatgttcttctgttgcggcaaaagtgccaaaaattggagcaaaatttggcggaatgtaaagaatttttgaaccgaatggcaatggaagacgatttccgaaccaacaccaacaggacaataattgttgtggaagataaggaaaatgtgccagaagttgtgcaaaaaggtggggaggggaagagaaaatcgaattattaaataaaaataaatattttaaaaagtgccaattattagtgtcggtcaaaatcttttctcctaatttggttctttttaatcggaatatttttaaaaatgggcaaatttttcgaaaattttaagcaatttcttaacaaaatagcattaaaatttccaaaaaaaaattttccggcggcgtctaacggcaccccatagacccccagtttacgatattttttgaaaatttgaacccaattgaccaaaattagtcattttttgccgaaaacggctacaaattcctgctgcttttttgtctccgatgctgaggattttaaaaaacacggataaaaattatcttttttttatttcactaaattttgtccgttccataaatctatctaatttttggccttggatttgtggttggcttcatcccctgctattttcttttcgttctgtggcaattttcatcataaaaatcgctgtcattttaccaattttcagctgctgaccaaacggacggaaacaatgcgtcggacattatttttgtggacgacgttatccgaaacaaatgggtggccaaaattggacaaaaaagtgtcaaaaatgagccgactgaagtggtggagttggacgaccagccgagcgaggcggaa

SEQ ID NO: 60446 - DNA, 491 bp, Heterodera glycines
  Genomic contig location: Contig_ID=SeqID_6126; Location=57..547; Strand=-
  SCN-specific regions: Sequence locations=1-157,211-351,378-491
atgagacttgactccgacgaatcggacatcgcttggtttttgggaagtgtcattcatttgttggctttccaaacttatccgcttgaggaatggcacagtcggaacaaaacattggctgaccaatgccaattggacggcactttcaaaatgccgcaggttttatttaatattttatttaatgtttaattttattaattttgaatatttattcagacttccaatcattttgtatgtttctgctccaaaacagcgtcaacaaaatgctattttctgctgaaaagctccaaattcgtactgattttcctcatggtttcgagaaagagtacgccattcttggccaaataatgatggtattattattaattaattaattaattcaaaaactaaaattctttcgttttaattcatttttagaatgctctccacgccgattcggaaaagagaactttttgacggaaatggacaattgctgaaattggctgccaattaaa

SEQ ID NO: 60447 - DNA, 285 bp, Heterodera glycines
  Genomic contig location: Contig_ID=SeqID_29982; Location=617..901; Strand=-
  SCN-specific regions: Sequence locations=1-93,272-285
atggcagaagagaggcgggaaaaagtggagggacagagaggaaaacccagaggagaaaacggagaaaaagaaaatgaaaaagatgaaatggaaaaagaaaaaagagaaaaggaaatggaagaaggaaaaagagagggaggagaaggaaaaggaaaaggaagagaaatggaaatggaagaaggaaaaagagaaacggaggaagaaagaaaagaaaaagaaataagagaagaaatggaagaaggaaaaagagatggcgaagaaagagaagaaatctttgttttctaa

SEQ ID NO: 60448 - DNA, 712 bp, Heterodera glycines
  Genomic contig location: Contig_ID=SeqID_29985; Location=687..1398; Strand=-
  SCN-specific regions: Sequence locations=1-135,157-712
atgcttcacaaggcgactcggatggttgtgctcgaatactttgagagtttcttcggacaatgggacaaaaagcaggcgcagccgtggatggacgaatacgaagtgcgaagtgtgcgcagacaggcggagaaaataaaggcgggcaaagccgggggcacggtcgagctgatagcggcggcgaaaaagttcaacatgaacgtgctggtctacaagacggacaaggacatgtggctgtgcatgtcgccaaagacggcgcacaaatgggacttggacaaggtgggcaattagtgacggatcgggacattggataaggtgacaaatgggggtataggataagataggcaattagtgacaaatgggggtattggcaggtaattattgacaaatggtgagctcaccgaacaattagctaattgggtcattagtggaaattcggcaatttagaactgccaaagcaaggatgcgatgaccattgcgttggaattgtacgacaacgaaaattacgacgtgattatggacgtgcaacaaaagaagtgaacggagaggcggacggacggtcaactcaaaaggaagaatgaaatgagaaaatgagtgaagattttgttcgtagtgattaggggcttaatgatcgtcggatgatacaaatcactttataagcaaatgtaaagtaatcatcgaaaatcattcggcagccgtattcccaccaaataaa

SEQ ID NO: 60449 - DNA, 877 bp, Heterodera glycines
  Genomic contig location: Contig_ID=SeqID_29986; Location=412..1288; Strand=+
  SCN-specific regions: Sequence locations=1-597,621-770,792-877
atgaatttgtgtggtgagtggtggatgtggtaagacgagagttggtaatgtatgatacgagtcacgagcactacgggaacagacacgccagcgcacattttcgaaccgcgatttggcaacggttgtgcaaagagttggactacccaaggtgaaaagagtgttttatggaagcggggaaatggataaaaatgaaaggaatttaaacggagggactgaaatggtcgaaaaaagtggtccaaagcgacggaaggggtcaaatgcgtcccaaggaatttttaaagggcattcttttttctcatatggccaaattttacaattttggcagcatttgaaagagcctacacatttaaaagctgttgaaaagttatttttctaagcgaaaagctactacatgaatgctgcaaaagtcaggattattgcatatttttatttatacttttttacatatcggcgagtttttctgattttttgaaatcaaatagagattgctaaaggcttttgaatgatgctaaatatgtaaaatttggtattctgtggagcaagttgcgacctattaaacttgtctgggatgttgttggcaggttccgaaaaacgattggaagggaatttgggtgcaaaaatgtgacggaattgggggactaaaaacagtgccattttcagatgatccgcaggcactgcaaaagcaatggaaaagcattagggacaaatacatcaaagagaagaagcggagaaaagggggcacaacaacaatgatggtaagcatttgagaggtttttaaattttgtagaaattttactgacattttcaggaccattccgaatcgacgacaaatggcacacgaaatttcaacggtaaaatggacaaaaaatattcttaa

SEQ ID NO: 60450 - DNA, 56 bp, Heterodera glycines; identical to SEQ ID NO: 52733
  Genomic contig location: Contig_ID=SeqID_29988; Location=583..638; Strand=+
  SCN-specific regions: Sequence locations=1-56

SEQ ID NO: 60451 - DNA, 111 bp, Heterodera glycines
  Genomic contig location: Contig_ID=SeqID_29990; Location=187..297; Strand=-
  SCN-specific regions: Sequence locations=1-111
atgagcgacagttcaattcggagacttagcattctgagcattttgccaactgatatgagtcgtagccaccaccacaaaggcgcgaaaatggatggaagaattgtggttttg

SEQ ID NO: 60452 - DNA, 651 bp, Heterodera glycines
  Genomic contig location: Contig_ID=SeqID_29991; Location=313..963; Strand=-
  SCN-specific regions: Sequence locations=1-205,275-562,587-651
atggctacgcccttggttggtgggtggttcgtgaacgcacagcaaaagaaggtggttactggttacctaaccccatgtaaccatggtaaagcgcctgtcctgcccctccctccctacccatggtagcagtcgtaaccaccaacctttaaaaatctgccaaaaaaaaccaatgtaaagttttaatcgaattaaatgccgaaatatcttaaataataataaaaaaatttacaaaaaattaatccgtaaataataataattattatttttatttattctaccaattttctaggtactttaaacattattttgcccatttattaaaaaaatcagtgcaaattttactaagttcatggtagcgtagttggtgataaagtaaaagaagatggttggcggttaaaaaaaggtggttgctggttggttgctccagctgaaaatttaccatcttcttttgctaccgtttttctcatggttggtggttatttgaccgggttaaataccatggttaaataataatgacctggtcaaataaccatcttcttttactacggcccccgggggggggggacggacggacggatggacggacacccaactcgtactgtttttcgacaaaaaatcgtcataactcttgacaaagtcaaccaaattaaa

SEQ ID NO: 60453 - DNA, 1122 bp, Heterodera glycines
  Genomic contig location: Contig_ID=SeqID_6129; Location=771..1892; Strand=+
  SCN-specific regions: Sequence locations=1-814,836-1020,1049 -1094,1116-1122
atggttattaagtcggggatgggttggaaaaaaatgcatttcgagcgaaaattcacaccgcatttctgcacggctgttggtttcacctgtcacgtgctcattggcggtcagttgtgtcacgttttaatgacctggcagaaaggttcattcagcggtttggagacactcaacagcaccaggattttcttgaaaacacttggatggttgtcagcgtcgcactccgtcatttttgctcgatttttggaattgcaaagacattactgaactccatttgccgaaggacaacaaatggcgtggaaagctggcatgcccgactgcagaagacttttgcctctccacatctcacctttttcacttttatagaagatttaatcttttaatttcgaaatgattttgcaaaaactttttattttaaaggattactgaacgaaaatgttcgagcaaatgcaatttgcgttaaattggaaagtggtgaatctattccattgtatacgcgcattgagtatcgtcaggcaaatgatcgtctgctcaacattttgcgccgttacaacgaatatttgccggacgattacaatttaattattgtacgaaacgccaaattgaaactttgtacgaaactccattgtacgaactgcccattgtacgaactgaatattgtacgaactgcctattgtacgaacagcattgtacgaactgcctttgtacgaactgcaaattgtacgactgcctattgtacgaacagcattgtacgaactgcctttgtacgaactgcccaatgtacgaactgccatgaccccgaatttaagacggctagttttaatttattttatgactaattttacaagtttttttaaattaattggtttatgcgttttaagaatctgattactaaatgttagaaatataaaatactctgttttatagtatttccattattataagccatattaaatttcatattcggcatgatgaaatattcgattttagtgtatgtttttagagagtaagaaacatgttttctaaatttatcattttttaaaattaatttctcttgagaccgtgccatcatcttgcagatttttcctgtgcattttataattcataatatatctaatgaaaata

SEQ ID NO: 60454 - DNA, 102 bp, Heterodera glycines
  Genomic contig location: Contig_ID=SeqID_29992; Location=356..457; Strand=-
  SCN-specific regions: Sequence locations=1-102
atgtcgaagatgggccgaatggaatcggacacggacccaaatacggtgacaattctgaggaagcaccaagcgccccagcgtgtacttaagtcggacgcggct

SEQ ID NO: 60455 - DNA, 288 bp, Heterodera glycines
  Genomic contig location: Contig_ID=SeqID_29997; Location=506..793; Strand=+
  SCN-specific regions: Sequence locations=1-288
  Gene Ontology: Mol. function=long-chain-fatty-acid-CoA-ligase activity; Cellular component=lipid particle; Biological process =lipid transport
attaccatcgaaggtgacccagttccgggccatgttggtgtgccggttccatgctgtgccgtcaagttgattgatgtgcccgaactcaactattttgccaaggatggtgcgggcgaagtgtgcatcaaggggcccaacgtatttcgtggctactacaaaatggctgaacaaacggcggaaacgctggacatcgacgggtggctgcacacgggtgacattggacgatggacagaacagggaacgctcaaaattgtggaccgcaagaagcacatcttcaagttagcccag

SEQ ID NO: 60456 - DNA, 792 bp, Heterodera glycines
  Genomic contig location: Contig_ID=SeqID_29998; Location=338..1129; Strand=-
  SCN-specific regions: Sequence locations=1-139,163-224,249-336,606 -638,660-792
  Gene Ontology: Mol. function=poly(A) binding; Cellular component =nucleoplasm; Biological process=regulation of transcription from Pol II promoter
atggctcaatcctttggtgatattggccaatttggcattaattatgctaatgatggcactgtgctgcgcaatattccgatcattaccaccgtttcattggacggaattccgaagataaatggcattatacaacgccgacaagaggatgaaggagaggaggaacaccaactgtcaatcgacgaatccctgcagatggtggaaagcacattcatcctggaagatgcggaggaagaggaggaggaggaggaaataccggacatcgatgtggaagtggaggaggaagtgatgctgacgaagctgtacaaaggggcaccgaatgccgaaattgagacgattgaggaggaggaagagcccatggatgaggaagagagtgggagagaaagggagaaggaagagcggtggaagagagtgggaatggaggaagagcagagggatggacgagaaacagagagggtggaggacggagaggggaaggaagagaaacggagatggaatagagagataacggacgaaaaggtggaagagagatggaagagactggggatggaggaggagcagagggatggacgagaaacggagagagagagaggggaggaggaagaggaagaaagagaaatcggagttggcattgaattggtgaaggagaaggaagaaagcgccgaagttctgctggatgttactgaaggaacagcacaaaagcagcagcaacgaattgtgttgattgtgccggacaaccaaatgccaaagcagccagtggcgatgcctttgccggaggaaaatgcgtccaaaacg

SEQ ID NO: 60457 - DNA, 693 bp, Heterodera glycines
  Genomic contig location: Contig_ID=SeqID_29999; Location=51..743; Strand=+
  SCN-specific regions: Sequence locations=1-67,100-281,303-693
atgttgaatgtggttgagggtcagactgaagaagagccaacctatgaaattaaacaggtaaaatcccatatattttattatttaaaacatttttaaattcagttggaagtgaattgtggctcagttgccggcacaagtttggaccgacgcgcggcacagctgaaccatgtgatgctgaagaaggtcggatttcatgcggcaccagaagatttgccagagaattggcccgacagagcgcaaattgagtcaataaaaatggcatggtgagaggaagcatgaagaatagttaattatataaaataattagctaatttgacataaagagcgaatttttgggattatgacagtatctctcattcagggaagcatacgataaccctgacgcgattgtgctgcttacgatgtcgccgggttcgcagaccgcgttcgatgcgcgcttttttgagactgagttggaccgactctctgatgggcgcatcaaaatggtgcgcagttccatgggcgattgtgcgaggaggtggggaatgcaattaaaatatattgctaattaattaaaatggctaattgccaaagactatggatcccgcaatgggtcagcaaatttggtttttgtgcggcacccggccagagacccgcaatatgttttttttaaattgcagaaaagagatacctaatgccaaattttcaattaca

SEQ ID NO: 60458 - DNA, 387 bp, Heterodera glycines
  Genomic contig location: Contig_ID=SeqID_30001; Location=254..640; Strand=-
  SCN-specific regions: Sequence locations=1-2,24-158,180-387
atgttgcccaatttcctttcgctttgctccgtttttgcggtttttctgctgcttttcaccgcacaattccctccaaaagtgcggggaatgatttgtggagcaaaagcattaaaataccaaaggatggaaggtaattagtgctaacgcaatacgtaatgatttattattatagaaaaacaatcgctcaaaaatttattagattattttttggattttttcagggttttccctgacctcatctccccgatggcgtctttcccgacccaaatccatgagcactgatacattgaaatctcctaagattttcacccccgaaaggtccgagagcaacctttgactttattgttcgtcgttgtttaagtgccgaaagatttatgccccattaaa

SEQ ID NO: 60459 - DNA, 1123 bp, Heterodera glycines
  Genomic contig location: Contig_ID=SeqID_6131; Location=397..1519; Strand=+
  SCN-specific regions: Sequence locations=1-291,313-330,352-416,440 -783,805-811,833-856,890-1092
atggcattggtgaagaatggcacagtacgaataccatttttaatgaaaacccggtaatttttggtgaaagcccggaaactttcatctgtcgttagaaaagacaaaataagcataagttgtttattttgcatttttaattagttaaacactcatcaaaataaaaacaaaaacaaaaaacggaagtcatataaaaataatgttggccggaaacaataaaacatttgttggcatttgttttcacatgttttttttctattatataaggacaaatttttttatttcttttatagataaaatatacagaataaaattcccaataattctcaagagaatgtttggtaaacacagtaagcaattattgttcggtatgcttaccgtaatggttactgtaatgctcaatgtaagctcaatgaataatgacgatgataacaacaacaactatcatccttattactactacaataattatggttatggtaacgacagtaattttcctggaaataataattggtataacgcaaacgcatacactgataactggtatagcgtaaatgatggtgatgatgacacgagtggttacggtagtactacaagtggaaactacggttttgagacgaacagttacagtagcagtacactgggtggcaattacgattacggtaacagtagtgagtcatcatcagcaccagcgttgacaaaaaagaaaaaagaattgcagcaaatattcagaggaaacgttcaaatccgagaaactgacagtgatggtttagtgagttatcggccggccaaaaagaacgaagtggtaatcaaatttaataaataaataatgcaaaatataaaaggtttcaaattcagcttaaattatactaatattttattttaaaaaattcaaaatgcatataattttttcttttagtgttttgaagtttattgcggcactagtaatccaactgacggcatttttactgatcactatggcaattttgaagaaactttgcataaggaacaaattaaagcgctgaaaaaaatgcaaatttggaattaatattggattctacaaacaagaagtacttaagtgcgaagtgtcaaagcaaaaaatttaaaaataattataaaattaaaa

SEQ ID NO: 60460 - DNA, 659 bp, Heterodera glycines
  Genomic contig location: Contig_ID=SeqID_6132; Location=688..1346; Strand=+
  SCN-specific regions: Sequence locations=1-251,276-379,402-431,453-659
atgggggctcagtccgcatcattggcctacggaaacggcactttgttcgctgcacttggaggtttgtgtcccgggtttgcgagcctccatccgtccagactgatccggccagagctggctggatcagccccgtgcgctatttgcccggcgcacccatccgtcgactttccccatttttaccccaagggaaatgtgtcagtcctcctcgggcacacgccacccctcaggggtggtgtggcgtgcggatttgtattgggttgattgtttgtttgtttagcgtgtgtgtggttgctgtttagcggggacccccggcagtgcaactgaccgtgcgtacggcctccgcccgctccgtcatttccttcactcgtctaccccgagcggtggcccatcactgaccaaaactgagcccacgagtgcgtccgcttgctcattcttcttttatatgatgaaagcaattagtgaaatattttttggatgggttcatatggaagagagagatttatagtgacaaatagacactctcgcactgctactcttgtttcttttccgttctctgctatttgttcactatctatacagcccgctctgctacaattcattaattagtaagcaaaaacgaggtacccaattttgattggcaataggaagaaatttatcaa

SEQ ID NO: 60461 - DNA, 1213 bp, Heterodera glycines
  Genomic contig location: Contig_ID=SeqID_30002; Location=386..1598; Strand=-
  SCN-specific regions: Sequence locations=1-1033,1055-1213
atggttccattgttgaatgaggcgcggaaaacaaacagttcgatcaagcgcagggatgtggaagaatatttggctgaacagcccagctacactatgcatcgtcaagctattagacggttcaaacgtttgcctacgcttgcttcgggtctacataccgattggcaagccgatcttgcagtttttgaccgtttagccccgcaaaataaggggttccgttatttgttggtttgtgttgatactctgagtagacagttgtttgttgagccagtaaaaagtaaaaaaagtgaggacatggttcatgcatttgataggctgtttgcccattccaaatatattccatggaagttggtaacggaccaaggcctcgagttcaccgccaaacgcatgcaaacatatttcgattcaaagaatgtcaagcatttttgcatgtacacgtccccacaatttcatgctggtatagcagaaagagcaaatcgaacaattaaggaacgattatttcgttattttacggcgcgtcaaacccaacgatggttggatgtcatccaggatattgtgaatggaattaaccattcatacaattcatcaattcaaatgcgcccagttgacgttacatttcggaatgcggacacgctaagagagaaattagccaatgaggcagctatgagtagaccaaaacgtctgcctcgtttccatgtaggggatctggttcgcattgaaaaacataaacatgtgttccagaagggttatgttggccgttttacgagcgaaatattcaaggttgacagtgcggatgaaggccgttcacctgtcacataccgaatcagagatgcggataatgaactgatcaaaggtcgtttttatgcttcggatctatgtcgcgtccgcaaaaacacccaccaggatggtgaaaaattatatgacattgagaaagtgttgaggaaaaagaaaaaggatggtgtagagtatgcatatgtgaagtggaaaggttataacaaacagcataacagctggattccaatcagttcaatcacccataaaaatatataaatatatagggaaaaatgataaaacaaaaaaatgtccaccatttcgtcaaattctttttatgttgttgttccctcgaacacgaacgttgaagggaaccggacgaactctttccgtgtgcgactaccacgaaaaatacaatttaattcggaatgggatgtgggcctag

SEQ ID NO: 60462 - DNA, 181 bp, Heterodera glycines; identical to SEQ ID NO: 52969
  Genomic contig location: Contig_ID=SeqID_30007; Location=705..885; Strand=-
  SCN-specific regions: Sequence locations=1-3,27-181

SEQ ID NO: 60463 - DNA, 669 bp, Heterodera glycines
  Genomic contig location: Contig_ID=SeqID_30008; Location=80..748; Strand=+
  SCN-specific regions: Sequence locations=1-243,278-372,395-669
atgcggctgatgtccatccgagaggctgtcgagtctggcttgttcgacgtgaccagcggcgagctgatcaacccaatttccggtcggcattatcccgtgcagcgtgctgtgcaaatgcgactagtacaaacaacgccggaacgtgcacaacagttggaggacgcgttggcccaagcgcaacaacaacatgcgcacattgtgcagccgctgcagaaacggccaagcggtcaattctcgccgagcagcattagcttgggtagcggtggcggcggcggtgtgatcgccggtccagcaggcggtgccgagcacggctacagtagttactcccagcggcgctcgtcctacggtgttggcgacgggtatccatcataagcatttcatttagtttacttttctcgctggcactcaaattttagcgattggggagccgaatctcgaagccttttatacagtagccatggtgttagactaaggtagtggcaattaccgtcctttccagtatgattactgtagcggtcttgacttccatttcgaattgagtggcagcgagtaggaacaaaaaatcaaccaatccaaggataatcaatttgactcataacttaacaaagcagcgaattgatgtgtttttttacagtaattaccgtaaaaaatcatacaccgtaatcaaaa

SEQ ID NO: 60464 - DNA, 616 bp, Heterodera glycines
  Genomic contig location: Contig_ID=SeqID_30010; Location=686..1301; Strand=-
  SCN-specific regions: Sequence locations=1-181,203-616
atgtattttgggagtggaggtgacccggaattgaaaaagtgcgtaatttgtggcaatttggtacaattggccgacaaaatgatgatcgacagggtcacatgtaattattacttatttggtcaaaatttaaaaacttgtccaatgttattgaaaatggttaaaagagaaatttggatgaaattaaagtttcttgtgaaaaattaaatatttctctttgaagcgaccgcttaatttcaaaaacatttatttcatttcactttttttatctccaaaatgccctacattgaaatactgtaaataattctgcttttttacaaaatcatttcagtgcacaacaaatgcttcaattgtggctactgtggcaacccgttgaagccgggcgaatgtgccatggaagtgcactcattcggccgccggtggtactgctcgggcccggccggcagctgcgcaatgcttccaacggcacaaaaggaagcgcgacgcaaaacgcaagcagcgaaacagtgaaaggagaggcatttttcgagtttggtccaattttgaacccgatttgaacccgaaatgccaatgtattatggcaattaattgacttaattgttatgagaagcaaaataaa

SEQ ID NO: 60465 - DNA, 470 bp, Heterodera glycines
  Genomic contig location: Contig_ID=SeqID_30011; Location=262..731; Strand=-
  SCN-specific regions: Sequence locations=1-47,80-149,205-247,270 -332,362-470
atgaaaaggaaggaatttattcagcgaagtgatgagcttaaaagaatgttcgaaattggaaaacagaaacaatttgtgaaagagttgggcattggtaaagaaatgtttagaaaattgaaaagggaatttggcattgaaatgagaaaaagtaaatttgaataaataaataaattattgtttatttgttttaatttttaatatttaggtggaaatcgcttttcgaatgaagaaaaaatgagtaaaatgacaatttattatcaaatgaaaaaagcgaatccttctttgcttgataaagaaattgctgaattattggaaatctctgaacgcactctcagaaattggaaaaacaaaaatcaaaatttgtgatttgtgtcaacgaagcagatcatttcacatctggcttccctagaaacgttttgatgattttctttattttttttattatttgggtttttattttgctaaataaa

SEQ ID NO: 60466 - DNA, 414 bp, Heterodera glycines
  Genomic contig location: Contig_ID=SeqID_6133; Location=711..1124; Strand=+
  SCN-specific regions: Sequence locations=1-414
atgctggcggatcaacaaaaaatggtgcaggaccaatcacagcaaattgctcaattgattgcgatccgacaaaacgcaccaaatgcggcggcacagcccaatcaaggagcaaattcagtgccaatattgccggacatttcaccattcgagccaacggacgacaagagccgaatttcggaatggattgagcgattcaaattcgcgttggattgcacagcaccaacggcggacgacgaagtcaaggttaaatgcctgatgaataagctgagcgaatcggcattcagtgaatacagcagatcagttctgccgtcgtctgttacagatttcagttttaaagtgacgaccgaaaagcttgagaagctatttgccaaggctcagtccatattcatcgaccgctacgagtgtttaaaagcg

SEQ ID NO: 60467 - DNA, 2992 bp, Heterodera glycines
  Genomic contig location: Contig_ID=SeqID_6134; Location=401..3392; Strand=+
  SCN-specific regions: Sequence locations=1-440,463-915,937-1604,1626 -2602,2624-2992
ctaaaaacagcggttctgttcaacaagaagccagttgaattccatctcgacacggggtcggacattgtcgtcattgatcaattaacgcacgaatatgttggacgaccaccgatcgaaaaatgcaacgaaattggcaaggctttcgacggcacaaaaatttcctttattggaaaaggattcggtacattcaaatttggtaaaattgaagtggagcaaacattttttgttgccaaagcaggctcactaaatttgttgagctgcaaaatgatggacttatttgggcttttagacgaattaaagctgaagatcagcaatcctgcagtaaatgcatgccacgcgaatggcaaaaaggctgaaaatttaatcccgaatgaagcaacgcagattgctgggacagaagtcgaaattcaaggcctggaaaaggcatttcacgaaattttcagtgaggaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaacaaagtcgaacatttggagtgggccgcacctattttgattgttaaaaaggctgacggatccgcccgactttgcattgattactctacgggcctaaacgatgcccttctcgactgccaatacccacttccaataccggaagacatttttgcgacgctaaatggaggcaaaattttctcacaaattgatttgcgagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccaccgcctatttggacgacattataatcgtcagcaaaagcattccggaacacaccaatcacttaaaagaagtttttggtcgaattcaggcatacggattccgcgtcaaattggcgaaatgcaaatttttccgtgatcaaatcaaatatctcggacagattatcgataaaaacggacgccgaccggatccagcaaaaatctatgcaattagtcaaatgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcgtttcgaaaaattaaggaaattttggcatcagatttgctgctaacacattacgatccaaaaatggagatcattgttgcagctgacgcttccgaattgggcatcggagcggtcatttatcacaaatttcaggacggaaacatcaaagcaattgcccatgcttcaaaatcactcgcccctgcggaaaaaaattattcgcagattgaaaaagagggcttggcgttaatttttgcagtacaaaaattccataaaatgatttatggacggcatttcactctgcaaactgaccataaaccccttgtcagtatttttggcagcaaaaagggaattcggcagtgcagtgccaatcgtcttcttcgctggtccttaatccttttggcctacgattttacgatcgaatacatcaacacaaaggattttggcccagccgatgcgctctcgcgcctaatcgccaaaggaaatgagaccgaagacgagaaaatcatcgccatgatcaatgccgaaacggattttgaaacaaattttggccaaacaatttcaaaattgccattaaaattttcggacctagtcgctgcttctgagcgcgatgaaaatattattcaagtccaaaaatttgtcaaaaaatggctggccaaatgaaaaggccatggacaaagaaaatcaaattgtccgtgatttatgtcgaagaaaggaagaactttcaaccgaaaagggatgccttatgtatggagaaagagtggtaatcccgaaagtcttccactccaaaattctaaaattgctgcacaaaggacatcccggaatgaagaggatgaagcagctggcacgccaatatgtgttctggccaaaaatcgatcaggacattgaagattttgtccgtgaatgtgtgccatgtcaggctgctgcaaaagcgccaattaagacaaatttacagtcatggccaaaaacatcaggcccgtggcaacgcgtgcacctggattttgccggaccgtttttcgggaagcactttctgattgtggtcgactctttttcgaaataccccgaggtattcgaaatgtcaacaatttcaacggcaatgacaattgaaaagctaagatatttggcttcacggcacggaattccagaaacattggtttctgacaacggcacacaattcaagagcacggaattcgccaaatttacagcggccaatggaatcaaccatttattctcggctccatataatcccatgtccaatggacaagcggagagatttgttgacacgtttaaacgtgccttcagaaaattaaaaggggagggaatgtcatcagtgaaagaaataattgagacatttttggtcacatatcggaccacccccaatgattcgttgccggactcgaaaagtccagccgaaatgctcctgggacggaagccacgaacaactttggacctgctgaagccgcctccaattcagccgatcgaacgtgatcaggcaatggagaagaaattcaatcgccgatttggcacgcgtcctcaaattttcgcttcaaaggacgcagtttgggcccgacatcgcctttcacaaaattggaaagccggaacgatctgtgggtgttccggtgtcatttacaatgtccgatttgaagatggatccagcggtcgctatcatgcgaatcagctgaggttccgaaag

SEQ ID NO: 60468 - DNA, 602 bp, Heterodera glycines
  Genomic contig location: Contig_ID=SeqID_30014; Location=159..760; Strand=+
  SCN-specific regions: Sequence locations=1-301,323-340,362-406,453 -507,529-575,598-602
atgaaatcaggcgccgcattggcgcctctacttgcccggcatccgttgggtataaaaatttttttaataagaaatgtttcttcgtaaattaatttgttcaatacagtatgccataggttattttcaaaccaagttcggttcgcttacaagtaaatgttttttgccagtaaatatttttggctcttttttttgttttggtatattaatgaaagcgattatagttatttttgaaaaaaatctcatcaaaatcccacttatattaagttgttttttttttgaaattattgcttgttttaatctctttttctccatttgaaattttacaaataaaatcaagaatttctcttcaaataattcaaaattaccttttttgatggaaaatataaaaaaaattcgcttcaatttctttttttttgaaaatataattaaagaatttttcaaattttttatttcatgaataaatcagttgaaatgaacaatttataatttcaaaagaattttctcatcttataattattaaatttattaccagaaaatttgagaaatttgaataaaataatcgctcaattaacattgtgtgagctaaaataatttttaattta

SEQ ID NO: 60469 - DNA, 695 bp, Heterodera glycines
  Genomic contig location: Contig_ID=SeqID_30015; Location=787..1481; Strand=+
  SCN-specific regions: Sequence locations=1-239,261-695
  Gene Ontology: Cellular component=nucleus; Biological process=protein biosynthesis
cctcaaaacgagcatattgaactacacagaaaacgccatgggcgaaaattggatcacgaagagcgcacgtgagtaaattatgcaaataacttaatttgattattcatttttatactattccttttgatttaatcaggcgaaagaaactggccagagctgttcatgaccgttcaaaagtggccaagaaattgcggaaagggaaggcgaagttgtaccacaagaagagatatgcggagaaggttgcttcttgtcttactttaaaactaaagaaaaagttaaggtccaaatgcgaaaattgatcaaacaacacgaggagaagaagcaaaaggggacgacggacactcaaacggagggagcagtccccgcctatttgttggaccggcaaaaggaaacggcggggaaggcactttcgactgccatcaaacagaaacggaaggaaaaagcggtaaggaaataggcaaatgctcattggcatttctatcatttacacatttaaggcaaagtaccaagtgcctttgccaaaagtgagggcggtcagcgacgcggaggccttcaaagttgtcaatacgggaaaaactagacgaaaagggtggaaaaggatggtcaccaaagtcactttcgtcggcgaaacattcacacggaaaccggcaaaattcgaacgattcattcgtccgatgggtctccgttttaaaaag

SEQ ID NO: 60470 - DNA, 918 bp, Heterodera glycines
  Genomic contig location: Contig_ID=SeqID_30020; Location=130..1047; Strand=-
  SCN-specific regions: Sequence locations=1-115,156-918
atggtcatggaggacattcatgaagttggaaagaaggctgggctcttcacctttgaacaggtcggtcaattcggtttgaatttgaatgaaaaaatacaagtgagcgtagaacagctattttcttaatttagtttttgttttattctttaaaaataatatgagacagttttagctactgtaccaaaaaaatgggtggctcagtggtttttgtaagatagtaaagggacacaggaaggatgttcgagaccgttctgcaacatgaatatttttttatttttgtccaaaaaattaaaaaaatgcccatttttgggaattatttttggagggttttgccaaccaaattggacaattttggtatcattcgaaagcttctaaaccaaagctaaggtatttgatgttttaaaaaaggatacaggctttcaaaattttcttttttaaataactttttagctaatacactttttgctctcaaaaacctcaaattttgttcgtaatttttttctctatcgatatgcaaaatttgaggaagatttaacgtattgaaaaaagttaaactagcgaagtaaattcaggttttttcaactaacagaggcaaagaaatagtacgctaaaatgagagatgtttttttctctgcactctctatttattggtacacatcagggatgtgccgaatcggaatcgcaattaatcggattttgggccataatcggaatcggattttgtctggctcggcacatccctggtacacatctcgttttttcggatggtgtgtttatttatttattttttcattttaaggcgaaagacattcatttgtacgccgagcttttcacggtggagaacgacctgttgactccgaccatgaaaagcaagcgaccacaattgatggcccatttcaaagatgagctgtgcaaaat

SEQ ID NO: 60471 - DNA, 89 bp, Heterodera glycines
  Genomic contig location: Contig_ID=SeqID_30021; Location=538..626; Strand=-
  SCN-specific regions: Sequence locations=1-89
atgtcccatttgattgggctcaaaaatgacggacagcaaatgtcgtttttggcagtttggccacaaatgtcgggacacgccatgatatg

SEQ ID NO: 60472 - DNA, 419 bp, Heterodera glycines
  Genomic contig location: Contig_ID=SeqID_752; Location=84..502; Strand=-
  SCN-specific regions: Sequence locations=1-58,89-282,304-419
atggcaaaattaatcactgttaactctgcaaaaggaaagttttgtgacgggtattgttatcacaaacacaaaatgacaaaaaataaaacttggtggaagtgtgaactttaccaacaaggatgcaaaggttggggttttgagagtaatggtgagtttttcggaactcgaatgcataatcatcctccagaccaaattctacttcaaatcgagagagaacagcagatttgaagatgtcaaacatagaaatcagatttcaccttggaatttcaaaaatatcacacgaacttttatttttcctctcacctgcgtgattttgggtaacccaaaacttggaaaaaaggtttgatatttcacgaccctgagcttttgaatgagcgtaatttttgtttacaccggttcaattttagcgatcgaataaa

SEQ ID NO: 60473 - DNA, 1931 bp, Heterodera glycines
  Genomic contig location: Contig_ID=SeqID_753; Location=1..1931; Strand=-
  SCN-specific regions: Sequence locations=1-149,172-837,860-1099,1122 -1931
  Gene Ontology: Cellular component=mitochondrion
catattaaagaggcgtgtgtgctcacgcggttggtcgcctcgtcggtgcgactgtccgaagcggtggtcggaattattaaggcactaatcacctgcgaagccctcaattaaaaacagaccaatttaggacataaggaacagtggtgacctgcaaattgtgaacaaggaccaaacgggactaatggaggatttacaaaccgaggccgatcggttggacattttggcattttatcaaaaggaagggcggattaagcgaattacacccgcaaattccctaaaaatacgaaagttttctgggcaaaacgccatattcattagtcgcatttttcggctttcaataaaaggaatcctcctaattattgttccatttttttgtggataaattgacgtttagatctgctcaattgtgcattgaacggtcactgcgcgagaaattcggcaaaaatcttacgattgttggcgaggaagtgaatgaatgccgcctttgatcccttttcggctaattgccctttttgcaggaaattgagctcccatcgacgccctttgaaccgcttgaagctttgccgccttcacatcattttcacatcttcttaaaagacgtccgtccggcttttttaatgtttaataattaatttgccaattgaataatttttcttttcccaatgtccttttgttgttttaattttttaattgcaagatgcaaggctttaatttgcccgttgcttttcgcatataatttgttgtccccgtgttagcttgttgtttgggtcgacccgttggacggcacttccgattttacaaagtcaaaagataatcggggtcagataaattaggtcacaaatggcaaaaataaataaatttcaagcgctccttcgtcatgtcactgtgctcattggcatcacttacaaaggccgaccggtggccggcattgtgcatcagccgttttataatggggaacaaagtcgaaccgtttggtcaattgtcggagttggcacttttggccttaagaaaacggcgcaacaaaatatgaatttcccgaagggtaaagcagcatttatttgtctggttgtgccgagtatgtgaccggaaaatgcatcagtacaatttttaaaaaagttctgtagcattaagtagtgtaaacaaagtaaaattctgtaagaacttcgttgaaattccgaatcccggaaccgaattcgaactaaaagtcgaaagtccaagtttcaattttacccgttttttgttcaaaatcggttgaaaaacacggaaacaaaactgaaaggcaccaatcctgcaataagagattatttacgcattttagaaccaaaaatgggtaaaatttaaatttgtatttcgactttttatttgtgtcaggaattcggaattgacgcattttccgggagctgccgaatattctcaccccccctttttttagctaatgaacaaatgccgccgcgggtcgctgtcattaccttccgtagccgctccgaattggtcgaacagctttttgttctttcaattttattttaattgaatataattggtattttttccttcttccgccttaggtgcaaaaggcattggacgcgttggaggagaaaaagctgatcagcgaagtggaacgcgcaggaggcgcgggctttaaagtgttgcgctgtttggagggggccactgcttttgtttacgccgcgggggacaccaaaaaatgggacattgccgcgcccgaggcattgctaatggctgccggtacactttttagaaattgttgtttttttacaacaaacagttttttgccacttttaggtggcactttatcggatatgtccgggcgacagattcgttacgacggacctccgttcagctggcaaacagcgggggactgcttgcgaccgcctcgggcgtggaccatcaggtgagcgggcggaaaaggaaag

SEQ ID NO: 60474 - DNA, 888 bp, Heterodera glycines
  Genomic contig location: Contig_ID=SeqID_754; Location=1085..1972; Strand=-
  SCN-specific regions: Sequence locations=1-222,244-335,378-690,714 -819,841-888
atgaatgcaaagaaatgtttaactactgtaagttggacaattttaacatttttggctattccaatttagactggcttttacagttaaaacaattcattttctctcgctgacgatcttttaaggtagagaattataaatgcaccttaagcttaccaaaaaaaatatgaaaaataaaaattttcagtgtggggattgtaccatgaaaataaaaaaaaacgaagatttagctataaaaaattttttagtcgaaatcgaactgaaaccatcggagccggacttcggctcgggaaaaagccgggttccggaacatccgaaagagacttaaaggatttaagattttaaattttttttcataattttatttaaaaaaaatttaacagctattgaaaaggaaaaagttttaaataggaaaaaaggtaacggaaaaactaaaagtaaattaagcagtagagcccgggcgcgcgggaatatcgagaaaacgtggcaaaacaattcggaacaggacaaaacgtcgcccactgaagcatccccggacgaatttttggactatatcttttttcttactcaacaaatcaaacatttttggcacgaacaaacacgctatacattttccattaaaacgatatataaatgttatgggtgggttgtatgtggtggcatttctgtgacagactcaaaattttgtaccgtaagtgcggagacctgaaaattggtgtacactgccggaattttgaacactaagtgtccaattaccgggaaccgtgcaccgtttcccgcactaaatcatttaattaaacttaatacatgtttaattgtcgctggaaatttttattgcaatttcttagactattcaacatagaatgggagcccgttgaacagagtaataaa

SEQ ID NO: 60475 - DNA, 3623 bp, Heterodera glycines
  Genomic contig location: Contig_ID=SeqID_754; Location=2128..5750; Strand=+
  SCN-specific regions: Sequence locations=1-165,195-230,252-551,577 -585,608-760,782-840,869-1043,1065-1105,1159-1406,1449-1482,1505 -1521,1555-1611,1633-1906,1968-1979,2038-2377,2399-2473,2495 -2522,2611-2672,2709-2890,...
  SCN-specific regions: Sequence locations=...2937-3246,3272-3396,3418 -3440,3462-3623
atgaatcgcgccagatcggacccagagcttaatgcaaattttcctcagcgaacaaacgatttgttcggtgggagagtttactgtattggcagtcttaggcggttgaccaatgtaatcttccttatcgacaccggtaaagcgtatgacaataattaacatgccgccaaaaaaaattttcaatttttattatttttgatcacgaaattgagatttcacctgacaatcggggattccttgatatttgcttttgaaaaattcaaaaaattcattgaacctgatccattcacaaaaaactccctatattcacaacattggcgtagaaaaattaagaaattctcaatttagctctaaaattcgataaaaaactttggcatggccgcgtccggtctctactaattataattaaggctctcccttttgtttgatcgcggcgcaattcattcgcgaacacaatttggctattgttaacaccaatatcacgttctctcttggaggagttggtggtgttagtctccgaactttgggccggtaatttaagaattaatataaccgaataaaataataaaaacaaaagcaagtctcatcatttcaaattttattttaactttttgtagtgtaatcgatattttttcagggctgaaggtgtagaaatgagaatcggaaggaccagattctcttctgatttggattgtgtcagggatgaatcataccatgttctgtgagcttttaaagttttataccccaatcggatatttgcggcaaaactttttgttttgttttgcggtcaaagccaaaatcggacatttgcggtccgacattttgcgatttcgcccaaatttcatggtcaaaataaaaattaaacccaaaacgagctcattttttacattttaaccattcattaagcccttgtgcaaggtgctacaatgttactcaaaaaatcatcaaaatgggcgttaataaaaaacggtgccgcgcgtttcgcgaaaaccgcaaatatttaaaaagagagactgagccacatcagtacgatgtctctatttgttaaattaataaaaacaatttaatgtgttttaagctactataatcaaacaaagcaaagcaaaggaatattttttaagtaaaataaatataaaaatattttaattagtttatttaaaagtgtttttgtgaatgaggttctgtgatttgttaattaactgataacttatatttttattgataatttgcatgcgtgcatatgtaaaaatatgaatcggcgatttctgtatgcaaccaactatttgatctttaacatccgatagccttaagtgttttctattattctactaaatttcaaagagtttcgttaacttaagaaagttaacaacaaaaaggttcaaaaaaacttgcttttttgagtttctctgattattatttttttaaaacttaatgaatttttttgaaattttgcagaaaaacttcgggctaccgaataacaccaagattataaaatttaattaattttgggcgaacttatgaataatttactgtcaaaaaattttttaagcatttttgagtaatggcctggcactttcagaaagggaaacggttaaaagtgcgctgcacaaaaagcattttttcaaaacaaaaaagtcgtcgccttgctaagaatcgcaaaaaaaattttttcgtttttgatgaaattctgttaaaaattgacaaaaattttcaaaaatttttccccggcggcccaaatgtctttggaaaaactgcgccgagaaaaaatattttgaaaaacaaaaaataacaaaatcgattatactgatcatgatgattttaatgatgatttaaactatttttcctttttttttgttaggcttctattcctgtttacaatttacatttattaactttcaaatggaaaagcaaataatttttaaataaaagttttcatacttttaataattcatttaaattacaaatttaatgcccaaatagccttaataaaaaataaaaattaattaaaaaaaattttatcaaaataataattttatttttcacgttttaagattgggatgcagcattttggtgtctagaggggtggcaattaactgtcaaccgaggactgttacgtttctgaatggaaatgcagttcagtttatgaccgaagaggggttcagacaactcagaacaacagcttctatcagctttggttcaaattcttatggaacattacatggtctgttcacttaaaataggttttatatttcatttccaccatttttaagctattggttattttgcgccccaacgtataaactttattaatgacggtgatgaccatatagaaaagccatacgatttaataagtttgttttgtaacttttatatatagcactaaatttaattttaaaattttcatgtaccgtcacttggacattacaaggaagaggtattgcggtagtaaaaatagataccttcgatccaaaggtagtattttttaataataatttaacagtagaaaataaagctgagcgggactgaaaaattttgaaaaaaaattgaaaaatttcaaaaattttaatctcaattcatagatgaataatcatttaaatatttttttaaataaaactgcattttttttaaattccaaaagactcggtgcttaaaatctttttgagaattgttaattgttttaataaattataataatctcttaaatttatttactacaaatagctttttttcttgcgcagttttccgaaaaactttttgggaacattgtggggggggggggtgggtccggcggtgccgataggcgccgccgggaaaaattgaaaattgagtgaaatatattaacagcttgtcctaaaaatgatcaaagccttggttaaatttgtggtttgggcagtttaaaaaaataatattttaagttgtaatactttttattataaattgaaattgaaataatgtacagaaaatatggaacattttcagttcagttggggaattgcacccaagcgataaatataagtagaaatagggcggctacacgggcccgggtatttaagcaaaaaacgagcccgggcattaccgggtactgaagttttgttacttaaaaagtgtaaaatccacttttttggcgtttggttactacttttcactatttcaacattttttagaaaattccttaacaaaaatgcaataaagtacacctataagaatcgacctaaaaaatttcaaataatacacccttaagaatcgatctaaaaaatttttggaaaattttttcaagagatcatagaccaaattttttcccagacgcccattcttaccagtacttatttagtcccgttgggagcgggactggcaaactgggaccgggatttttttttcagaaactgggaccgtggcctgaaaaaactgggaattcccaatccggtcctgcttagccctagtctaaaataacaagtaacaaaatgggattggagggtccttttttgctttctcttttttgaaactgcttaatgttctattaaattttcgttttcaggaaaacacaatcaatcatgacgtattggatgacttgcacaagacgttcgctgccattgagcagaattcgtcagtgcgtggcgttgtgctga

SEQ ID NO: 60476 - DNA, 186 bp, Heterodera glycines
  Genomic contig location: Contig_ID=SeqID_754; Location=6182..6367; Strand=-
  SCN-specific regions: Sequence locations=1-186
cgaaatcagcctgggcaaccgctgagtgccgccggcgcacggcaacagaccaagcatcacctcgggcagtgcaaactgcgtcttgggccagctgaccgcgatccggtagtggcacgccagcgccatctccaagccaataccaatgcaggagccggagatggcagcaacgatcaaaaagcaatttag

SEQ ID NO: 60477 - DNA, 668 bp, Heterodera glycines
  Genomic contig location: Contig_ID=SeqID_6137; Location=1525..2192; Strand=-
  SCN-specific regions: Sequence locations=1-202,307-516,538-567,589-668
atgacttctccctttaaggtcggcgctgcagccttcggggcgggaatggtaagtttttttttgttgttgttcgctccaaaatttacatctcaaacaaattttcaaattttcagtgcttcgcgaagacgtacatggagaaaccgaagagcgaagacgacaaagaagcgcccaagaaggaagaagccacgaccggcggcgacgcggaggagaaggcaaagaagaaggacaagaaaggcgacggcgcagctgcggcggacaagaaggaggagaagcgcaaggacaaacacaaatcaaaggaggggaagagcgacgacagcaaccgccgttccaagaaggacaagcacgggaagaaggacgctgccgagccagccgctaacgccggagaacagagcacagcggagacgacccaagcggacgaatagccagcgatgagaacgacgacggtgcacgacgacctctcccttccgatcagtcccccctactgcttgctgttgtttgtgtgaagttcgttccccatattttgtacatattccatgtgatcagagcgaccttcctaatgtgatcaaaatatgtatgtatgtataatatccattaatgtgctgcttcatattcgttatttgtgtgtatgtacagtgtttgcgtattcattgttcaatgtgtgtaataaa

SEQ ID NO: 60478 - DNA, 726 bp, Heterodera glycines
  Genomic contig location: Contig_ID=SeqID_30025; Location=315..1040; Strand=-
  SCN-specific regions: Sequence locations=1-61,129-400,423-572,595-726
atgacggaccaaaaaaatgaaaatcgaaaacaacaacgaggtagttgagaatgttcaaatgtaaaaattttagaaataaaaatatctaaatatattccatttaaaatataatttttttttttattaaactgaccactaatttgaaattattttttagaatttgttctaagacacaagctagcggaacgcaccaaaaaacgaacacgttacgggcttaacagcatcaaaaaaatgctgattggtggtggaaaattagcagaaaaattttctaatgaatttcaggtgaaaatttgcgaaaaatttccatgtgggattgttatcaactactatatcatatagttcgaatgtacctctctgggagatatggactccaaaaattcattttgactaaattattattaaatttcaatacaaaaacataagcaggtcatttttgatcagatttaaaatatagagagtttttcgctgctcatatttttgatattattttgaaaccaaaacaattctctgattttcaaatattaaaaaatttttacccttcaggatttttatctcaccagtataaatttagaaaaagtgcccacatatgcttcattaaaccgagagtttcatcctttgtgatcagatcaatcagaaggtgctaggtcgtttcgtaaattccgccatttttaacgactttactttgacaaactcacaatatcttttctcaaacgtccacaaaataaa

SEQ ID NO: 60479 - DNA, 49 bp, Heterodera glycines; identical to SEQ ID NO: 51181
  Genomic contig location: Contig_ID=SeqID_30026; Location=666..714; Strand=-
  SCN-specific regions: Sequence locations=1-49

SEQ ID NO: 60480 - DNA, 88 bp, Heterodera glycines
  Genomic contig location: Contig_ID=SeqID_30030; Location=924..1011; Strand=+
  SCN-specific regions: Sequence locations=1-88
atgaataatgggattcagtttgggcttatggatcaaaataatttggtggatttttgggacacttatcagacgacaaatttgaggggcg

SEQ ID NO: 60481 - DNA, 2295 bp, Heterodera glycines; identical to SEQ ID NO: 6140
  misc_feature (37)..(37): n is a, c, g, or t
  misc_feature (135)..(135): n is a, c, g, or t
  misc_feature (159)..(159): n is a, c, g, or t
  Genomic contig location: Contig_ID=SeqID_6140; Location=1..2295; Strand=+
  SCN-specific regions: Sequence locations=1-315,337-453,518-1444,1478 -1496,1518-1786,1809-2295
  Gene Ontology: Mol. function=transcriptional repressor activity; Cellular component=polytene chromosome; Biological process=growth

SEQ ID NO: 60482 - DNA, 1416 bp, Heterodera glycines
  Genomic contig location: Contig_ID=SeqID_30032; Location=1..1416; Strand=-
  SCN-specific regions: Sequence locations=1-116,145-252,275-994,1016 -1416
  Gene Ontology: Mol. function=methionyl aminopeptidase activity; Cellular component=cytosolic ribosome (sensu Eukarya); Biological process=proteolysis and peptidolysis
tcatctgaatttttaaggtgttgaacgaggaggaacagttgggaatgcgtttggccgccaaattgggccgcgaggtgctcgacgaggcggcacgtgccattgagcctggcgtaatgaattttttttttttttttttattaaaatcccataaaaatacaaaccggatcaggggattccggaaaatagttttttttccctaaatcctatccatttcatgtttccaagctgatttttttcaaattggttatggtcttttgttgttgttaaacatttggttttaaagaaagttgttcaattttttatcattttttcatttttcaaaaaattcgaatcaaataaaaacgccaatttttcgtatgattcgatttaaataagtgccattatttgtattaaacatcaggtgaccaccgatgagattgaccgtgttgtgcacgaggcgtgcattgagcgggagtgctatccgagcccactgggctactacaaattcccgaagagttgttgtacgtcggtcaacgaggtgtttcaaattttcaaaaaaaataaaatttatctgaaaaatttttccataaaaaatgtgtacactggcaatggttatttttattgggccaattgccagaaaaatggttgatgcccctagagaagcacaggaagaaatatttgaaagttggacatatacattttgctagcagattttgcccctaaaaacggttgctttttgagacttttcggtaataaatcaaaaatttcacaaaaaaaaaaaattttatccaatttttttttgttgtaacttgcaccttgcctccaagcacatttttttaaagtttaatagagcaaaatgctaatttcgttgcttttttttggaagattttggtttttgtacgctaattgtcttaggtcatttgccatggcatcccggataaacgggcactgatcaatggagacatttgcgatggtttgttatgtttttattgcattttttaagcctcaattttgctaaatttgaaatttcaaaaaattcctggcattctaattcaagttgatgtgactgtgttccatcgcggcttccatggcgatttgaatgaaacttttctggtcggtgatgcggtcagtgaggagaacttgaagctgatcacggttggttttccaccaatggaccaaatcaaaccgaaaattttattacgcttttttaattaaatttgctttttgggactagaatttgtgttttaaaaattggtaaacaaaatgagtaaatctccaattactagaaccaacaaaattttacaatacatttttttaatcttgaaaaaaattattcttaactctacgtaatttttttttcctcactaattttcggggctgggaaaaagcacgctgacgtttattttaaaaaattccgagaaaaaatggcaaattttt

SEQ ID NO: 60483 - DNA, 746 bp, Heterodera glycines
  Genomic contig location: Contig_ID=SeqID_30033; Location=361..1106; Strand=+
  SCN-specific regions: Sequence locations=1-686,708-746
  Gene Ontology: Mol. function=pre-mRNA splicing factor activity; Cellular component=nucleus; Biological process=mRNA splice site selection
atgtccaatttgcccgtttcttctctgattcgtcaacagcacggcggtggtttaggagaggaagatggtatagaaagtgggaaaagaaagtccaaggatgagtacagacgacaaaaggacttggaggagcagcgaaaagccggcacggcgccggcgatggtcgacgtggagacggggagagacataaatccgcacattcccgagttcatcgagaaaacgccctggtatgtgccatcttcaggacccacgctcaaggtaagtggacgaataacaaacaatgcgacaacgaatccattttagcaccagcggccacatcctgaacgccaaaaacagatgtcatcggttgctgaatggtaccctaaggttcattttggttacaaaacaaagggacattgtgactcattggcttattgtcagggcactaccgaacgcgtggcattcaaataccgtgacggggcttgtcaaaattgcggtgctttgggacataacagaaaaaattgctttgagaagcctcgattagtcggtgctaaatttacgaactcaaacattgctccggatgaccatgttctggtgggtgaccactttgttaaaatgttagcaaaatgaccccaattcagccatccctcgaaatgggatacgacgcgaaaagggaccgatggaacgggtacaacgcggaggattattcattggtggcagctgagtttgaaaaaatggaggaaacgcggaaattgatcagagcggaacag

SEQ ID NO: 60484 - DNA, 428 bp, Heterodera glycines
  Genomic contig location: Contig_ID=SeqID_30034; Location=505..932; Strand=-
  SCN-specific regions: Sequence locations=1-63,91-103,136-154,202 -210,239-262,294-300,329-428
atggggccacttggagctcaaacattcaacgcctgggttcagagtcaagcaaccctggcttcatacccatttagagtttgagaataggttaaggacatttcgtccccaagtcctctaatcattcgctttaccgaggataactgcttaacgagctccagctatcctgggggaaacttcggagggaaccagctactagatgtctcgattatcctttcgcccctatacccaagtcagacgatcgatttgctcgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaa

SEQ ID NO: 60485 - DNA, 368 bp, Heterodera glycines
  misc_feature (7)..(7): n is a, c, g, or t
  Genomic contig location: Contig_ID=SeqID_30035; Location=1106..1473; Strand=-
  SCN-specific regions: Sequence locations=1-55,93-168,190-263,285 -299,321-368
atggagnagagtggcgatgagttgggcactgataagcaggtattttattgctctcattttttcaaaatattatttaaaataaaaattaaaatgttttccagagtgtttctcgcgatcgtgatgatgacaatattgcacagcagcaggattctactaatccaataagtcaaaatatggtttcaccaaaaaagcgttggacatcggcacttcgggttgtcacggcaatggcacgcttccgaaacatgccaagggttggcaattagtttttattttatttattttttgaaatctgcattttcatatgttatttaaaaaatatagttttttttgttgggtgtgaattttaccgcatattgggattgaataaa

SEQ ID NO: 60486 - DNA, 940 bp, Heterodera glycines
  Genomic contig location: Contig_ID=SeqID_30036; Location=6..945; Strand=-
  SCN-specific regions: Sequence locations=1-108,130-148,173-553,576 -595,618-637,660-679,702-721,744-763,786-865,888-907,930-940
atgattttatcgaagatcgccgaaacattggcgccatcgaagaaatcccttggaaaaagtgagcaaggagaagctgtttctgctgctgaagctgcaccggctgtccgacaacaaaaggaacagaaaaaaggtgcaattaaagcgaatgaaatttaaaaaaattaaaaatttagaggacgaaatgccaaaaaaatacgaagacaaatatgaaaaagtgaaaaagttgggcaatgaagccaaagaagtcgcccgttccgctgggcacagcgcgaaagaagctgcttcgagagttgggagttcattgaaaaacgcattcacagaaaaggaccaccaacagagaaatggacagaacgacaacaataatcaaaaagggacagaaggacaaaatgggatagaagaacgacaaaaacaatcgaaaagtgatcagaaaaacggagagcgcagtgatcaaaggatgggaagtgatcagagaatgggaagtgatcagagaatgggagacaacgtgatcaaaggatgggaagtgatcagagaaacggagcacaaagtgatcaaaggatggggagtgatcagagaaacggagcacaaagtgatcaaaggatggggagtgatcagagaaacggagcacaaagtgatcaaaggatggggagtgatcagagaaacggagcacaaagtgatcaaaggatggggagtgatcagagaaacggagcacaaagtgatcaaaggatggggagtgatcagagaaacggagcacaaagtgatcaaaggatggggagtgatcagagaaacggagcacaacgtgatcaaaggatgggaagtgatcaaaggatgggaagtgatcagagaaacggagcacaaagtgatcaaaggatggggagtgatcagagaaacggagcacaaagtgatcaaaggatggggagtgatcagagaaacggagcacaaa

SEQ ID NO: 60487 - DNA, 559 bp, Heterodera glycines
  Genomic contig location: Contig_ID=SeqID_30039; Location=660..1218; Strand=+
  SCN-specific regions: Sequence locations=1-433,455-559
atgtatgaaatttcagctgacccaactgacaaaggagtgaaaaaacgtgtcatttctacggacaacggtcaatttaagtggaatatttggaatgctgtgcgagatcttgacactaatgccaagattacggtactcttgtgtttggacgatgagtaccgtgtgtatggccaatttgcggattatgatgcgatggaagatgagatgggtgaacggttccacgaagtgtttcaagtggtgtacaataattaccccatttatgagattgacgaaacggtgccaattgaacacgacgtgccgattgagtacgaagacgaaggccattcgacatgcacaattcaaaagtcagtttaatcaaattcaaaaattgttaagcttattttttaggtgatcgaatttttggcaaatattaggaaaagaatttagaatctttaattgaaaaccaaagaaaatgatgtacaacgaacggattattcatttgaaatatttaccccaaaatgagcatggatttaatttatttcatgtcattttgtaaaaattgtttttttttgactctatgata

SEQ ID NO: 60488 - DNA, 246 bp, Heterodera glycines
  Genomic contig location: Contig_ID=SeqID_30040; Location=110..355; Strand=+
  SCN-specific regions: Sequence locations=1-246
gcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 60489 - DNA, 304 bp, Heterodera glycines; identical to SEQ ID NO: 51570
  Genomic contig location: Contig_ID=SeqID_30040; Location=432..735; Strand=+
  SCN-specific regions: Sequence locations=1-304

SEQ ID NO: 60490 - DNA, 2013 bp, Heterodera glycines
  Genomic contig location: Contig_ID=SeqID_6141; Location=1148..3160; Strand=+
  SCN-specific regions: Sequence locations=1-212,236-238,262-440,463 -522,544-585,621-653,692-715,737-739,780-945,1031-1125,1147-1174,1196- 1235,1257-1315,1337-1341,1365-1414,1436-1598,1623-1692,1714-1864,1887- 2013
atgcatctcaatcgccgggactcaacccaccagaattccattcactggattcaattatccgcatttcaatcattggaactcaatcctctatcattccaatcgccaggatccaatcgaccagcattccaatcactgggactcaattctccggtattctaatcactgggactcaacccacatgcatttcaatcactgggactcaatccaccagcattcaaatatattataatgaacttctgattttacacacaaaataaaaaatttcctggcatactaacataaccatcggacaaaattctctttaatttcttataaataaggtttaaaaaaatctgcagaaatattttacgtgagaacaaacattttctccgtgaaaaacttatattccgcctaatttccgatagaatgacttttattaatatttttttaggtattttcgcataaaaatagcacatattttggcgattttaaacataaaacattttatggcaaaaataattaaaaatagggaaaaatttgaattacgcgcttggtacttggaagcaagaaatgcatttttaaaattcgatatgtttggataactgaaacttgaagattaataaaataaaaatatccttgatttattaaagataggtaccaaaagctaaggacgcttattttttgaatatataataatattattttaaaaattgttcatatagtgcgaagtaaactaattatttatttagttttaatacctttcataatgtactaatttgttagaataaatttgaatttttgacaaattgcaaaaataacaataaactaactttaaggttggacaacacgacgcaccgaaatatgaaaccgttccaaaacttatggaagattttgtgcgcgatgttaaccaccatctgcatagaatggatgcgcctgaattggctgcgagagctcatttcgagctggtaataaatttaattaattaaaatttataattattgaaatttggagaaatgaaaaaagaagaaattatttttttattaaattaaatgaataatggcctaaaaggcagaaattccctactttctccttgaccgcaaccgtcagtgaatcaaaatttttagatcaacgatatactgtagaaataataattttaatgagaataaatccgcaataacaaaaagtgttcgtttttaaaattttcaaaattctattaatgttttcgaatattgaaaacaaaatatcaaattctgaactcattttttattaaagaaaattattttcgaaatataacattactgatgcattttctactggccaatttaattactattttcaacagttttatttgctttttccacataggtaaatttattttttaaactaattagaatccaaaaatcatttttggtgcaaaatttcttacaatttcatgaaaacccaaactttcccagtggagtgcccgtcggcaccgctagattacttactgcttattttgttttatttgcacaaaatatcctgaaattggcttcttgttataaattctgttagcacattgcttttaaccaaaaaaaaagttttacaaaatctaaaatggctttttttggctatttttcatgttttttattttttaaaatttttttggtgatatttatggcttttttaattttttatttacttatttgacgtttgtatatttcgtgactttaacccctctcgtagatatttttatttcctaatttaatttaggcctatatacatccgtatatggatggaaatgggcgcgtttgcaggctagtggcaaactggattttgtcaaagggccgattccgaatgttcgagcttccggagattgcccgagacgaatataacgcaggccttgatttggccgtacgtggaagacgtgaagggcacgcgacgggccttgatgcgaacatcaatcgaagtggcgagcatgattggccccgaccctttatactattaatatattttcacgtgcagaatgcacagcaagaaaatgttacatttgattag

SEQ ID NO: 60491 - DNA, 1021 bp, Heterodera glycines
  Genomic contig location: Contig_ID=SeqID_30042; Location=290..1310; Strand=+
  SCN-specific regions: Sequence locations=1-175,198-219,252-305,330 -434,456-556,584-588,610-717,746-788,819-983,1006-1021
atgcctaatgaaaaacaaaagttgtgagaaaaagcaagggttattctgttccaatttatccattgatctggtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagggttataaattaatatgatttttaatatatttttctttgcgcatatgctattaaaaagcggctcagaaatagcatttctacgttaaaattttttggttgttttggtgtttattctcctgatgagataacacaaaaaattattaaaaaaacaaagattcatttttagagaaagggaaaacattaaaatagtgtatgccagagatattttctgcttttccaaaaaatccaaccaaaaagggggaccaaaactaatttgtaagacaacattagtaccaaaaatatacatattctaaatttagtgtaaataaaggcacaactttttttctagttattttgttcaaattataattttaaattaaaaaaataggaatgaaataaaagacaaaattgaacttttttatagagggaagagagcgcaaacaaattaacttctcgcaattacactgatgcccctgttttttttctaaaccatagcctcaaatttaggagtgtaaaatgacaaaatttattcaaaaattataaaaattaggcaaagtcaatattaagataaataattttaaaatccaaattcttgtcaagaaaataaataaataaattttggagatggatttttgagaaatttttcatttcttagggatgtatttttgaaaactttcgggtcgattcttatggggtgtattttttttttaattttcaggtcgattcataggggtgtatttttcgttgttgcatttttgggcaatggccaaaatagatcgaaataggttttttcaaaatttttaaaatctctttaagctctaaaaa

SEQ ID NO: 60492 - DNA, 646 bp, Heterodera glycines
  Genomic contig location: Contig_ID=SeqID_30043; Location=174..819; Strand=-
  SCN-specific regions: Sequence locations=1-646
atgaatttactaatcactgttgtacctcttctaatcaaatttgtactacttctattcactgttcaacctcttctaatcattgttccacctcttctaatcactgttgaacctcttctaataactgctgtaccttttctaatcactgttgtacctcttctaatcattgttgtacctcttttaatcacttttgtacctcttctcatcactgttgtgcctcttctaatcaatcacagttatacctcttctaatcacagttgtacctcttctaatcattgttgtactacttctaatcaaatttgtactacttctattcactgttcaacctcttctaatcattgttccacctcttctaatcactgttgaacctcttctaataactgctgtaccttttctaatcactgttgtacctcttctaatcattgttgtaccccttttaatcaccgttgtacctcttctgatcactgttgcacctcttttagtcacttttgcacctcttctaatcatttttgtaactcttctaatctctgttgtacctcttttaatctctgttgtacctcttataatcgctgttgtatctcttctcttcattgttgtacctcttttaatcactgttgcacctcttctaataacagtttacctcttctaa

SEQ ID NO: 60493 - DNA, 351 bp, Heterodera glycines
  Genomic contig location: Contig_ID=SeqID_30044; Location=384..734; Strand=-
  SCN-specific regions: Sequence locations=1-37,70-121,208-214,237 -241,272-351
ggaatcgaaggtgttgtaagcttttttcctttttcacttttaaatttatttaaattttcaatttttttagcttttttcgaaatattttttgtcttttttttcggcaggcactgcctctgacaatattttttatttatttagaaaaataaatttttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 60494 - DNA, 612 bp, Heterodera glycines
  Genomic contig location: Contig_ID=SeqID_30045; Location=914..1525; Strand=-
  SCN-specific regions: Sequence locations=1-521,557-612
atgtgttatgtgcctgccacaacaaccgctcaacgacgcacagatgccagcacagccgttaggtcgccccacgagcgtgcatcccacattggcgcagcgaaccaaccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataa

SEQ ID NO: 60495 - DNA, 88 bp, Heterodera glycines
  Genomic contig location: Contig_ID=SeqID_30045; Location=1534..1621; Strand=+
  SCN-specific regions: Sequence locations=1-88
atggtggtttcgttcccggtcttacgtgccgtaactagcggtgtgtttgtgcttgctgctacgtccgtggccgtgatgagacgacgcg

SEQ ID NO: 60496 - DNA, 606 bp, Heterodera glycines
  Genomic contig location: Contig_ID=SeqID_30046; Location=177..782; Strand=+
  SCN-specific regions: Sequence locations=1-87,109-164,188-606
atcattgaacgagccgattggacagcgagcgatttttgtggccaattgtttacggactgtccaccaaactcagatgaaatgcaacaaattttgtcttcctttgagttagccaacaaattgaatggaagcgcggcgaatagagacgaagaaaatggcggaggaaatgatggcggaggaggaggagggaccggcaatttattggaatgaccaattaattagaaaaaaaaacaaaaaaaagcatcaaaacgccaatgtgtattttgttttctttattttaaatggagacttttaaatgcacttttcctctgtgtcacaattgtcattatttctgtaaccaactccatttggaaatttatatgttcatgagtaatgacggttccgagctgctttgtgggtagggccaagggttttgaaaaagtcgggaccgggattcgggagtggaaccaggctgggataggattgattatctgaagtttaggtttgccggtgtttgaagaccctggcggaatttaaatccaaatttgtcggaatcgaattccggctccttttcaaaaaaacaaagccaggattgtggtcctggactggaccccgtcctggctctatgta

SEQ ID NO: 60497 - DNA, 232 bp, Heterodera glycines
  Genomic contig location: Contig_ID=SeqID_30047; Location=34..265; Strand=+
  SCN-specific regions: Sequence locations=1-232
ccgtgccttatggtgaacatatatgtgtacatttgtttgcgagttgctttcagcctcagacagcagtgaaagaggcaaagaaagaacgaaaaacattggggaggaagtgatcggcagagcaaatgatatgaaaaatggaaatgattgtgattttgtgaattgaattgatcaaaaatgaaaagccaagacttttgtgagtagtcccaacttgaaaatacacgtaaataattaa

SEQ ID NO: 60498 - DNA, 443 bp, Heterodera glycines
  Genomic contig location: Contig_ID=SeqID_30049; Location=352..794; Strand=-
  SCN-specific regions: Sequence locations=1-443
ttcatcgattacaccatcgacactttctggagaacctgcccccgccgttggcaccaaaattgaagctcaattagcgctttacaaagatgttgaacgagttggaattgatgctgacatatttttgtggtggaaggaaaacggacttcgctttcctgagttggcaaaaattgctcaaattgtgcattcaattccagcaacctctgtgagcagtgagagactttttagcaaggctggactaatttatgcaaatagtttgagaaacaagtgaattgcattattctcaaataaattaaaaataagtatattttagactttccggaaaaacggtacgacaaatgttagtggttaaggcaaatatggatgatgtaaagctggcacctccaattgaacctgatcctatcgatctcattgattatgaaaatgaaatgattaatgatgattaa

SEQ ID NO: 60499 - DNA, 553 bp, Heterodera glycines
  Genomic contig location: Contig_ID=SeqID_30051; Location=579..1131; Strand=+
  SCN-specific regions: Sequence locations=1-141,179-217,239-241,308 -379,401-526
atgaaggttcttccgccgtcgcttagtccgccaccgtatcgtcaattcgacttgcaacaaccgtatcggtggccggcagctgccgaacttcaacaacaaccagaacaaacgcaattttccagcaattttggaccattgcgtcaacaacagcaacaacaacaacaacaacaacaacaactgaatcaaaggcagcaaatgaaaagtggaattggtaattaataaatgaacaaaattaaaagcgtattattttattttttaagggttttataaaaatattttattttcatcaaaatttatcaattaatttgcttgaaatccgtgaaattatcgcttgaaggttcgcctccttattattttgacatataaaaaagaaagacactaagagacagacctaaatgcatggaaactttaaaacttttcaactttagaatagagcaaaaaagtcaatttttgataaaaaaaacacagcaacaaattttacaaaaaattgataccccaaataccaaaaactttgcatatatcgaagttattaaattaatatataatttttata

SEQ ID NO: 60500 - DNA, 948 bp, Heterodera glycines
  Genomic contig location: Contig_ID=SeqID_6143; Location=1371..2318; Strand=-
  SCN-specific regions: Sequence locations=1-79,101-418,453-495,556 -689,711-948
atggaacttgaacaatctttcgaactgcccgtctatcctgacgacgagtctctttctccagccaactctttgccaacagacaccgtcccctttggtcccgatgtcgacgaagtgccggaattgggtcccaacccgcacgaccaggtagtggagatggtagaagacgcggtttcggctgcgtattcttctgaccacgaattcgaggtcgaaagaatatgtggccaaaagcgcgtcaacggccaccaacactacctggtaaagtgggttgggtttcccaaggaccccaacgattggatacctgtcggggatttggtatctgattttctaaatcctttttcttcatcccccaccccccattcagaactgtgaagaggccataaatgattattggcagcgatatcgagaaggcaaagagtacagagagcggaagaaagaggaaaagatgaaaaagacgggacagcggaagagaaaagtctcgggaatggctacggccgcgggagaaaaggagcaaaaggaggaaaagaaagaggacgaaaagaagggagcggaggaagaattgcagcaacagctcccgataaatgccgggactgagggcacgaatgaaggaaaagcagaggtcggggaagaaactgatggggcggaaacaacagaggaagcgaaaaaagagatgggctctgccccgggggagatggtggaggacgggactgaaggtcgggaggatgtgtgcaaaaaagggaattcggaatcggcagatgtgggactggaggttgaacagttgaagaaaatgttacgcgacagtggccaaatggcgacggacaatgccccacttcccctacctcgatgggtgaagggttgtggggcattcaaaaggaaatataagaaaatttatgataacatgattaaaataaacaattcgtgagctgtattgtattattgttgcgtaataaa

SEQ ID NO: 60501 - DNA, 612 bp, Heterodera glycines
  Genomic contig location: Contig_ID=SeqID_6143; Location=3262..3873; Strand=-
  SCN-specific regions: Sequence locations=1-104,178-295,317-612
atggacgtaactcttcccgtcagcaactcggcaggtgaatggatcggagaggaacggagggatggtgttgtgctctatgcgccgtggacggacgagtggcatgtgcaacagcagcagcaacagcagcagcatcaacagcaacaacaccaacaacaacaacagcagcagcaacagcagtttgtccggcgaacaggcacggggtggacgcggtttccagcatggaacgaaccgctcgttgccaacgattggcgagagaaggaggaaaatctgatccaaaggaagagactacagcgtgaaaacccggagtattgggcgcaaatattggaggaggaaaagcgagccggtgaggagcgccgcttaagggatttgcggttagagcgcacatgggatggctacaaggaaggccactttgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgtttgcatgggattgaaagtgttaagattaactatgattggggatggtatttga

SEQ ID NO: 60502 - DNA, 604 bp, Heterodera glycines
  Genomic contig location: Contig_ID=SeqID_6144; Location=294..897; Strand=-
  SCN-specific regions: Sequence locations=1-108,151-155,181-604
atggacgtaactcttcccgtcagcaactcagttggtgaatggatcggtgaggaacggggggatggcagtgttgtgctctacgcgccgtggacggacgtgtggcatgtgcagcaacaacaacatcaacaacaccaacaacaacaacagcaaaacgaggtgcagcagcagcaacaacagcttgtccggcgaacaggcacggggtggacgcggtttccagcatggaacgaaccgctcgttgccaacgattggcgagagaaggaggaaaatctgatccaaaggaagcgactacagcgtgaaaacccggtgtattgggcgcgaatattggaggaggaaaagcgagccggtgaggagcgccgcttaagggatttgcggttggagcacacatgggatggctacaaggaaggccacttcgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgttggcatgggattgaaagtgttaagattaactatgattggggatg

SEQ ID NO: 60503 - DNA, 826 bp, Heterodera glycines
  Genomic contig location: Contig_ID=SeqID_6145; Location=1934..2759; Strand=+
  SCN-specific regions: Sequence locations=1-348,373-432,455-525,547-826
atgagcgaatttgttgattggattttgggatttaaacgatttgaaacggttgcttttgctcattatggtggaaggttcgactcgcattttgtgttaaaagagctgactgaaagaggggtcgaaaccgagttgatgatggcagacctgaagatttatcaaatgaaagcgcgtggtgtgtattttcgggatttctggctgctcagccaaaacaagttggcagatcttccaaagactttgggttttaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaatcgggggattaaaagtggattgtatcattggagctgagaaaaaaataattgaatttcag

SEQ ID NO: 60504 - DNA, 357 bp, Heterodera glycines
  misc_feature (318)..(318): n is a, c, g, or t
  Genomic contig location: Contig_ID=SeqID_30052; Location=105..461; Strand=-
  SCN-specific regions: Sequence locations=1-42,72-127,213-219,242 -246,277-357
ggaatcgaaggtgttgtaagctttttttccttttttcacttgtaaatttatttaaattttcaatttttttagctttttttcgaaaatttttttgtctttttttcggcaggcactgcctctgacaatgttttttatttatttagaaaaataaattgattttttttctttttgatttattttaattatattttatccttaaattttttaataaacattttcaaactttcaccttattaatttaaggcgaattttgccttttttaataaattctcttgtgaaaaggcaaaaaaataggctcttttaaatatgcctatttanattactttaattgctgtcctttcgcttacgaccatagca

SEQ ID NO: 60505 - DNA, 351 bp, Heterodera glycines
  Genomic contig location: Contig_ID=SeqID_30052; Location=542..892; Strand=-
  SCN-specific regions: Sequence locations=1-40,70-125,208-214,237 -241,272-351
ggaatcgaaggtgttgtaagcttttttcctttttcacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcgaattttgccttttttaataaattctcttgtgaaaaggcaaaaaaataggctcttttaattatgcctatttaaattactttcattgctttcctttgcttacgaccatacca

SEQ ID NO: 60506 - DNA, 292 bp, Heterodera glycines
  misc_feature (76)..(76): n is a, c, g, or t
  Genomic contig location: Contig_ID=SeqID_30052; Location=973..1264; Strand=-
  SCN-specific regions: Sequence locations=1-63,149-155,178-182,213-292
tttttagctttttttcgaaaaattttttgtctttttttcggcaggcactgcctctgacaaatgttttttatttatntagaaaaataaattgattttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 60507 - DNA, 1025 bp, Heterodera glycines
  Genomic contig location: Contig_ID=SeqID_30053; Location=52..1076; Strand=-
  SCN-specific regions: Sequence locations=1-21,43-83,122-379,430 -582,639-758,780-1025
atgattctaccgacaagattattttttcttttatttcaatttcttcttgtcatttcgactttgtctgaaactcaaccaaaatgtaaaaattatacataaaaaaaagaaaataaaaaatttagcataaataccgagaattaattttgggctttcgtttgaaaaaactgcgaattctataatttgattaccataattttgaaaagtgtctactatttacaactaatttatttacgaatagtttcatttttacatatttgagaatttttgagatttataaaaatgaaatttcgaaaatagctgaacttgattataagcttatttaggtctttttatgcattttttgcctattttatttttttcgaagttttttgtccaaaactaataataataaaaattattttacatattttgttttatatttgtttttttgttcgtaatacaataagaaaatcctcgggaaaagtctcggctttcagctgtttcggtcacaagtctcgggaaagtttcgctcccgagcatcactaatggggttgattcaattctgatgatcccctattttcttttcactgcaaagaattgttgttttaatttttaattacattttttgtattttaaataaattttttgttaaataaattcttttttcagtgccttcttgggcccaaattgatgaaatgtattcaaaattgttcggcttgccgataaaaaaggagcagcagacagttgatgaattgactgaagcgaatgttcccaaagaattggaccaaaatttaatatttgaaatcgaagcgtcggtatttgcaaacgaaattgaggaaatattaaaaaatgctagcatcaaaagcttaaccgaagagcaaaataaaattttagagaaaaaacgcaaaaatttcaaagagttttttggggttgccgaagagaagcgccgtcccacaatgagcagagtttgcgaactttggaaatttggtcgccaaattggcgatgagttcggtgggattaaaacgttttttacttcatttttttaa

SEQ ID NO: 60508 - DNA, 585 bp, Heterodera glycines
  Genomic contig location: Contig_ID=SeqID_30054; Location=140..724; Strand=+
  SCN-specific regions: Sequence locations=1-71,106-208,230-257,279 -321,343-384,406-585
atgcttggcccggcacttttcaatattcgttttccgctcgtccaaaaaatggaattttcggagaaaattggtaaaaaaaatataaattaattttatttattttttctaaatctttcagttcctttcggcgtgttaacaatggaagaagtgatcggcattgaaaagtaccacagtcctccaaattttcgtgggatgtccaacggcatattgtacccattgcaatttccatgtcatggacgcatttcacctcgtggcacaattctggtgcacattgacaaattgtccgaatttgcgggagaatctgtggggagtcgccgatacagcataattgagccaataatgggatttggatggagaattgtggcgcaaataagaataaatataaaaaccaaagaaaaatttttgggcttttgtcttttctctctggtgccaaaaggaggttaaaaaaaagcattattaaaattgcctaatgattgttttatttgttttaagattcgtgcctttgctcggcaacctttcgaattgtcacacaaaatgccgaagctgagaattgcattgggaaatttaatgacatcatttttaaca

SEQ ID NO: 60509 - DNA, 583 bp, Heterodera glycines
  Genomic contig location: Contig_ID=SeqID_30059; Location=1163..1745; Strand=-
  SCN-specific regions: Sequence locations=1-268,296-406,428-562
atgagcataaaaaatgatgtcgaaaattgttcatcgtttattttgcaacacgtcactggtcatttctcaaagaataatgtcgaatggtggtacgatttaaaaaagagaatttttgtgcaaactttgccagaaaaaatgacaaaaattggcaaaattatcaatttggaatttgtgataaaggcttacacatgtgaaatagaaggtggacttaatgctaaaatgacttttattacggattttcttctgaaggatgaaatggtaattttggtaaaattatttatttatttttaatattcggctttttagacatttaaatccgtcatgccaataaaaatatgccattcacacaaattgaatggagaagcaagcaatcttgaacagctaacggatcatgttatacacattgtcatttaattacagacatataagtatgaatcagacaaattatttaggtcaaagagattattatttttgttggatgatttatgtcaataatttcgtttgcaattttgatgatttttaaagaaatgttgaaaattgtcaatttatgtgtttatcggaatataaaaaacaaagaaataaa

SEQ ID NO: 60510 - DNA, 234 bp, Heterodera glycines
  Genomic contig location: Contig_ID=SeqID_30059; Location=114..347; Strand=-
  SCN-specific regions: Sequence locations=1-234
atgcgctcccttctgttcctcgctttcgtggcacttttcgtcgtcaaatgttcggccgatgagtcaatgcaaaatgatgaaaatgatgagcaatcccctcccggaccaccgccaagcaatgaaatgtcggaagaatcaaacgatcgccgcaagcgaagccctttcttcaactttttcgggggcttcaaaaagggaggacgaggaggacggccaaaaggggaaaagccgaacgga

SEQ ID NO: 60511 - DNA, 315 bp, Heterodera glycines
  Genomic contig location: Contig_ID=SeqID_30060; Location=142..456; Strand=+
  SCN-specific regions: Sequence locations=1-315
atgcgcaggcgcagcattcgttccggcatcgcgtctggggaaataagtcgggtgtcgccctttctgaacgacattgttcacgtgaacaagttgggccatgaggagatgatgaacagcagcaaattctcgtccgctgcctccgtccgttctgccaatgtgccgcgtcaacgaatgcgttctcgttccgctggtcgccaatcgatcgctcgactcatcccagcttcaaaaccgaatgttcatatccataaacccgccattccggcttcaagaccgaatgttcagatccataaacccgctccgaaagaacacatttaa

SEQ ID NO: 60512 - DNA, 2766 bp, Heterodera glycines; identical to SEQ ID NO: 6147
  Genomic contig location: Contig_ID=SeqID_6147; Location=1..2766; Strand=+
  SCN-specific regions: Sequence locations=1-1086,1108-1223,1257 -1391,1413-1512,1534-1677,1699-1797,1820-1919,1941-2200,2222 -2510,2533-2766

SEQ ID NO: 60513 - DNA, 485 bp, Heterodera glycines
  Genomic contig location: Contig_ID=SeqID_30066; Location=486..970; Strand=-
  SCN-specific regions: Sequence locations=1-300,323-406,428-485
atgcaaaatgaagcagtgttattaaatggctctgataaaggaggagcctcatttgagtttgatgacggatcagcgtcatcggacacaactgatgccaatgatgatgaatttgttgtccccaattcgaccgacgaaagtgatgaaacttgttgtgacacctttttcgaatttaacgaagcgcacacttcgtcaagaaaacaaaataaaggaaaagccaaaagaagggaaaaaacggtcaaaggcgttaaggacgacggggaagaggccaattatatggaacggattaagtaatgaataaatatcagagaagtacttggccaaccccaatttcagagagcatcggtcactccaagaattggccaaatttaagggcgacccttttgacgaccccaatgacttccaaacactgtccaatgactgccgcatttcaaattccgtttggaacagactttacaggtcataaaaggaatgaaagtcgtcaataa

SEQ ID NO: 60514 - DNA, 824 bp, Heterodera glycines
  Genomic contig location: Contig_ID=SeqID_30067; Location=201..1024; Strand=-
  SCN-specific regions: Sequence locations=1-112,137-262,300-431,453-824
  Gene Ontology: Mol. function=nuclear localization sequence binding; Cellular component=importin, alpha-subunit; Biological process =protein-nucleus import
tggtgccatcgctcaactgatgctttccaacagtaccacgtttgtcaaggattgctgttggttgatctccaatgtgttggctggtaacacctcgcaaatccaagtgatctctcaatttttggttcccctttttaattcaaacatttctgttttcttaggatgtcattgatgcgcaattgttgccaattttgctcagtgttttgcaaaagggtgaacatcgtttgcagaatgaggctggtgagtgaatttgtctaagttcgctttcgagttttaattcgaatttccccctttgggttgggcaatttcgaatctgtgctgtggtggaacagcgaatcaaatcatcgaaatttgtcgtgtcaagaacggagtggaggcaatttgcgactgtctgatcacaaagaacaacgaattggttgctgtttttcattatcaatttcaatattttccattttttagactttgaatatgctcgaatctctccgttcggtgctgcgcactgttgcacaaacgtagggcctaaacttgcatcaatttgactgtttgttctcattccccgctttttagtgatcctgaaaatttggaccgaattcgcgaccgtgtcgaggaatgcgatggggtggaccatttggagacattgcaacaacatgagtctgaggccagtgttttgtctgtcatattgtatatatttttttttccaatttttagcaaatatattcgaatgtgttcaagataatcgaagaattcttctcggaggatgaaaacgagggcttggaaatgaagggcgatgttcagccacaaaaccaggccatccagcagaagcccct

SEQ ID NO: 60515 - DNA, 931 bp, Heterodera glycines
  Genomic contig location: Contig_ID=SeqID_30068; Location=1042..1972; Strand=+
  SCN-specific regions: Sequence locations=1-27,334-738,760-931
atgaaaagagaaaatggtaaataaacaaaaaaaaatttttttaattttaaatatttttaaatgaaaaattcatattattgtttttttaataaaaaattattttttttaatattttcacataactatttacttgaaaaaattcacccgttttaaaaacttaaaatttaataataaaaaataaaaaaaatttttggtatttaaaaaagtttaaatttttcaaagagaaaatatataaaattttaagtcattagaaggattttatacttttaaaataattaagcaaaaataaataaacattttcaaaataaaatttactaaacttttttaattttaggattattgaccagaaatttttcaaatgaacaaaagaaggaaataatccatcgatttgaaataataaaagaagaatttatgcgcaaattcaaaataaaaaccaatgccaaaattagcgataaaattgcgcgaaaagttggcgtcaatttggagacaattaatcgttggaagaggtcatttggctcaactggtaaaaaataataatcaaaataaaactaaatcttttgtttttaaaagatttttgcatagctttttggggataaatgtttaatttttacagcaaagccaatctatacgagcgcagaacaattggaatttatccgaaaatatgatgcactgaaaattcaaaacccactgatcagcgatcagaacaccgcccaaatgatcggaacaaacgcaataagcataaaaagatggaagaagaagtttggtatcgcatatccttgcaaaagagacggatcacgtgaattgattgggcagtgatcagcaatggcagttgcttgaacatcacagaagcggaagagtgatcggtggcttctgatcagaattggtctgctgacctggtctgagtgatctgcttaatttaatatgttcgtaa

SEQ ID NO: 60516 - DNA, 1003 bp, Heterodera glycines
  Genomic contig location: Contig_ID=SeqID_30069; Location=1..1003; Strand=-
  SCN-specific regions: Sequence locations=1-143,182-685,708-811,833 -1003
gaaaattataataaaatggacaatgcctcgggcaccgatttgctaattggctatttgtcccttttcgtctcgtgtctttccttcggctttctctttgtgccattgaaacgttgcgacaccaaagatggtctcaaactgaaacaataatttcaaattgggcttttccccccaagggcttttcgtccaatgggtccaatgcgccgtcgtttttatggccggactgatcataaacatcgcccgaggccttcccccgttcaatctgatcgctgccattggcggttttctttatgccaccggtgaattaaagcatttaaaattgattgggttttaattgtctcattaatatttgaatttgttttaattatcctgaagatgccactcatttaacacattaattgttcaccttaatctgtcattaacaaatgttcctggggcgaaaaagagcggtcccttcgattgccatccttttccccgtcgttctcctctgatcagtcttgggatttggccaatccaattttgcttgagagggacccccctcaggcgctcctctgttccagaggacgttttgtgttgagccctcagttgtacctctttattttacccatataaaggactattgtttgaaggtacaccatttgtattgggaatttcaactgggaaaagggccccccgttatatcactgacattaatcctttaaggaaatataattaacaatttaaatttcgttttaattgtcccttaaggaaatgttgcctctgtgccgattatcgccgaaatgggcattggccttggcatgttcatttggggctcttttcaggttcatagattgggttcaaattatcaaatggcacttcattcatttcatgcagataatcgtcggatggtccgtggccaaattcggtctgttcggcaccaaaccgcagcaaatcaaaagtccgctgatcaattatttgggcgttctgatcactctgatcagtggagtgatgttcgtcttcgtttaca

SEQ ID NO: 60517 - DNA, 247 bp, Heterodera glycines
  Genomic contig location: Contig_ID=SeqID_30072; Location=100..346; Strand=+
  SCN-specific regions: Sequence locations=1-101,125-247
ggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcg

SEQ ID NO: 60518 - DNA, 486 bp, Heterodera glycines
  Genomic contig location: Contig_ID=SeqID_30073; Location=192..677; Strand=-
  SCN-specific regions: Sequence locations=1-290,355-486
atgttaaatttggacccgaaagaacgaatgactgccaaaggggtggttgactatttggacgggaaatgtaagccaaaatattacgagaaaacagctgagaaagtcgcaatgtttggtaatgtgtcggtagaagaattgcggaaattaacggaaacagaaggatttacggaaggatttaacgcatttcttaaaggtccggaaaaagaatggaaaaacgaaatggagaaaaaggaagccaacgagaaaaaacacgaggaacaaataaagaaaatggaacaacagaaagcattaaaggaaaaggaaaaaaagaaaacggaaaaggagaaaaagaaaatggaaaagaaaaaggaagaagccattgaaaatttgaaagagaaggctttgatgaaaaaaaagaatatcaaggaacatttggccaatgctttgaaaagtattgccggcttattggaagagttgaaacaacgaagcgcaatttgcgaagattaa

SEQ ID NO: 60519 - DNA, 557 bp, Heterodera glycines
  Genomic contig location: Contig_ID=SeqID_30074; Location=311..867; Strand=-
  SCN-specific regions: Sequence locations=1-557
  Gene Ontology: Mol. function=3'-5' exodeoxyribonuclease activity; Cellular component=delta DNA polymerase complex; Biological process =DNA replication
aaatatgccgccaaacaagcccacgtggagttagcggagcgaatgcgcaagcgtgaccccggctccgccccgcgtctcggcgaccgcgtgccctacgtcattgtcaaccgcggcggcggcgccaatacgcccgcctatgagaaggcggaagacccgatttttgtgctccaaaacaacatccccatcgactttgactactatttggagcaccaactggtcaaaccgttggcacgtattttggacccggtgatgggcgaccaggcggaaaagctgttgatcagtgcgttttccatttattccttcggcaactgactctttttacaggcggcgaacacacaaagaaaaaggcgcggacaaaactgaagagtgggatgatggcgggctatttctccaaaaagtccgtctgtttggggtgcaaaacgcgcatggacttcgaggaggaggcggcacccgccacatgcgagcagtgcaggccgcggatcgacaaaatctatttggaacaggcgagaagaccaattagttttgtatttgttattccatttgcacttaattcataa

SEQ ID NO: 60520 - DNA, 1083 bp, Heterodera glycines
  Genomic contig location: Contig_ID=SeqID_30078; Location=1..1083; Strand=-
  SCN-specific regions: Sequence locations=1-183,229-296,432-665,694 -911,942-1083
  Gene Ontology: Mol. function=isocitrate dehydrogenase (NAD+) activity; Cellular component=mitochondrial matrix; Biological process=isocitrate metabolism
tttaaggtgtaattgagtgcctgaaaatcatgacgcgagagaagtgcgaaagggtggccaaatttgcgtttgattatgcgactaaacatggccgcaaaaaggtcaccgccgttcagtgagtgtttttcaatgaatgcttttctcgggagcaggacaaaacgtcgccagccgaaacgtcgccgcaaaattttttaaaattttataaacaaaattatcaaaaaatttttagttacctagcctggttcggaaaaaattctagaaaaattcgaaaaacttttttattaagaaattcaaggaaaaaattttatttttttaagtttttttttgattttttttttcttagaaatcaacaatttagtttttattaacacttagattttcaaaaaagctaaaataactttaaattttattaaaatttttaatttttttttgcggcgacgttttggggtttacccgcttttctcactcatttttcatattcatttcactcatagcaaagcgaacataatgaaattgggcgacggactctttttgaatgtgtgcacggagacgtcgaaactgtacccaaaaattgagataagttaataatgggaaaagggggttaattgtccatttattgaaattctgattttgaagactatcaaattcctttttcaatttgaacaaatgatcattgacaactgttgcatgcagttggtcgcccatcctgaacagttcgacgtgatggtaatgcccaatttgtatggcaacattgtcgacaacttggccgccggtttggtcggcggtgccggcgtggtcaatggggaatcagtgggctctgactacgtcatttttgagcccggatcacgacacacatacaaagaggcgtttggaaggtgtgtgaaattgttgacccatcctttgattcagattcgtaatttaattttatttttaggcaaattgccaacccaaccgcaatgattttgtgctgtgccaacatgctcaaccatctccacttggatcagtacggctcggcactgcgagaatccgtcgagaaagtgatcagagacgggaaagtgcgcaccagggacttgggaggtgtgt

SEQ ID NO: 60521 - DNA, 466 bp, Heterodera glycines
  Genomic contig location: Contig_ID=SeqID_30079; Location=754..1219; Strand=+
  SCN-specific regions: Sequence locations=1-466
atgtcggacaaaatcccgcacaatgacgcgttggacttggccagacagattgccccggacctgacaaataatctctttgacgatgttagcgaagccaatcaaattctcaattcaatcccaaaggacgaattgcagaagctcaacccagaacaaaagtggatgaagctatttgaagccgatttaccgcacttgtacaagttggtcagcattgtactttccgtgccggtctcaaatgcatctgtcgagagagtgttttcgctttgcggctcacaatggactgatgttcgaaattcgttgaaagtcgaaaccgtgaaggctctgctccagacgaaaataaattttgatctcacttgcccagaaatgtatcagatgctcatttccaatcacaaactgttggatcagatcggtggatgggacaaatactttgaatgactcttttttgaaaaaaacaatattattttcaata

SEQ ID NO: 60522 - DNA, 71 bp, Heterodera glycines
  Genomic contig location: Contig_ID=SeqID_30079; Location=1..71; Strand=-
  SCN-specific regions: Sequence locations=1-71
aacttcacaatcatggtatcattcgaaagccatagatgtttagaagatatttataatcgatttctcagtga

SEQ ID NO: 60523 - DNA, 3400 bp, Heterodera glycines
  Genomic contig location: Contig_ID=SeqID_6152; Location=1..3400; Strand=-
  SCN-specific regions: Sequence locations=1-74,99-728,750-776,799 -1022,1044-1071,1093-1251,1273-1331,1353-1373,1395-1398,1420 -1427,1449-1620,1642-1677,1699-1852,1875-2009,2031-2808,2835-3400
atagagagagacatttatgtggacaacataatacttggtttagaaagggctgaagaaattaagtcatattattctcttctcaaatagattttttctaatgcggatatgaatgtgagagaatttgtgtccaactgtaccaaggaaatagagagattaccaagtgaagaccaagtggtaaaaggaggagttaaattgttaggaataaaatgggacatcaacaatgacactctggtcatacattttcccgtgtttaagtctgagaagttgacaagaaggaaggtcttggcacaaattgctaaaccttttgatccgaacggatttgcggccccagcaattttgccagcaaaattatttcggcaaagggtagaaacgaataaaaagctcaaatgggacacctcgttgtctaatgaagagctaaatgaatggataacactgatgaaagactgggaaaatcagtcaataacagtaccaaggaatatcattccgaaagaaatgattaaaaattgtcagtgtgaattgcatgcgttctcagacgcatcacataaggccatgggaacggcaatatatttgagagtcattaatccaaatcaaataaatgccaatctcatatttggtaagagccttgtggttccagcaataattccatcaaagtatcggaccattccgattttggaattacacgcaatgcttttgacttcgaaatggttaaattatgtcaaaggtcaaatagaaaaatcactgaaaattgagactgtacagttgtggacggattccacggatgtattagattttctgaatagcaacaggaaattagaaagatacattaaaaatcgggtagagaaaatgagacaatggaatgtcaaacatattgagggtcaatcaaatccggcagacgttgcctctcgtggcacaagtccggaagatttacaatgaattatggtggaaaggaccgccgtttataagtctaaaaaatacacagtggccacaaacaatcagggaatttgatccaaatgtatgggcagatcaaaatcaagaggtcactgtttgtgaattgacgaatccggcaagggaaagaaaccaaaggaaattgggttcctttctgacagtttatgtgaaccacttctcaaagtggaagaggattagaaatacagtggcgtatatttggcgaatttacaagggacctctccaatttgtacaacgaattgagccaattcaggaacgtaaattgctcaaggcaaggagtgaaactataaaaagaattaattcttattggctttagagagattcatgaggcgtagaagagtgccaaaaatgataatttctgacaatgcttgccaatttgttctttctcataagatattggctaaaattactgaggcacattggagaaaaaataaggtttgggggcaaattcagaccagacaaagggaattagaagaaaaggagaaatggtcaatgatcatgaacgaaagagaggtacaagagcgtacagctaataagggtatcacatggcaatttgcctctccattagcgccttggcgctcgggattttttgagcgactaatcggtctagtcaaacaccatttataccgagggttaggtaaaaagttattggattatgaagaattattgacttatcttatccaaatagaaaggatagtcaatgaaaggccaattacatacattgagaatgatgaaattatggagcccttgtgcccaatgcatattctcaatgcatcagaaggggaaccatttgagtatcagcgtgacactaatgaaacagaggatacagacgatttagatgctcaaattaaccaaacaaaacgggatgaactcctcgaagttcacaagaaaacaatgtataagagtaccaaattctgggaagtctttagggatgactatttattggcattaagggaacaggaaaaagccaaaaatgtggatgaacaaaggtttccaaaaataggacaagtggtactaatcaatgaccaaaaaccgtgtccccggaataaatggaaattaggtaaaatagaaggtataatcaataaccgaactgccaaattaaaaatgcccgacggaaaaataatggaaagagcaacgattttattatacccactggaaatagagaccctcgagtctgaccctaatcccattaatgaaatttcagcattaacaatggaggacacagttagtttggccagcatggaggaagagtggtacgaaattgatgaagggcaaccgaccgaacaacccagctcaacaacaacaccaactgcacatctggaggacaacatttaccatgacgacgaaccgtcgttgaaggtcatcaaggccccaattttgatattggggcaaggggaagaggacggtggtgcgctccgcaattgtctcatcaatgcggacgcacgacaattttgccattttcccgaagagtgggacgcgcacctctttacagaggaattacacattgaaggtgtacagtcaattattgtctggaggaagggagtgacgttggacgatttggggtttatgcaaactttggcaacggctcaacaattgtacagcgacagattgttgttttggatctcatccataccgcagaccgaattgtcaccaaatcatctccgaatgcttcaccattggcacatcattgacgaaagagagccgacttcggacatgattctcctcatgatgcagatgggcatggaaataattaagaggaaggaaaaaccagcaaagcgcgttcgtccggacaaatggcaaagagaatgggacgcgaatcggaaaaaatttcatcaaggcacattccaacaacaacaaccacaacaacagcagcctttaccgattcaagtgccaaaggcattttggggtgaaaggccaatgatgcccaaacgggttgaaaggacccctggtcaatatcagcctctcacggctgttaaaagtgtggcggatgacgtatgggacaaacccccataccctaaatgggttgaaattgaggggagaggtggctacttcttctttcgccatgtgtacgcgttcagcaacttcttctccgtggagttcagagtggacaacaacgtgtttaggtgctcggagcaattttacacatggagaaaggcgttggaattccgaatgccaaacctggctcgacaaatactacggggagaattgccaccgattaccatgaagagtgccaccgatcgagaagtgcatcaatgggcgctgcgggaacctgatccaattccatacaatcaaagccactggaaccagctaagggtggaggtgatgataatcgccctgagagccaagtttggccagaatagtgggctaaagcaaatgcttgtggacaccgggtacgagccgatttttgaagcctcgtcttctttgagttgggggatcg

SEQ ID NO: 60524 - DNA, 1185 bp, Heterodera glycines
  Genomic contig location: Contig_ID=SeqID_6153; Location=666..1850; Strand=-
  SCN-specific regions: Sequence locations=1-3,32-245,267-357,387 -684,706-775,807-856,884-940,1004-1148,1178-1185
atgaaaatattattaatatttttattattatgcgcattaatattcaaaaaagcaattaaccaaattgaggctggcaaaataatccaagaaaaaagttttgctgaaatatttggccaaagatgggacgacggagcagaagaaaacatctgtcaaaatgatcaaataattcatggagaaattgctgatcagaataaccaatttggacaaaatgttcgacaatttgatcagatttttgatgaaaatgtgaaagtgaaagaagaggagagtgaagaaatgtccacagattatgatgaattgggcgaccaattgccaatgccaacaaataatggacaaagttgtgacaatttttcaaatgcaattgataaaaagaaaagagaaactgtggaaaaatttcataatattaaggagaaagttaagcaaatgggaaagaaatattcaagaaaagaatgggtgaaaattgaaagaaaaattgcaaaaaaattgggcgtcagtcaagagaaaatttacaaatggaaaagagaatttggaatgatgaagaacaaaaattattcagttgaagaaaaaagaataatgttaaagcaatttgatcaaatatatggcaaattaaaaacgaaatttaatgaaaaattggaaggaaaaaggacaaaatgccaaaaaataatagcaaaacatttgggcatacatatcaaaacaattttttattggaagaaacaattaaaagttggaaaaatggtgaaaaagcaaaaaactgatgatgaaaaaagagaaattgttgaaaaatattttaaaacaaaaattaaatttatgcaaaatgagaaacattcgctgaaggaatggaaagaatttaatgcaaaaattaaacaaatgtttggaatttattatagaacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattga

SEQ ID NO: 60525 - DNA, 1100 bp, Heterodera glycines
  misc_feature (3)..(3): n is a, c, g, or t
  misc_feature (27)..(27): n is a, c, g, or t
  Genomic contig location: Contig_ID=SeqID_30083; Location=7..1106; Strand=-
  SCN-specific regions: Sequence locations=1-163,185-791,813-917,939 -996,1043-1047,1070-1100
atntgggatgtttttgtccgtgaaatntggcccatttttgcgccaaacattcgccatttgttcttttccaatgcttatcatttggacaattttcgtcgtcttatttcgccgacaattctcaccgatctgaacccttcaatgtgttctggtgatctgttccccgatggaattgctgatgatgggccaaatgcaactgctggccaatcgttgtccaaatggttgcacaccccgacaaaagatggaaagccgaagcgattgacttgctatgattatccgtcaaaatccagtgaatgggtcaacactttcaaggaggccagtccccacattggcacaaaactatttggattaattgccatttgattttgtttctcaattgtttaggcatttcttagtgccaccacttctgccagctacaaaattcaacttgaactgcaacaattaatgcctgagccatttgaattggtaaacgaaaggaccaaagaaaagctaacactggagaatgtgccgcgcgaagtttacaattgggtgatgaagcgatgccaaattggggagacggcgtcggttcagtgggaggacgaaaagacgaacaatttgaacattgtcaacttttggctttacaatgccaaaaattggcttgggtaaacaacaaaatgcatttccttttgtttaaaaattattcaaatttcgcttaattaaggtcattgtctccgtcgcaagtagtagaagaaaaagcgggataaaacggcgaaaagtgcgcctaattattggtgtgtttcagagcactttctgaaaaaatatttatgaattaattttgcaaaaaattgaaaaagtacagaaaatcagaaaatctaaaaaatttttaacaaggcctagtaagcgggaaaaaagtataaattaggtatggttctcagctgttaccctgcaaaatctgggatttttctgatcactactcgtaaaactatgagtgagtgaaatttcagtaaaaagttaagcctaaacttttcgcatatttaaaaagcaattaaaaaatttttaagaattttattcatccctttttggtattaaaagcatcagagtgccttaattaacctgtaaataaa

SEQ ID NO: 60526 - DNA, 1041 bp, Heterodera glycines
  Genomic contig location: Contig_ID=SeqID_30084; Location=157..1197; Strand=-
  SCN-specific regions: Sequence locations=1-585,607-696,718-1041
atggaggagaagaagaagaagcgaagacagagaatgcggagaaaaggagagaaattcgaaagatccgttgaaaaaggaaatgtttggcgttgtgtcgacggcggtcatttggtcgtctgtccatcggtttgttgtcgttgcgttgcgacaccccccccccattaattcacaaatccattctctcattgaactgccaaacacagcagaagccaaacattactcttattcaccattagctaagttaactttgaataaaggtcatttattcattttttcaattgctttccgagattcccggtcacggtctttccctcatccccacaaaaaaaggggaccgggagtccggtaaaattccattgtaatcctggtctcgtccagctctatatccttgtttgcccttaatgttatgctaattacctcttcccatcccactaattaatgccatttcccttgcctccacctcgtccaaattaatctcgtttgcttttttggttttatctttttgttgcataatgcgtttaatcatttcaacaaataaatgaataatcgtcgcttcttctttcccacaaaaacaacctgtccaacattacaacataagcccatctcgccgactttttcttattctttgcatttttatttatatttttagtattaaagaaagttttttgaggcaacaaatttttttttgattatgcgcaattaatttcaaaactgaattcgttggcatttgggtgatttccaattcaattttgtcgtttgcctctttctattccattccccccccccccccaatttcgcctttcgccgtttctttggtcatccgtcgttcgtccatttcactctccgaaacgccatatttccaatttctctgcttctcccattttcttcttttcgcttcatttgttccattatatacaaatccataagaagccaggaggctgatgctggcgattacgagcattgctccgatgatggacgacgggggggcgaagacgagttgagggggggaggaaacgcacaaaaagttgaggcttaaataaa

SEQ ID NO: 60527 - DNA, 1068 bp, Heterodera glycines
  Genomic contig location: Contig_ID=SeqID_30086; Location=150..1217; Strand=-
  SCN-specific regions: Sequence locations=1-65,97-595,617-1029,1051 -1068
atggtggtgttaaatcaaatctttgcggtgtttgtggtgtcgtttttgagtgcattttttaatggtattaaaaaataatttaaataatattaattagggatgcgaaattttataaaaagatattttttggttaaatttccaaaaaatacatttcaaatttgtcattttaaaactcattgtaaaaggggacatgaaattggggagatttcaataaaaaactaagctttcaaaattctaaaaagtaaaaagggaaatttaagcttttaaaaaaaacaatttttgctttcgtgcaaaacttatttcttttttttttttgtagaaatgaaaatttttgcctataaattaaaattggaatttttgattcaaattttgccagctttgtgaattaacaaacacaaaaattgtgattaatcatcgattaattccaaattaggtggcgtaaattcgactagtggaagaagtgtcttcctctcaaatgttcaaaatccgccggcaaacattccgaagaattcaaatgccaatttgctgcagcaaattggcgtgactaattatcaacagcagcagcggcagaacgccaacaaaacattgaagggtaattaataaggatgccaaatttaaaaatagcttagataaacatatttttttgcgttccatttcaggtaaatcttatgggaatattcaaaaagatttttataagtttcaaagttttctgtgaattactaattttttcaaaaattttactaaaaaatcactggaaaattttaaaaatttttaggaaaaaaatttctaatcttgctgaaaaattctgcttgaaaatttaaaaaaaaaatttcgtgcggcggggaaacgagctgatcccgtgctcgagaattttcttgctatttgggtctcgatcttgaatctcggagccagcattcgtctgtggggttcatattttaaagtgaaaaaagccttctttcaatatgtttagaaatttttttttctaaccctacctactcaaaaatccgttgaaaaaaaattgttctagtgaaaatttttaaaggagattttgcgtatttttagaataaa

SEQ ID NO: 60528 - DNA, 1464 bp, Heterodera glycines
  Genomic contig location: Contig_ID=SeqID_30089; Location=1..1464; Strand=+
  SCN-specific regions: Sequence locations=1-196,218-594,616-1464
  Gene Ontology: Mol. function=ATP-binding cassette (ABC) transporter activity; Cellular component=integral to plasma membrane; Biological process=transport
ttagcaatgcaaatgtccaaaattgggtccgacatttggcttagccgttgggcttccgccgtttcaccgctgcccaatgggtccgagttcactttccctgcggctgattggaggtgcatctccgatcgctttttccttcgcttgataatctgaatcatttccgtcccttttagttttcctcttttctcgcgtcccattcaaaaaatggtcccatcaacgaatgctcagcaggaggaaaccaatttttatcttttcgtatacattggaatcgctgctctgaacaccatttgcactctgatcagggcctttttgtatgccttcggttgcattttggcagctaagcaaatgcacgaacgaattctccaccgaatacttaatgtatttaattgactaattagttgtccctatcaaaacatccccacaggccacgctgacttggtgggaccggacgccctgtggccgtgtgaccaatcggtgcgttttcggcatttcgcttcccaatcagtcagtcatttttgtccttttttcgactgtccaccgacgtgaaccgtgttgacgatgcgttacccttccaactgaacattctactcgcctccctcttccccctcgtctcctcccttttggtcacggtcgttgctcttccgctgctcagtccctttgtgctgcttctgaccgtcgcttatttcttcctccaggcacattcccttccatccaatcattcccatttgtgctgtttagcgatactatcgaaggactacggtcgaattggtacgtacagtactccatttgtgtgcaaagggagtcaaaacgggggataggaggggggggggggggggtggaaaggtcgagatggtagcacattctcctttgatttacttagcgtcgtatcgcagcccttagcctgtcgcccctgtacagtcatttggccgagactgtgtccggcctcgtgtccatccgcgccttccgaatcactcaccggcatgatcaattcaatccttgccgtccattgtcattaattaattggtttgtccattcggcagattctcctcgctgatgtgccaccgtttggagggcaatgtccgtgctctcttctctcaattagcttgttaccaatggttggctgttcgcacccaaatgctcggtgttgccattgtctctgtggtcgctttcgccagtgttttcgatgttcatttcttccatttggctgaccccggtgggtccaattggtctctcttttccagctccaaactcattaaggcttaattggcctttccattacttacgctctttcatttaccgcccttttcaacggcgctttaaacacttttgttgaaacggaaaaaggtgggaattgtaattacaactgttgaagcgcattaattgccatttcctgggcttttaattcagaattggtttctgtggaacgaatttgcgattatttggccaatgttccggaagaaattg

SEQ ID NO: 60529 - DNA, 999 bp, Heterodera glycines
  Genomic contig location: Contig_ID=SeqID_30090; Location=339..1337; Strand=-
  SCN-specific regions: Sequence locations=1-386,653-836,858-999
  Gene Ontology: Biological process=N-linked glycosylation
atgccctctaaaaaaacatcttgcaccggcgaattctgcttccgagcgttcatcaaatcgaaacttggccatttgaatgcttatcggacggtgagagagagcgcagcagcaacaccaattgcccccccccccccaccttctttttcatgtgcttccttcccttggagattggctgcgcctctttttcgcgcgattcgaaattggcggaggaattggagccgacggggtgcgcaaagttcaattcggaagacttgcaagtggaagtttgcttcacggtaatctatcaaatcatatggcaaccaattaactaattgtgtttatgcaattgataatttagacaaacgacaccgaagccattgaacgtgccaaagaaagtcggcaaaatggggaaagaaaagcagggaaaatgaggccaaaaaatgggagggaaagggtaaagggcaaagggacgagagaaaaggaggaacgggaaaagacaaaggaagaagatgagacggaaggggaagaagcgaaagacaagggacacaagggcgtgagagagcagggggaagacggagggagcaggaggagagagttacaggaagacgaggagggagaggaagagacagcggaaaaggaggagacggagcaggaggaggaggcgcaggaagagatggagaacggacgcggggacagcgagacgaagcagcaacagcaacacgtcatcttcgaacggccgacattggcaccggcggtcactgagagtaataacaccgcgtgggtttttttttactaaaattttaattttcctaaggctttttccttttccgcaaaaagctttttctatcacacaggcttatctttgtctttcttcttctcatcctcctcattttgttgagtggcgccgtgtggaagttgcaactccacaaaaaattgtttcgcgcgagttacgatacggtagcgggcggatgagatatacggtagggacagcaaatggaagcggaaagaagcattaataaa

SEQ ID NO: 60530 - DNA, 1141 bp, Heterodera glycines
  Genomic contig location: Contig_ID=SeqID_6154; Location=49..1189; Strand=-
  SCN-specific regions: Sequence locations=1-11,33-576,610-982,1007 -1083,1105-1141
atggaacgaattgaaatgtggaaagtgatagcatatgccaaacacagtgagtgaagagggacacgcacggcacacggaggcattggcttacaattagctaaaaactaaaaagggttgggcgattcgaaaagacagaagtttctggcacccccccccccttatcgcataatcgtatacctttcgtattgacattttttaaatttattttcccgttttagggtatgagaatcggccgtttaatttgactgttttgatggacggtgaaattacggacgacgaaaaggcgaacacttggactgatgcctgctcgtcaacatttggtaggttttatttttaatcattcgtttgaataaatcactcattttcagtgtttttgtctctactccttcccccctttcttaggtggtcaaattccccaagagaaacttttgcgacttttctccgccgcttccctcggcgccgtcgtcgcgcgtcactgcgacgatggcgaagtgttgggcacggcccttttccatcggaagacttattcgagttggactggacgggtacaaatgcaacactaacgattgtttgaatccatcatctgttgttttttgagtttttgtttgtggaccgtttgctggtaaagccggaatatcgacgcaaaggcattgggacggcaattatagccgaattagccatcgtaacattttaattttcaatttaacttttttttcttttttggtccctggctacggggaattttgtgactatgttactttttagcattttaaatcgactgtcttttcccgacagattggccttcggaaaggttgccgacggatcggatttgccgcgcaacaaaaagggagcggcgccgaaccatttttaagagctgtatgaaacacataaatatttaaaaagccctttcatatttcagttgaattgtgtgaatatgacagcgaaagagaaactgctcactttccgatggaatggtcaaattgaaaaagaaaagggggagaagagaagggaacttagcaaatgagagatggacggccaaagaaaacgtaaccataatattgctcacaaaaccaaaattgcatttgttgtatatacagtatatatggtggtattttttgatacagtaaacacactaattaaa

SEQ ID NO: 60531 - DNA, 1276 bp, Heterodera glycines
  Genomic contig location: Contig_ID=SeqID_6155; Location=264..1539; Strand=-
  SCN-specific regions: Sequence locations=1-103,126-135,157-274,298 -336,358-358,381-1089,1111-1178,1200-1276
gctgtcgtcgattgtttttctttttgcgtttgcccttgcactgtttggtcaattttcgggaacattacaacgctttttacctgctgaacagcatcaatctgtacgtgtgttttgtcagtgcttttccgatttgattgtccattaaaaattacttattaaccgatcatttatttaccaataaaataagaccaaatattttactattcattcaccttttaagcatggtttgcatttatgcggtgaaaagcagccgaattcgaagtttgcgcgtatgtttttcactgaaaatttgggtaatttcatgaaaaacaatgccctgtcagctgctcacttttttgatgctggcgatgttcatctacgacctgttcatggtgttcggcacaacactgctcacaaccgatgggtgttcggtgatgatggaggtaaaaacggcagaatttcaaccgaaaaaacatcaattcgccacgtctaaagccttaattttatttgggacggcgagacttatttattcctttcgcgtggcggtgaccatttttttatttatccgaattttgtatgtcttttaaacgatcgtccggaattttcgtacacgctgcataatgagagacttgtaaataataattttcatttctttttcaggttgtcaccggagtcgactgtcagcagaagagagccgactcggcttcgggcactggaaaaaactaccagccgattgcgccgattgaccttaaggaagtgccggaaaaggtacggcatcacatatccgtccatcgtctcaatggccgttcttttggcagattcctctgcttttttacgtgccaatgtttgccgatccgatggggcgttgtttcgacgtcgaagtggaacgcgagtacagacgcgtgatgctcggccttggcgacgtaatcattcccggtcagagtgcactcattcccatctgatccgaccgcaaatcacctttcaggctatctgatcgccttctgtttctacgtggacgtggtcaaacggagtcgcttctacgcctacgggtccatttcgatcattggtaccttttataaaaaccaaaaatgatttgactatcctcccttattgggggtcacttttggtaaaatatccaaattaattcgatttgatcctttcatttttgtcactcatttttaggctattccctcggaatgttcgccacttttgtcgcccttttgctgatggagacgggtcaacccgctcttctctatttggtcccttttacgcttggtcccattttcgcttgggcctt

SEQ ID NO: 60532 - DNA, 1184 bp, Heterodera glycines
  Genomic contig location: Contig_ID=SeqID_6156; Location=545..1728; Strand=+
  SCN-specific regions: Sequence locations=1-1184
atggcatttgagacaaatgagttggatggaaatcaaaccctttattggtcggctcattcggctgcgcaggttggtcctcgtcactgagtgccgcccgactcgaacccaatccatcggacacggaaacgtccaacggcacgcgttttgcgagcattgctttggactcgaaagcagcccaaagagagcctaggaatttgagacacaaattggaaaatgataattacaagcgggttttcagacaaatttttattttgacaatttgtctctaatgagtgagccaaaataaacacaccgacaagaattgatccgacggcaaacagccaaagaacgccgaccgccgggtccattggccacgccgtttggggacggtaaaagcgaagctcagtggaagacgaattgagtagtaaaggctgaattaattaattcatttataatttgaatttctatttacttcgatttcctgtcgaaatgtgtcattgtaaacgaaaaacacggacatcgaagtgtcggaatcgttaatttcggcattgtaaaattgcgaaaactgaactttttttaaagtgataaatcagtaaaatattatgtgagtggacacaccaaaaagtcgcgacttctgtatcggttgcgtttacccttttccatcaaaaacagcacatttcgcacaccctttggcttaagacgattcaactgaaagggaaaagccaaacgaattgaaaccgaataacaaaaacaattaacaaatggatgaccgtggcattgaccaccgcctcgccctctttaaatttgcatggcaaaagctccgaggacagagttcgataatcgactggaacgagttcatttttggcgaaattgtgcccattttcaaggcaaatgttcgtgtttaaattgctattccaccagccaatttggacaaaattctttaaaaaaaaattattttagaaacagcgcgaaaatcacttttgtgtcggccgacgatggcaattgacggctgtgccattgttggaaattgacacagaaatcggagcctccggtgggcaaacttttgctacggacattcaaaaaagcgaagctggagtcgtatttgtagaaagcggaggttggacactgaaaattttagggatttgaaaaagtgaaaaaaggggaaaagtaacaaccaatggaaggaagaggagaaaagaaaggga

SEQ ID NO: 60533 - DNA, 650 bp, Heterodera glycines
  Genomic contig location: Contig_ID=SeqID_6156; Location=394..1043; Strand=-
  SCN-specific regions: Sequence locations=1-650
atgtccgtgtttttcgtttacaatgacacatttcgacaggaaatcgaagtaaatagaaattcaaattataaatgaattaattaattcagcctttactactcaattcgtcttccactgagcttcgcttttaccgtccccaaacggcgtggccaatggacccggcggtcggcgttctttggctgtttgccgtcggatcaattcttgtcggtgtgtttattttggctcactcattagagacaaattgtcaaaataaaaatttgtctgaaaacccgcttgtaattatcattttccaatttgtgtctcaaattcctaggctctctttgggctgctttcgagtccaaagcaatgctcgcaaaacgcgtgccgttggacgtttccgtgtccgatggattgggttcgagtcgggcggcactcagtgacgaggaccaacctgcgcagccgaatgagccgaccaataaagggtttgatttccatccaactcatttgtctcaaatgccatctttttatggcatattttagccccttgaaacgcacgcaaagtgccgaaattgcccagatgaatgtgtgccaacatttgtccgtcgttttggttgctctcgtcttcatcgtcattgtgctcactctcgcctacttttttcgcaaattcgctg

SEQ ID NO: 60534 - DNA, 263 bp, Heterodera glycines
  Genomic contig location: Contig_ID=SeqID_6157; Location=330..592; Strand=-
  SCN-specific regions: Sequence locations=1-263
atgcttggaaaaattcccacggtgtgcaggtcattttgcatgcgatgcgtcacaaattcagcgaccaacatcaggtgggcactttcctcgattggttttgagtttttttttgaattcattgtcaggagttatgtgaccaattgctggcgactgaagacgctttgttggtgcaggcatatgacaaagactcgttctttgctgccggaatggtcgagaacggagtgcgcgaatgggccaaggaaaacgaaggcaaagtgctcaag

SEQ ID NO: 60535 - DNA, 806 bp, Heterodera glycines
  Genomic contig location: Contig_ID=SeqID_30092; Location=289..1094; Strand=-
  SCN-specific regions: Sequence locations=1-90,119-806
atgagcataaaatggttttatttggtctagtatttaccaagatataaactaaaaaaatttataaaatcattggtaaaacatagtgctatcttttatttttgtatttttattttattttggcgttctgtaattgattagtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaacattttttaatttgaaaattatgttaataattaggaaaaaagtcgatttttaggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctagttataaataaa

SEQ ID NO: 60536 - DNA, 139 bp, Heterodera glycines
  Genomic contig location: Contig_ID=SeqID_30093; Location=699..837; Strand=+
  SCN-specific regions: Sequence locations=1-13,49-139
atggagcggtataaacggcaacaacaacgacaacaacaacaacaacaagctaaagttagtcaagtgcttgaacattgttgcttcccgattccgactgacaacttggcagaagaaacgactaatgccctacgtggacacg

SEQ ID NO: 60537 - DNA, 689 bp, Heterodera glycines
  Genomic contig location: Contig_ID=SeqID_30095; Location=391..1079; Strand=-
  SCN-specific regions: Sequence locations=1-526,548-689
atgatggatgcgacgataattttgaagaagaatgcgccatcatcaacttcgaactcggaaaaacaaaagggaggcatttgtctttggtctgaaggtgggaaatttgatagagaattatgaaaagttgtcaaaggttttcggtacacgcacgaaaaaaacgtccgatggaggtgcactgtgtgtgctgccatgcccgcgtgacaattgcggacaaaagtgacagcagcatgtccggttttctcggacaaaaagaacaatcatttgcctaagcccccgaaacaaaatgtttgggaggcatttaattcattagacaaagaagaatttaggcggaaattcgacggcaaaaaactcgagcgcgtgaaagccgaaccccgaatcaggacaaattgcggctggatggcgaggacatcgtgctatacgacagtcgcactgtcagaattggaacaaagaacgttgtgctcgtttttgggtgcgaacgggttgtctcattaggggccaaagacagaatttatatttaattttttagagtttggacatttgagcaaaaacagtgcaagatggcatttggacgggacaatgatgccgagattcacgatgttattacggatcttggtctgcaggtcgaaggatacgcagaaaaattgaaggactacgaaaacatggaagattcaagcatggctgttgcttaa

SEQ ID NO: 60538 - DNA, 362 bp, Heterodera glycines
  Genomic contig location: Contig_ID=SeqID_30096; Location=63..424; Strand=+
  SCN-specific regions: Sequence locations=1-119,300-362
  Gene Ontology: Mol. function=protein binding; Cellular component =axoneme; Biological process=eye photoreceptor cell development
atgggggataaaaagagcaaatacggtattgaaataaaaaatttttttaagtggtgctttagtggaagaggatcagaaagtggaagaggaacagaaagtggaagtgaaacgaaagtggaagaggaacagaaagtggaagagaaacagaaagtggaagaggaacagaaagtggaagaggaacagaaagtgaaagagaaagtggaagaggaacagaaagtggaagaggaacagaaagtggaagaggaacagaaagtggaagagaaacagaaagtggaagagaaagtggaagaggaacagaaagtggaagaggaccagaaagtggaagagaaacagaaagtggaagaggaacagaaagtggaaga

SEQ ID NO: 60539 - DNA, 663 bp, Heterodera glycines
  Genomic contig location: Contig_ID=SeqID_30099; Location=727..1389; Strand=+
  SCN-specific regions: Sequence locations=1-111,137-172,202-222,244 -476,498-663
atgtcagaatttctcattttccttttgggtttctcctttgcaatgcttctcatgttgtgtttgctggtttcgctggtgctctttgttctttatacaacatggtattattggacaaaagaagaacaacaagaagaatgtgatgattttccagaatacccaccgccttattaatgaaataaattttttgttgaaatgtgtcatgaaaaaacttgggtttaatccataatatctttttaactttttctgttttaacattaccatttcaaatatctaagatttgaaaaatgttcaattcatccttttttgttgatgtgaaagaactagggcgtattccaacaccaaaggggaaatttagtgagaagaaaaatgaaacacaatttatgaaaatatttaggtatattttatgcacttgagttcgctaagctttatcaaacggttggacgtgaaatttctcgtgataaattccgacatatcatgaaaacagggaaaaaacaacacgaattagcattggttttgatggaaaaggctgggataaatacacagcagaaaacttttgggcttaaacacctccaatttgtgcaaaactgggacaaggaattcccagatatatttcgtatcgttgcgtttgatatggtaaacgaacatttccaaaactgtttgtga

SEQ ID NO: 60540 - DNA, 2495 bp, Heterodera glycines
  Genomic contig location: Contig_ID=SeqID_6158; Location=1594..4088; Strand=+
  SCN-specific regions: Sequence locations=1-290,350-403,460-535,594 -826,850-864,909-1032,1054-1063,1099-1325,1350-1486,1509-1512,1534 -1681,1703-2047,2069-2235,2257-2495
atgtcggaggagggcgaaggctcgtgggtggacatttactcgtttatgggcgccgaagggacggaggagagacacgggacgaccctttggaacatttacgaattggcgaagatacaaagtgccaaattggacggaatgatcaacgaggccatgtgggcggagcacgaggaaaattggaggaataaaacggagaaaaatgggcaaaaaaagaaagggtaaaaaatgggaatgaaaagaaaaacagacatttataagaaaactatcaatgggaatatgaaaatataatatggattaataaaataattaaaaaaatataacacaaaaaaataaaacaattgaaattaaaaaacatttggtattttttaggaaaatccccaaatccatcttgtataattctttgaaatttcattttcatttaatttttaaaatgaattagctaaaaatgtgaaaaatgtaaaagggagcggaaggtcacaaaaagtgattgaatgagtgatttatttgcgatttgcgtttttcgtgtttataaggtatcattaatgaatgaattaattaattggatattacaactcattaattaattaagcaatgaacgagtgctcattgaaggcgctggtccgattggtttgttctgtgccgttcacctgtttttggccggtgccaatgtcactttggtcaatgaccgccccgagctctattcgcgcaaccatatgacctttttggacgcaaaatttatggcacaatttcgctttttcttgggcacaaaatttgatgaaatttacaacaaagaaagggtacggtttacggattacggttactgtaaagagtaaatttaaaaataaaatttgaaagcggacaaaatggttaaaatatttaaattggttaaagaaaatattaaaaattaaaatcagtgaaatgtttaaaacaaaattaatccaacggtaaaacgtaaatttaaaatgccgaaatttaaaagaaaattaaaaaatggataaataatttttgaatttgatttatgaagttatcactacaaaaaatatgatttctttaattcaaaaaagtcaaaattatttaattaaattgaaattaatttttaatgaatttgtttttgtttagtcatttggtcggattaacactttggacggggaagtggggcaacagaatgtgaaagacatcgagcaaattttgaaaatgcgactggtcgaattgaccagttttgtggagagcaaaattgggccggaacagccgaatcggctgaaattgctttatcagacggaacttaaagggattaaacgcgatggcccaatgggtaattgaagaaaaagtattaattaataattaaatttaatgtttttgaaaggaattgaagcgattgttaaagtgtcacccaaattcaatgcaaaagagcaaaaacattttaatagaagaaaagtcgaaataagagcagataacagagggattgacttggaaagtgcggagaagcaaatctttggtcagtcaaatttaaaagggaaaaaattattaaaaatttaagaagaaaaagtcgaaaatgccaaagaaatttatgctgcccgtcgcgcggcggcacttcaccaacagaagcaagctgatcagagtgatctgccatcacaaaagcaagctgatcaggaggatcataatgcggcggttgagcaagttcgcttggaaaaatgggaggggaaagtgcccgaattgcgccatttggcgccaattccctttgacattttgttttgtgccggcggagccaacgatcggattcgcaacaagcttttgggtatgacacgaaattgttgtcattgtttaatttatgtaaaaaattataggaaatccaattcgacgaagcatttcgaagaattacggattggttgtgttccataagggcagcccaaatgagaaagacggaataatggagcagagagtgttcgaccatttgaccggctttttcaaagtcaaaatgagcgattttgagccaattttgcaaaagcaaaatttcgataaatttgtcacaaatcacgggaacattttgccaaaagaattcataaaaaagtatgaaaatttgacgcaactgattgtccgagggctggtcaaggaaaacgaaggcaaatacgaggaggacgaaattcacaaaccgcacacgaaacacatttacaaacagcgtaagtcattagtggggtaattagcgtaattattagtgaagaacccacaaacggactacggtaatatttaaaatgaacgaaatgccaaaaagctgttcaaaccaaatgtttaaaaattggtttttttttattaaaatgggtaattctggatttaatccaagaaaatggccgttttgtgctcgccgacccaaaagaggagcccagtcaaatcgttcgtctgtttgagaatcggccaacacttcacatcgcttcgataacgccgccggcggtggaggaatttgttcgggacataaggcgagagtggctgcgatcggaaaatga

SEQ ID NO: 60541 - DNA, 70 bp, Heterodera glycines
  Genomic contig location: Contig_ID=SeqID_6158; Location=537..606; Strand=+
  SCN-specific regions: Sequence locations=1-42
taaaaaagcacatttttctatttttgggttgggcccaaacgaccccggggcccaaaaacgggggcccaaa

SEQ ID NO: 60542 - DNA, 1094 bp, Heterodera glycines
  Genomic contig location: Contig_ID=SeqID_6159; Location=16..1109; Strand=+
  SCN-specific regions: Sequence locations=1-300,322-941,966-988,1010 -1035,1087-1094
atgcgtagtggaaaaatcgtcagtagaaaatgcgtcagtggaaattttattgtcacaaaaacagagtcccttgctttttcgaggtcactgaccacgatccagtatccattttggcctcttccgaatcccggacctgaattcgaacaaaaagtcgaaagcccaaattttcgatttagcatttttggttaaaaaacgccataaatgatctcttattgaaggattgatgggtttcagtttgtttccgtgtatttaaacctattttgaagaaaagccctaatttcgaaaattttggctttcgactttttgttcgaattcgggttcttgattcgaaattcagaacgaggttcttatagaagtttacttttatattacaatactaatgctacagaactttatactaaaatatttgtatcattgacacattttccactgacgcattttccggtcacggttttaattgggtcgaaagccgaaaccgaacaaaaaacgaaaagattggcatttaacgaagcatttgaatttgactgcttttggaatatatttgactttgcaggaaattctttggctttttttcctacctctgcacttatacgggaatgacccattaattgattaattaactaactaaccattcccattcattaggccgtttgggcgttgaatggtccgcgtacgccttgagggattatcaccagggaaaaataacggagaaggaactgatcgaacggatgagcaaaaaattgaattcaatagaacaaagagtggtgaaaaaagtgcgagaatatgtgacaattgaggacaaagagggcgaaaagacggacaaagcatcaaccattttggacaaggacgaggacaaagtgtacaaagccatttaccatgccaaaaagacgcaatgaatgggcaaaaaatgatcgaccgaccaaagaacgaacagaaaacgaaatgaattttgaaaaaattgaattgagatatgtgattttgttcagagatatgtaaatgcatttttaaattagttggaaagcttaattatttcggaaaattttttaattaaaatttcaaaattaattaattaattaagtaatatttgcttaaaa

SEQ ID NO: 60543 - DNA, 521 bp, Heterodera glycines
  Genomic contig location: Contig_ID=SeqID_30102; Location=9..529; Strand=+
  SCN-specific regions: Sequence locations=1-274,296-418,447-521
  Gene Ontology: Mol. function=ATPase activity, coupled to transmembrane movement of ions, phosphorylative mechanism; Cellular component=membrane; Biological process=calcium ion homeostasis
gaagccaaagggcacgacagtgacgcggcagtttcagcggtgcaaaatgagtacggaaacaatcggtaaaagtttctgctataactccaaattacaacaaattgggtcacatttgcttcactccctcactttcagtgtcgaaatggaagtgccaaagttcgtggagctgttcattgaacgtgccactgctcccttcttcgtcttccaagttttctgcgtcggtctttggtgtttgggtgagtgagtcaccgccgaccattgcccattaataaacaaattatgcatttatttccttttattagccctaaaattacacttcaaccttttggtgacttaattttttgaaattcagaggacatgtggtacttttcactgctcactctgttcatgttggtcactttcgaggtgcaaaatatgcaattttttaaaattttaattttatttttcaggcgaccattgtaaagcaacagctcaaaaatatgtccgaaattcggttggacttatttgccatttttctttga

SEQ ID NO: 60544 - DNA, 502 bp, Heterodera glycines
  Genomic contig location: Contig_ID=SeqID_30105; Location=1085..1586; Strand=+
  SCN-specific regions: Sequence locations=1-300,322-342,373-502
atgaaccgacggtaaggaatttaaaaaacaaattcatttaactaaactgttttccccgcattctatgttgggtttgtaacgatgtttggatggacattctaccagtttttaaccgtcttcaactcggcctcaaattggcacttctttcgccacgtttcgatgttttagtggacaaacattttgatggcaaaagcgaactgacaatttggagacatatcaatattctaaaaggcgctggaccagaaccagaattatctgtacggattgatcgcaaaaccatggtttccattgcccgaccgtccgctgcccaccaaaatccgcattaaggacattcatatcgggtaatttaaaattcaaataattattaaattacaaagcattcctttccaggtacactgaccattccgtcatcacagcaagctacataattcgacttctatcaacagaaattgacccagttgaattgatgaaccgaatggaccaacgaaatgctgacatttga

SEQ ID NO: 60545 - DNA, 321 bp, Heterodera glycines
  Genomic contig location: Contig_ID=SeqID_30105; Location=471..791; Strand=-
  SCN-specific regions: Sequence locations=1-137,159-321
tttttgggccccggggtcgtttgggccccaacccaaaaatcggaaaatgtgcttttttaaaaattaagaatctaaaaactaagcctgagggatccctcgccacttggcataagttaggtttaattaacactcgctcattttttacaattttacttattccaaatcctattattttttaatagttaaccaatttgatgtacattctgatttggatatttttcagaaatggcttacccaattgcaaccaaaaaacaaaaagtaaaattgtcttacgaaggccacctttacaccttcgctaaaatgagttctgatgggatgaca

SEQ ID NO: 60546 - DNA, 340 bp, Heterodera glycines
  misc_feature (4)..(4): n is a, c, g, or t
  misc_feature (94)..(94): n is a, c, g, or t
  Genomic contig location: Contig_ID=SeqID_30106; Location=108..447; Strand=+
  SCN-specific regions: Sequence locations=1-4,94-340
atgngcagcagtgaaagccgtgccaaaggcggcggagaatgctcagaagggaccgtcgagtgcggaagtggtggcggaggaaaacaacttggancactgaggcggtcgacgacttgggggcggaagagtcggactttgaccaattggcagaggacgaactgctcgaggaggacgccatgggcggcgaggcgaacgaattggagggcatgggggaagagacggagatggacagccaaatggctctttgatggacaattgaggcaaattggacaaatggcaaacggaaaaaacgggacaaatgacacaaaaatataatttttatcatagaaattaaagaata

SEQ ID NO: 60547 - DNA, 758 bp, Heterodera glycines
  Genomic contig location: Contig_ID=SeqID_30106; Location=504..1261; Strand=-
  SCN-specific regions: Sequence locations=1-178,203-409,433-482,542 -558,644-702,725-758
atgccgtgcaacttcactccaacattcccgtttgggcagttcaatatattacagtaagaaactcaaacaataccgtatatagaaaaaacgaattcatattaaaaatgccaaggtgacgcccaaatgttatcaaatattttgccatttcatgagaaaaatgttacataatgtgaaaaagttttaaaattttaatttattatttgaaagtatattttacttttaggcgatattttttcatatttatttttatcttctcactaatttgttgtttttatcattatcaatgatattattaaattcataggttgaacataacgaaaatgccaaaattggaaagccggtgataaaatgtgaaccgcaaagtcgctgcttggccaaatcagaagttgacaattatttgggttcacacaatttataatttatattaattttcatttccatggcaacatttcttttttcatttatgtcattttaatcgttccaatttttaaattttttgtttgaataaaaattgcaatttttgaaatatattttatttttaggtgttttgcaatttgcttattatcaaaattaaaataaaaaaagattaaactcaaaattaattcaagaagaaattcaaattcaaaataatattttaaattatccaatcattttttataacaaaatgttttagggctactgaactgaagagatttatgtttttgtaagtagaagaaaattccaggtatcaaagctatgctcactgaatacaaaataaa

SEQ ID NO: 60548 - DNA, 610 bp, Heterodera glycines
  Genomic contig location: Contig_ID=SeqID_30107; Location=392..1001; Strand=+
  SCN-specific regions: Sequence locations=1-52,74-133,205-225,247 -448,470-610
ttcctcttattgtaaaagaagagcccattgatgaacagttcagattggcagatttggagaaggaaatccaggcattggcgaaacgtctttcattgcttttccgtattgaaaagtcagttaaaaatggcatttgaattataattaacaaatttattaaataacttattttactttataattgacttaattaatcaaataaatttactttggattaacatcgataatttaatctaatcatttaattttgttccgtttaagcgatgtcttcgttttgatgcttcccactgaagaaggtgaccattggttgtctcgtcttttgatgcttcgcgatgacaacagctccattagacttgccgaattcaccggctcttccgaagcattcgcagaaaaagccgaacattggctgaaaagtgattttgaagggccgcaacaactgatggaagcggtacagttaaatcaattttgaaattgatcagttgatcgattatatcagtttttaaactgatcagctgatctgatcacttttataattaatttccttcagttgaatgcgaaatgtgtagaatactttcaacagcagaaaatggcacaggacgaggacaatctttga

SEQ ID NO: 60549 - DNA, 881 bp, Heterodera glycines
  Genomic contig location: Contig_ID=SeqID_30108; Location=269..1149; Strand=-
  SCN-specific regions: Sequence locations=1-170,235-294,327-338,361 -479,501-633,656-846,868-881
atgccgtgccatctgcacactgtcggtggaggaacaacagcgcatttacatgcaacacttgcgcaaacaatgggcaacacaatagcggcggtgagcagaggaataaattaaatcgccggtcaaataatttgaggaaatatttaaatggccaacaccatttttaattcgtgaaaataaatatttaatatttttataattttataattttaaatgtatgttttttctttatttaaaggaaccctccactttggaaaataacttttttaatcgtttgtgaccaacttgaaatattgcaaatttaaattttacattaaaaaaaattaaatctgggttattctgatttaagtatttataaaaattcgttaagccgctgaattacgattttttgctgttggcttaatccctgttgtacggcctcacaaattaattcactttcatttattttatttttttaacgactttttttaatttaacatttgttaaggaaaaatgtttttgactttgtgctgaagcatatggagttttggtcggcattgacaagacaagcaaaatgcaccatgcccaatgctactcgactgatcagtgatcactcagttttcgatcggaggaaaatttaacaatcaattccgattctaattaaatggaatccatttaattttcacttgtttgatatacattttctatttattcaattgattgcttttaaattcattaagcaaagtaattggttcatttatgtgtgtgtgattaatttcagttgggagccccggttataggtatttttgttggaattgcttcaatttcgaaacttttattatgaagcaaaaactcaactttatcagagagagataaagcattcacaaaaattctaaatcaataaa

SEQ ID NO: 60550 - DNA, 307 bp, Heterodera glycines
  Genomic contig location: Contig_ID=SeqID_30108; Location=1312..1618; Strand=+
  SCN-specific regions: Sequence locations=1-43,65-181,203-307
atggcagcctgggtttttttggtcccgaacagttggctcattatgggattatggcagaaaagccgagaaaaatcttgggttggctttaaccgccaagtcatgtttctggttgaaaaatttttacaaaatcgaaaattcctaggccttaaatggcaggaatcgggcatgccaatttccaagcaaaacaaaagtggaattgatcttcgggattgtaaatgttttgaaattgacaacggaactttcaattagagtagagcgggaccgggaattttgggcaaaaccgggactgggacttgccgggatctga

SEQ ID NO: 60551 - DNA, 411 bp, Heterodera glycines
  Genomic contig location: Contig_ID=SeqID_30109; Location=465..875; Strand=-
  SCN-specific regions: Sequence locations=1-3,25-181,204-411
atgaatcaaattaaactttgttctttaactgaaaagggcgacagcggaggtccattgctcagaaccctgaatggtaggtggacccaaatcggtgttatattgggacatgaatcagaacgatcaaacaagagtacgtttctgatcacattttgtaaaaaatttttaattacgcgattaattatacttaataaactcattaacttcctcttattaagattttttcaacaaagtctccgtattttgtgaatggataaatcgagcgacgagaggcgaagtttcttgcaaatgaatggaaatttgtaaaggcacgaaacaataattgttcatcaaagttgagataaccatgaagaagattttttacaaattcaaaaatacacttaattttttgagttttatttcggataaaataaa

SEQ ID NO: 60552 - DNA, 433 bp, Heterodera glycines
  Genomic contig location: Contig_ID=SeqID_30110; Location=377..809; Strand=-
  SCN-specific regions: Sequence locations=1-349,372-378,404-433
atgatttatgtgttaatttacggtaatgattcacatgttaattcccgggcatgtacgtttaatttacagtcattattcacgtgtcaatttacggcttaaagcacgtgtcaattcacggtcatgatttacgtgttaatacacgggttaaatcacgtgtcaattcacggtcatgatttacttgtaaattcacgatcatgatttacgtgttaatacacggtcattattcacgtgttaattcacggtcatgtacgttaaatttacagtcattattcacgtgtcaaaccggtattttaaacatttggatccaaattaaagttgataaataattgaagactctaatacatcaaatttaaaagaaatcaaattaaaaggcatgaaatatatatatatatatatatatataaattagtcataaattaatagtatgaataaa

SEQ ID NO: 60553 - DNA, 674 bp, Heterodera glycines
  misc_feature (136)..(136): n is a, c, g, or t
  Genomic contig location: Contig_ID=SeqID_30111; Location=607..1280; Strand=-
  SCN-specific regions: Sequence locations=1-319,353-546,584-674
atgcgcacccgtccgatctggcaagttaagcaacgattgctgactagccaaaaggttcggtgccgtgatgaaacgaaccagcactgcttaccccgcggcacccggcacggtcccccgaaggaatggatttaattanattctctccttcggggatttttttccattaggtcgtccgttagcgttcgattgctctagtcaatttttcaaaatttttgttgaaatatttgtcgtgctctgaaggcggggaggggggggggggggggaaaggcccccccccagggccggaaagaaggccgagtgagtaacttccggtggcaggaaaatttattaaatttttaaaatttttttaattggctttttaaaatatgccaaaaaaatgtaggctttactttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctttcaataatggaggtgaataaa

SEQ ID NO: 60554 - DNA, 588 bp, Heterodera glycines
  Genomic contig location: Contig_ID=SeqID_30111; Location=1290..1877; Strand=+
  SCN-specific regions: Sequence locations=1-58,80-588
aaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactgaaacaattatggggagcaaaaatccaacgcagaattaa

SEQ ID NO: 60555 - DNA, 741 bp, Heterodera glycines
  Genomic contig location: Contig_ID=SeqID_30115; Location=665..1405; Strand=+
  SCN-specific regions: Sequence locations=1-217,255-426,448-498,520 -563,592-648,678-716,738-741
atggcattggctcatcaattggcggaatttgctgttgctccattggcattggcactacttaaaaatgggaaaggttttttgaaaatttctcatggatttttttacatatttggttaaatattttggacttttttcttatatatttcattttttacagattttgaggattttttacggaaatttttggaaatcatcaaaaaaaatccaaaatttcggcaaattttttgtatattttttcattttttatatattttgagaatttttgaaaatttgtagtgaaaaaataattttgaaaatgtacccctgaaaaataccaaaaaataatttttaaatactaaaaggttattctaagcctatttaggacgtttttatggcattttgtgcctatttaatccattaggaagaatttttttccaaaaaaaaagtttagaaattttatttaaatattcagtacatatttatggttttgtgtacatatttcgggatttttgttacatatttatgtacatattacatattttgaccaatttttgtacttatttttggcagccctatttattagcattttaaaaataaaaaaacattaataatcagtgttaaattagggacaaccattttttagagcacattctggcctttttttaacatttccagcaaataaagaaaatatttttcataaattcaaaattttcagaaatttttcctcgaaaatacaccaaaaacggatttcccaacaattag

SEQ ID NO: 60556 - DNA, 297 bp, Heterodera glycines
  Genomic contig location: Contig_ID=SeqID_30121; Location=41..337; Strand=+
  SCN-specific regions: Sequence locations=1-297
gtagacagtgctgatcgggagaagcgccaagacaaccgagctgatcgggagaagcgccaagacaaccgagctgatcgggagaagcgccaagacaaccgggctgatcgggagaagcgccaagacaaccgagctgatcgcgagaagcgccaagacaaccgggctgatcgcgagaagcgccaagacaaccgagcaataatgtattaagccattacggatgacattagattttccgacaagaaacgtctcgtatgaaaatgtttcaataatacaccgaaccttattatgtaaaataatcaa

SEQ ID NO: 60557 - DNA, 2744 bp, Heterodera glycines
  Genomic contig location: Contig_ID=SeqID_755; Location=2457..5200; Strand=+
  SCN-specific regions: Sequence locations=1-137,159-297,357-397,419 -528,550-564,586-777,799-1291,1325-2025,2047-2744
  Gene Ontology: Mol. function=pre-mRNA splicing factor activity; Cellular component=nuclear matrix; Biological process=chromatin -mediated maintenance of transcription
atggcaaataaatttgtgcttgtaccacaagaaatttaccggggtctcacctctgcgactgacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcacggacaaaccagcacgggttgagctagtcaagggattgagtgttctgatgaggcgaggcggtgctgatgatgaagcagaagttgtagatacaccaccccgccctcctcgtcctcctcctccaccaccgcctcctggtcagcatcctcctcgtcgtccaccaagccctccaggcccaggcccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgatttgcccgttctgcctgacaacgcggacgcaattgaggagatggacactgcacagcacaggattgcaaccagaagaaagttaaagaaagcagatgacgatgatggcgatgacgatttgcatcgcaaaaaataccgggtctattatcctcctcccccttctcgcccacccccgtctcgtccacagccaaaaattgaaacacctcgacctccaccgcgtcctagcctcaagaaagaaccacaaccactgctcgatcctcggccatccacatcacaacaagttgatcgcaaacataaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacactgccgcggcagcaaccttctcctgctgccccacaagtgccgcctgttccgccacctaggagagggaccaaacgtcgacaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgctcaaccattggtgcgaagcaatttgcgaacggccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcatccgaaaaaatggaaatgatcaacaccactcttgacaagctgtacaacgatccatcctctccggctgcgtttgccggtgttagtgcactgtggaaggaggcgcggaaaaagctaaagaatttacgcaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcgtcagttgctgagcgggcaatccgaaatgtgaagcagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtgcgcatgagcagagagaagggacagttcgagaaggggtatttgccaaactatggagacgaaatcttggaaattgacgaggtgctgaaggcggtgcgtcccatcagatacaagctccgggatgatcgtggtgaaaaattccggggcaccttctatgaccaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataa

SEQ ID NO: 60558 - DNA, 516 bp, Heterodera glycines
  Genomic contig location: Contig_ID=SeqID_756; Location=401..916; Strand=+
  SCN-specific regions: Sequence locations=1-8,30-516
atgtcaaatagtttctttgtgtttttgcctagcaatgtgacggattatccggacaatcaaccaaacaagttccgggtcaggcttccaaaacctttgcatttcaacgggtcttgggtgtgtgggctgcacagcattagctacccatactcgtggtcaacaattgggacattggatgagcagtggatagacatccacttcacggatattggtgttcctgaagaagacaaacaccgcatcgtacgcgtgccggtaccgagatcgtcacacaatcgggttgaacagctgagagactttgtagcaacaacgctgagaaaccatgccaatgctaaactaaagccgcttcctcgagaggaagaggcggaccgtaataggacaaaaccactatattctccaccgcctgctaaaagaagtataaaagacgtgaatgatttgtctttgtttccttcacccccgagagttaatgagccggaaaagccgcctaagtctcctccagcacatgtaccacctactgaaccg

SEQ ID NO: 60559 - DNA, 1866 bp, Heterodera glycines
  Genomic contig location: Contig_ID=SeqID_757; Location=315..2180; Strand=+
  SCN-specific regions: Sequence locations=1-8,30-733,756-782,915 -1831,1855-1866
  Gene Ontology: Mol. function=transcription factor activity; Cellular component=secretory vesicle; Biological process=cell proliferation
atgtcaaatagtttctttgtgtttttgcctagcaatgtgacggattatccggacaatcagccaaacaaattccgggtccggcttccaaaacctttgcatttcaacgggtcttgggtgtgtgggctgcacagcattagctacccatactcgtggtcaacaattggtacattggatgagcagtggatagacatccacttcacggatattggggttcctgaagaagacaaacaccgcattgtacgcgtgccggtcccaaggtcttcacagaatcgagttgaacagctgagagactttttgacgacaacgctgagaaaccatgccaatgctaaactaaagccgcttcctcgagaggaagaggcggaccgtaacaggacaaaaccactttactctccgccacctgcaaagcgtgcccggagatctctagcgctctcttcgcctcccagacatgaagaagctcctgcacgaccacttgaatcgcctcctttgtatgacgagccaaagctgcaaaaagcacaaaaaacacccgaaaaaccagccaaaacagccccggctacaccaattctgcttgactcgccaccgttgtatgacgagacaaagctgcaaaaaccacaaaaaacacccgaaaaaccagcaaaaactccagctaagccaccgtcgcaagctcctcctataccagcaacccctacagcagctgtttctaaaccgtctcaaccgattgctcctgttgctcctccaacacctactgctaaatcagtagcaacacccactccagctaaaacggtttctcctcctccagctaaaacgccttctcctcctcctccagctaaaatgccttctcctccttctcctcctccagctaaaaccgcttctcctccttctcctcctccggctaaaacggcttctcctcctcctccggctaaaacggcttctcctcctgccactactattaccactactaccaagccaaaaacaccgcctccgctggtcaaacatagtcctcctccaacagctgcaaaacagccttctcccgtaaagactacgcccgcgtctaagctaaagcccgcgaaaacggttccaaaaccaccaccacctcctcctaaacaaaaaacaccaccaaaaccttcaccgatacttgagtcaccgcctcggtatgaagaatcgaacagaacaattgtaaagccaccagtcatacaaccatctccacctcatcttgaagaagcgaacaaaacaattaccaaacaaacgacatttaatactactgcaaaagaagtgatgccgacagagcctgttgcagctgctttaacacaactagcagatttaccagaaaacaccttcagctttcgcatcaatccgctcccagttgtgccccgctcagtatcgattcaataccttgatgatgttgaacgttttaaagtttcattcaatgatcggttgatacgtcatttgtcattctcaccacagttgggctatgtgctcgggtttgaaaaccctcagcacgtgatgtctaatgaagtggcaaaatatccggtggatttgcgaggcggaatctcgagttttgccgtttactcaaaaggactaactgagaatatgattgttggaaattcgctgagttcgctgctccgtgttgtgtcagtcagcggtgcaacacccggtgactacaatgagaaaatttacgattcgcccatttttgcgcgagtgctacccagggagatcaacgaaattgagattgagctgcgcacaatggacaagggtcgcctcgtcccattcgcctacggcacgacgctggtcgtgttattatttaagaaagtgataaatttctgaaaccactcattttttgtattcattcattcattaaacgtaaaaaaa

SEQ ID NO: 60560 - DNA, 227 bp, Heterodera glycines
  Genomic contig location: Contig_ID=SeqID_758; Location=2462..2688; Strand=-
  SCN-specific regions: Sequence locations=1-227
aatccgaagaaggaataaaataacgccaacttttttggaatacatgtttatcgttatggaaaaaatgaaaataagtgtgccttaaatagtgatgtcagtgctgatcgatcgatttttatccaacatcaccagcgagtcgcactcgcccatcaccaccaacattattcctccagcgggcaccgcctgattaaatttgatgctcactgctgtggtcccgttccttatca

SEQ ID NO: 60561 - DNA, 1102 bp, Heterodera glycines
  Genomic contig location: Contig_ID=SeqID_758; Location=2916..4017; Strand=-
  SCN-specific regions: Sequence locations=1-49,73-507,529-532,554 -607,629-1102
aagggtgttattgctttagtcgatgtgatgtttgaggagaaaaggacaccgaagaagaagaaagtggggagactgcttctacaggaagaactgccgcaggacctcagccgaaatgagctcctgcactacctgtgctacggacgacttggaacgaatttgttcgagatttatttcgtgatgacccaagccataaatgtgagtgaaatactttaaatttttaatgacaacacaaaatttttagtcaattgccattgggaatttgtttggacttctgctcgattttgcaatgagctcaccaactccttggctcatgaagcggcccatttgctgtggaattttctaccgtcaacacatgccgtggattctgcaacaaccgatgagtgtaatgctatcacatggcatttttccggaggtccgaagtgatggttttgaatttttttggctgttcaatccacacttgaaaaagtacgctgggtatgtccgaattctccctgagcttagtcagcctgacaatttgtattttttctttagcgttttgtaagcatttatttgaccattttattcatcattattattacatacagatcagaatttgtcgatttttccaatttctcaataaaattttcaaatgaatgaccttgtgacatgtggtagacaaaaacaatacagtgtggggcacatgttgacactaattgggattgataggaacgaatattttttcttagacccatcggaaacttattcaggaatgatgacacaatgacagatggtattttttgggctaagctgtcataataaatcactggttcttccattcccttcgcataaattgcacaccaatgagaccctcccttgtaatgtgggtcccggttcacaattagcgctgcgggatattgtagagtgaccggaggcggtaattggtcactggcgaagcagccccgaaagacttgtgcggtcccccggttttcgctcaaaattgatgtgatttgcacgctgtccattcttgagccaaaaaattgagcaaagttgatggagaaccaggctgacaataagcatcaaatacaatgcgaacaccgcccagcaaacggcttgttggaataaa

SEQ ID NO: 60562 - DNA, 792 bp, Heterodera glycines
  Genomic contig location: Contig_ID=SeqID_759; Location=714..1505; Strand=+
  SCN-specific regions: Sequence locations=1-573,595-792
atggacaatcatccccgaaaacgatcctctaacttttccattgaccatattctctccgcacctaaaaggccccgacaaggcttcctgatcaatgaactcttgggcgtagtccacttccttggatcttttcaacaaggcgaaggaacatcaaaacaggccaaggactacgttaaaaaattggacaacagcattgaacacgtggccaaattccactacgtaaaagtcaagtcaaagttcaccattacggatttgccaagcacacctgaggcactgttggccggaattttccaacactgcatcgacgaggctattgctgacagccgtgagcgcaacatcgagcctacacacctcggctgtatgatcagcagccctctgttggaaggcggcgacatcccaactccagtgcgacagatgactaacaacactctcgacaccattctcaaccagttcaaaaaagtggcgcagtccaaacaacagaaaaatgtatcgttatggggtgagccgtttaccgtcaccataacgacattgaatcgcaatggactgccacccaaacgtcgtgtcaaagggggagctcgtcgccctgtcaaaacggccgttcaccaccgaattaatgaccaatgcctgattaaaattcgcaataacgacaaccacttctgccttttctatgcgctgcaggcaacaatggtcgacaaaacgtgcaattggcctcgctggaagttttcccgttacttgaacaaccaatacggacagcagggacaacttcatcgtgatgcagttgagctcatgaagcag

SEQ ID NO: 60563 - DNA, 923 bp, Heterodera glycines
  Genomic contig location: Contig_ID=SeqID_6162; Location=1535..2457; Strand=+
  SCN-specific regions: Sequence locations=1-158,180-252,274-514,543 -805,836-882,918-923
atggtttatgagttagaacaacagctgcaaattgacaattgttgcgcactaaaagtacaattatcagttgcgttggtgagttatcgagggcgttggtcacgaatcggacattcatttcgaacaaaatcgaatccaatcccgaacttaccctttttatgggactagtaaaggcaatgtttaatatcgaattgtgttggtagagaagccaatatttaattgaaaaaagtattctcgagattaatccttacccgtatttagagattaaataaatctttttaaataaaactgcggaaaattaaattaccgaaattctaatgttgtcgtcctcaaagccgaggaattcgatgggccgaatgaaacatttgttgagctcgggcgaggatgcggacgttttgggctaatttgccgataggcgccgccgggcgaattttgaaatctaagctctattagcagatattcaccaaaaaaaaattaagatttttccgataaatttttgtttttcttcggtattttgtaaaaatttttaaaatatattaaattttctgatttactcaaggaaaaaatgaaattttcatccggtggcgccggtaaatttttttgaaaagttgatttcaatttgttaacaaattatgcgaaaaattgtcaatttttatagatatttttgtctattaatcataaaaaaataaatgcaaaacaaaacgtcaaccggtatcgaactcatgttgaagcattaaccactaaaccacaaatatatcaaaaataaaagcaaaatttactatatttcataaaaatttgccaaagatggttaaaaaatttaaattgtataattttttatcttttatcccaacaattgctttccatttgatggtttttataactaccatttataaaatataaaaaatataattttattttaacaaata

SEQ ID NO: 60564 - DNA, 100 bp, Heterodera glycines
  Genomic contig location: Contig_ID=SeqID_6162; Location=3031..3130; Strand=+
  SCN-specific regions: Sequence locations=1-100
atgggaacaattgatgtgattcgacgggcccttttgtgcatattttggccaacaccggaggaaatactttgtcgaaattcgggcccaatacatttgaaat

SEQ ID NO: 60565 - DNA, 512 bp, Heterodera glycines
  Genomic contig location: Contig_ID=SeqID_6163; Location=222..733; Strand=-
  SCN-specific regions: Sequence locations=1-132,159-488,510-512
atgccattgtttgtgttgtgcaacggcttctactctgtgcaacaaaattgtgacgttttttgcacaccagatggtctaatgccaattaagaccttcgaaaactcgtattataagcaagattcagtgtgtgtgaattttaaattatttttttattattaccatttaattgaaaatttttgaaatttcagtgccatgggaatgggtgacaaattgttttgtaaggccattcagccattcgtccgtttaaaactgagcaatgaagaatttgtacttattcgcgcaatcatttactcacatatgggtcagctaaggcctaaaaacattataattaatgagttaaaattaatctggattaaattctaaccgtatcgattgaatgcagagagagtttagccttttttaccttttcatagaaataaggaattaaacaattttgatattattaaatggcattaaatattttctataagcatacaaaaatttcgttaagttacataaaaattatgaataaa

SEQ ID NO: 60566 - DNA, 741 bp, Heterodera glycines
  Genomic contig location: Contig_ID=SeqID_6163; Location=2012..2752; Strand=-
  SCN-specific regions: Sequence locations=1-94,116-118,288-408,430 -603,634-741
atgcctttaaaaattgcaggttgcaaacatttttttcgtcgcacaatttcgttgatgaaggaatacaactgcaaaaaaggcggagagtgcaaaggtgaaaaagggaaaaataaagcgcaaatataaatattaaaataaataaataataataataaaatttaaatttgcctttttgaatgaattaattggataagcatttttttataagctaaatttgaaagaatttcttatatattataatcttaaaaaattaaatcttagaaaaaaatttaaaattttattaaaaagatttatcatcatgtaaacgatgccgactgtacaaatgcttaacggtcggaatgaatccgcgaaatatttgtccaacaaaattgaatgacgaacaaacaatggcatttgcagaacgaatgaaagagcatccaggaaaaaatgccgtcctcaactcggttatacgaagagacggagaagggcaaaattcaattttaaactatattttaaggggactttagtttaatactcaaaaattttgttgggtaagcgcataactaagcgggatatatttttctaatgggccttctagcttgttttatggaagaaaactctcacaaaaaaatttgaaatttttttttaaattttggtaaaaattgaaaaacccaagaaagggcgtgaccaaacattgatgcaatatgtaacaatgtggaaatgtgcatttttaacgaaatttgtttaaaaaatttaattaaa

SEQ ID NO: 60567 - DNA, 716 bp, Heterodera glycines
  Genomic contig location: Contig_ID=SeqID_6163; Location=3291..4006; Strand=-
  SCN-specific regions: Sequence locations=1-266,290-365,387-388,413-716
atgatggatcaacaatgggcatgtggaacacttagaggcaagacacaaacaacaatttacggagttgaaatccgggaatttgcttcaaaaacaggaacaaaaggttaaccaataagtttttttaattttttacgtttgaaaattaccggtttttacctgtaccggtttttgcattaccggtcagtaccggtaccggattttttacaattaccgattaccgtgcaactctactcccaggtttaccaacgtttgaaaattaccggtttttaccggtaccggtttttgcattaccggtcagtaccggcaccggattttttacaattaccgattaccgtgcaactctactcccaggtttaccatcctttataataatttttgaaaattttaggattattctcattttttggtgatgcgaccctaaagaataattttcattataattgtaaaaattatcgttaagttaaaacgaaatacaaattgttacttcattatatctatcaacttcgtctttttgtcatattttttgtctattattattttttgaaatgccataaaaagccctgagggtgactgagcaaataatggggcgtccgtgccaaagttttgaaactttaaaggattaaaagagcaggttccatttggaggtggggttgtaatatatctgaaatatatcactcccatgtttagtattttagggactagggtataataataaa

SEQ ID NO: 60568 - DNA, 196 bp, Heterodera glycines
  Genomic contig location: Contig_ID=SeqID_30129; Location=471..666; Strand=-
  SCN-specific regions: Sequence locations=1-196
atttttctggtcaaagccaaaaccacggtagacaataaaacaataccggatgatttcacaataaaattgtcgacactgttcaactatggcgattctgtccgactgtccgtgcagcctgaacatggcgcccgaaatcaaagcaacaacaattttatgttcattttcatgcacgaatcgttggaagagaatggaaaga

SEQ ID NO: 60569 - DNA, 719 bp, Heterodera glycines
  Genomic contig location: Contig_ID=SeqID_6166; Location=239..957; Strand=-
  SCN-specific regions: Sequence locations=1-719
atgatcacaatttgcacttcggaagagcaatggacgaacggaaaaatagaagggacagaagggacggaagagacatttcggaagagagtggcggaggcggtcagggaggaggtggtggcgcggatgcgcgccatggatgacttggcggagttggactatgcggaggaagtgattcggcactacgtggaaagggccgcgggggacggccccgacgcattggtcaacagagtgaggggaatttgcaggaccagcgacaattgtgtgccatgtttatccacgtgacagattagaacagactttttcctggtcggccccgctctcctcgaggcgttcgtccgttcgcgcgttggctccgcccgcgtgttcgccctcctcttccgttcatcctcaaatgtttcccaggtcgacgtggccgaagtggcggccaactcggccaatccgtgggccgcttctcagtccgtttgtgcggacgatttggtgtttaatccaacgccgcggggacaaagtgtggaagacaaagaacaaaaggacatgcgaagttttgccgaaatggttgcaaatttcgtaacttttgggtgagttggccaaattttacgaaacaaaaaacgaaaaaacatcgaattttgagggacccgaacagagaagaacggaggacggacaaaaacacttttacgacggtttaccaaagagaaaaggcgaattgtgaaggtgctaattaa

SEQ ID NO: 60570 - DNA, 182 bp, Heterodera glycines
  Genomic contig location: Contig_ID=SeqID_6168; Location=1142..1323; Strand=+
  SCN-specific regions: Sequence locations=1-182
gtcgaccctcgcctttactatgcgctgatgatcactgtcatcggctcgacctttcccctcatcaacgtgtccatgaacaccattttctctgctgcagttggccctcggctacaggccaagcaacagagcattctgatggtatcgggtgggatgggccgaatgctgggcccacttctaatcgg

SEQ ID NO: 60571 - DNA, 728 bp, Heterodera glycines
  Genomic contig location: Contig_ID=SeqID_30132; Location=273..1000; Strand=+
  SCN-specific regions: Sequence locations=1-210,232-241,272-392,414-728
  Gene Ontology: Mol. function=peptidase activity; Cellular component =mitochondrion; Biological process=mitochondrial intermembrane space protein import
atgattgctgccgttaatgactttgagatgacacagaagcgattccaatcggtgattgaccaggccatttacgaattccgtcgcactttttccttcactccgccgtataagcggaaaacggaagccgccaaattgatttggacaattatcggtgccaatgtggccatcttcctactctggcgagtgccaactctggtaccattgttgtggcagtatttctccagtggtgtcgcttcgagtgaggcttttttggggggaggggtgggcacagtttggtggtgccgatattcctatttttgaactacaaatttcaatgatcgagtgtttattccacttttcagaaagtctttgcatgccaatgcttttcagtgtgttctcccaccaaaatctcatgcatttgttcttcaacatgtacgtgttgaatagctttgctatcggtgcaattacccttttgggtccgtctcaggttttttttttggtttttatgaaatcattattaatggttgtgtccgaacccaaattaattcgacccagtcgttaaaattaaattcaaaacgcatatactcaaatggaattttttttggccatctaataatgtgtgtccctttcagttcttggcaatgtatttgagtggcggtctgttcagttcgtgggtgtctctgtgccaaaaggccgttatgcgcagcacaatgccatcgctgggcgccagcggcgcaatttgtgacgtg

SEQ ID NO: 60572 - DNA, 52 bp, Heterodera glycines
  Genomic contig location: Contig_ID=SeqID_30135; Location=1198..1249; Strand=+
  SCN-specific regions: Sequence locations=1-52
aacaattgcgggagaagctgcgctcgttgcaggaatacggcgacttcaagca

SEQ ID NO: 60573 - DNA, 647 bp, Heterodera glycines
  Genomic contig location: Contig_ID=SeqID_30136; Location=1275..1921; Strand=-
  SCN-specific regions: Sequence locations=1-647
ttttttcaagtgtccgtttggggtacgcaaacacttttggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 60574 - DNA, 642 bp, Heterodera glycines
  Genomic contig location: Contig_ID=SeqID_30139; Location=17..658; Strand=-
  SCN-specific regions: Sequence locations=1-72,95-104,126-443,467-642
atgtttcgcggtccgttcactctaattctctcgggggctactgggagtggtaagacccgttggctattacggtttttaaaacatcataagaatctaattgaaccatcgcctaagaaaattctttattgttatggtgagatgaatgatagtattttaggattaatcggggagggcgttgagacttttaacgggattccggacatgaataagattaaagaacaggaaaaaccccttttgttaatacttgatgatttaatgcttaatatgcagaatactttcctcgatctactctttaccaggggctcccataattggaacgtaagcgtaatttttgtaacccaaagtctctatggtcgggacattaaaacggcaagagccaacgcacattatctggttttaatgcgcaacccttccggccaattacaagtgagaacattggggtcacaactgttcccaaaaagactgaattatttcatggatgcatatcatgatgcgaccaataatcaatttagttatctcatgattaacatgcacccaaattctgaggaggaatttagattatgtagcaaaatttttccagatgagactctggaaatttatttaccaattgaatagtatataagaatatgaatttaaattaaa

SEQ ID NO: 60575 - DNA, 414 bp, Heterodera glycines
  Genomic contig location: Contig_ID=SeqID_30139; Location=942..1355; Strand=+
  SCN-specific regions: Sequence locations=1-224,246-414
  Gene Ontology: Mol. function=general RNA polymerase II transcription factor activity; Cellular component=transcription factor TFIID complex; Biological process=regulation of transcription, DNA -dependent
atgcaaaaaccgataatcgtaaatataattgctctcgctaatctcggtaccggaattaaactaaactctctgacgatcaccgagtgtgaatttaagtataaccctagaaaattcaatgccgcggttatcaaatgtgcaagccccatcaaagccacggcattattatgggaatccgggaaaatgatatgtctggggacgaaaagtctgatagactgtgaaaatgctattaaaaattttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatatgttgcggtttaaatttcaagacggggtaa

SEQ ID NO: 60576 - DNA, 1415 bp, Heterodera glycines; identical to SEQ ID NO: 30140
  misc_feature (1273)..(1273): n is a, c, g, or t
  Genomic contig location: Contig_ID=SeqID_30140; Location=1..1415; Strand=+
  SCN-specific regions: Sequence locations=1-437,459-518,572-585,607 -985,1007-1135,1163-1415
  Gene Ontology: Mol. function=protein binding; Cellular component =cytoplasm; Biological process=signal transduction

SEQ ID NO: 60577 - DNA, 1454 bp, Heterodera glycines
  Genomic contig location: Contig_ID=SeqID_6171; Location=853..2306; Strand=-
  SCN-specific regions: Sequence locations=1-345,376-920,968-1259,1285 -1454
  Gene Ontology: Mol. function=protein binding; Cellular component =cytoplasm
ggaagtgtattgtggaccagaaagtgtgtgctcgctggacggattgcatttcaacactttgtacagtgcgcgagtgagggcattcaatgggtcgggcgaaggcccttacagcgaactgatcagtctgcagacagccccaggcaatgatcgaaacaattagcactcatttgtcagggagaaacccgaaaaacgttttcattcagaattctgcccgggaaaattgtccttgttagctcaaaaggttgacccccgcctttgggggcgaattgccatgggaaaacacccgaaaaataatcaaatcactattaaccgtctgcttttttcaatctttgtgctcaagttttgattttctcttctaaaataacatttgtatgggaatttgctgtgccaagggaacacccctgccttcgtgaaactttcgggaacatggcgcgacatttggggttatctcgggtagccttcgggattaatccgcctcccccccccattttaccccataaattgtccctctctttcagttgcctggttccatctcagccccgatgattcctcctctgtcccttcctcctccaccgctgccgagtccgcttcttcttcagctgaagttggcctcggcattgccatgcgcagttcttccccgctcccaatcgctgaaggggacgatttgctgctgcttttctccaacgattgttgtaccgtaaccggcgcgtccattgactaccgtaccgtgctgggcacagtgaccttttcgcaaggcattcattactgggaggcgagcgtggaccggtacgacgggaacgcagacgttgtgatcggagtggcacagccaccggtcaaccgaagggcgatgctcggtgagaccaaaaatgggaggagcgaagactaattaactaattggtcattgtaatgggacatacaaacaaaaaataattaattaattagctaattttccattttaaaattttgtctaatcaggaaaagatgcgcatggctggagtatgtacgtggacgggcagcgctcgtggtttttccacgcggacactcaccacgggcggatgagcagcggggtgatcggctgcggaagtgtgatcggagtggcgatggactgcgaccggggcacgctcagcttcgccatcaatggcacgccgctttgtgtacacgcatttaagtcggtggacggggaaaagacagagggggagggcagaacgttgccgcaggggacatttgcggataatcggaaaaattaaaaaaaaattgaattttttctaaaaagtgaatggaaaaaatcagttaaccccattccctgaagcttcgattaaaattaaacttgcaaattaaaaaataattagccttatttgtacagaaacatgccccgcggccttttctgtccggcattcagcgtcaattccaaggcgaccattacagtacacagtgggctgaagttaccggaagtt

SEQ ID NO: 60578 - DNA, 2629 bp, Heterodera glycines
  misc_feature (2594)..(2594): n is a, c, g, or t
  Genomic contig location: Contig_ID=SeqID_6172; Location=1..2629; Strand=-
  SCN-specific regions: Sequence locations=1-157,249-346,368-612,778 -1170,1192-1291,1314-1367,1390-1964,2014-2090,2112-2140,2174-2629
  Gene Ontology: Mol. function=protein binding; Cellular component =cytoplasm
ctttgggttatgcgaaatggagcccacccccggcacactttattctctgctgcttcttcgcccctcgagagttgggagtgcgggaaaatgtaattgaataatgaccgacgaataaatgaatgaatttgaatgaataacggagaacgccatagagagaaagagaaagaggaaagagaaagaaagagggaaaaacaaaagaaaaaagagaaaagaaagagggaaaaacaaaagaaaaaagagaaaagaaagttgccaattttaaaagcaattaatgccactttggcagaaatgtacgggattcatttattagcaatttgcgagggtggcaagcagcaaaagtgcaaatgagagatgctaataaatttttaatttgaatccgatcgtttaaatccgttccctcaaagagtgaccgccgcccacggccgacgccaattgtttatttgcccacaaagactcatttcatggtcgaccaatagcctcaaagtgttcgttttcgtcctttatgtgtttgtcataggcattcctttgttctttgtatttaaagttgaggaaaagaaaaagccgccccggggggacaaacggacaaacagtcgaaaaaggggacaaattgccaaaaaggacaaaatgaaagaacagacaaatagcggggaacggagacaaacaaaataggacaaaagaagggaaaggcgaaggaaaagtcaaaaatggtaaagggacaaattaagaaatgaacaaaaaaacagacaaatgttcaaggaaaaagcaaatgaaaaaaaattaaaccgcaaatggacaaagtgtcgaaaaagacaattggaagaaaaaggacaacggaaaaaattgctaatgatgggagacaaattattaaactgagccaaatgtaaagacaaatgacaaatttgtgattggacactcatcagaaaaaaagggggaaaaagatggatgattaattggatggatttacaatgaaaaaaaaatgaaaaaggatataggaacgaaagataataatgaaagggacaatttgcaaaagacatctttttaaattcagaccgaattgtcccaatcgctgcaaatgctcagtgccaaagtgcgacaagcgaccgaagacatcacggcattgaaacagttgcaaaacgaaatcgacgtaggtgttgggtaggagacaaaagatggaaacttgggaatggcagatcagagagaaagaggggggggggggggggattttggcatttctttgggcttaatatattcgtaagcatatttggtaattaacgattaatgttataatgttaatgttggtgggtggtgccacatcagcagatggttaaccaaactcaatatttttcattctggggaaatgtttaaagccaaaaaaggaagtgaatttttggtgccataaaacaattcgcttgtttctgttctaatgaggaaaagctttgcacgttaaaggccaattgcgacgcgttcagccgaggcattgagcgagagatggacgaactgatcgcccttctccaactgcgaaggcaacagctgactgatttcgccgcgggggaaaaggagcggaggaaagcgcagttgcgggaacagatcggacggtctacggcacaactcggtcggaacagggcactgatccaattttgcatcgaacttctgaaggagtccgacccggcggcgtatttgcaggtgatcggagtaatcagaaccgggtggacattaattgtatatttaatgatcttccaaaggttggcttcgcgttggcctcccgtgtgactgaccaggaattcctttggcaccgcgagatcagaaccaagcccgaggtggaggtccaattcgaattcgacatcgattcggcacaacttcggacggccatcgatcagttggaatttattcagttgaaaggtgagtcactcacgacaattttcttttgttttttgcttccatttgcgtttaattgctctccaaacaaaaaaataaataaaaagttattttaattaaatattttaattaaattttgaaacctaagaaattggagagaagcaacacaaaaatgaggccggaccaattgagagaggaggtgggcaagaggaaatggaaatgccatttccaattgtttatttccacgccaaggaaatgaaatttcatttttaatattttaatttttaaacaaaattttgtggaaatcatttggaaaatgacaagaatttgtcgtgtgttttgtgaagaaagtctcagtttttgtggtgtcctccaaatgcatttttaggtaattcgaagttgtttttgccattagcttatcccattttcccaaatgcctcctcttccttcgttttgatagggtcgttttgcgtgccaattcgaatgagtgacaaaaattcactttccataatctttggtcgaatttttagatattttgtacaattttttgggatttttttttttgaaatattgcagggtcattaagcccaaatatttgatttaccgggaaattgaaaatttattggcactctcgcgccgaatcggccatggataatgaatgccatccgaagaatcatttgccgattttccattgttcagcgccttctgcgccccaattngtggcggatgaatgttcagcggagaacaattcgat

SEQ ID NO: 60579 - DNA, 312 bp, Heterodera glycines
  Genomic contig location: Contig_ID=SeqID_30145; Location=289..600; Strand=+
  SCN-specific regions: Sequence locations=23-220,243-312
atgcagcaatttggctgcctttccctgttccccgttggcatttcagccgggctattaataatgccaatgcttttgctgttactgatgccatcatccactgatggcattgaaattgtagtgaatgttgatgaaaatattgccaatgaaatcaatcagcagcaaatcactgtcaaggtcagggcttctaggggtacagctgcttatttgagaaagcttgctgatttttggggaaagaaaccttcagaaatggccatttttagcctgtcgacatcgccggccccaaatttccctaacattttcaaaatttgacca

SEQ ID NO: 60580 - DNA, 1040 bp, Heterodera glycines
  Genomic contig location: Contig_ID=SeqID_30148; Location=91..1130; Strand=+
  SCN-specific regions: Sequence locations=1-504,527-692,838-1040
atgaaagtcaccaaattgggaaggtaaaatgacatttattaactaattaaattcacaaaattcgcataaaattattgtttttgtgcattttttgttaattttcatatatttacatttttatagttttgtctcgattggattcgccaccaaggaaatgccactggacggagcaatcggacagcatttgaacagttacgggtaccgaagcgatggctcatttggctgcaatggtatcagtcggccgtataaaatgggatttggcaccatgccaatgccattcaacgcggcgattggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacacaaaacgaaaaagcaaataatttcaatttcaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacggaaagggcgattactcatttaattaattaattaattcaataatctttttttctttattttatttttaattttttatattattttatgatgtatttgttaatcagataattttctgtttttttattcacttttattttctgtttttccttttttatgtaaagatttggttaaaaagagaccaccgaagaaaatcttgaagttgaagtaattagtaattttgaagaaattgctaaaactattaaattccccaaatttcctctttgttctttccactcattttggtgccattttattaatatttaaaatcgtttaatgggcctttttattaattttttcgcacttccagcagaggcaacaa

SEQ ID NO: 60581 - DNA, 583 bp, Heterodera glycines
  Genomic contig location: Contig_ID=SeqID_30149; Location=689..1271; Strand=+
  SCN-specific regions: Sequence locations=1-245,269-411,433-583
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttgaggtactcaaacatttatggggagcaaaaatccaacgcagaattatagtacaggctatagggaagctattctcgaaggattcggtctccccataaatctgggcgcatcggttcggggggactgccccgaaacaaaaaaatcgatttttcaagtgtccgtttggggtactcaaacaattat

SEQ ID NO: 60582 - DNA, 155 bp, Heterodera glycines
  Genomic contig location: Contig_ID=SeqID_30149; Location=1887..2041; Strand=+
  SCN-specific regions: Sequence locations=1-32,59-155
taagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaa

SEQ ID NO: 60583 - DNA, 134 bp, Heterodera glycines
  Genomic contig location: Contig_ID=SeqID_30151; Location=391..524; Strand=-
  SCN-specific regions: Sequence locations=1-134
caggcctcgacacgacctccgccgaactgtccgtgttggagtccatcttcaaattgggagacgcggcgccgagcgcaatttccaccgatttgcgcgacactttgatagaatcgatgctttgaaagaccaaattt

SEQ ID NO: 60584 - DNA, 1711 bp, Heterodera glycines
  Genomic contig location: Contig_ID=SeqID_6173; Location=416..2126; Strand=+
  SCN-specific regions: Sequence locations=1-315,338-514,537-568,590 -731,776-1224,1247-1619,1641-1711
atgaacgtcgaagaatcgcctcttttgacggagtttaagacctttcttcaggcgactcttgtcgcattcggaagcgacggagcacttttctcactggtcaatcagaaattcaggttcaaaaattggccagccctaaaatcgagtcaatgatttgtcttgtttgattttagcgaggattgggttggctcgccctctctcaaggaatacgcgaccaaattgggtttcgccggttcaaaaggcatcctcaaattgctgcagtccattcccgaccaggtcattgagcagtgcgttatggtctctaatcgctgcaataatttacatgtgatcattttgaaggtgtcaattttggtgaatccgaccggagaagtgattttgaagcccgtccctatggaggagacgcgcgacaatctggccaaaattgacgcgaccaacagagagctcaaagcgtgtgttatttgtttgggacagctaacttcctaccggctttcctcccccccccccacccctcccgcactcgaaaattttaaaattacataggttttattttaaaaaaagtttgaagaaatctaaacctccattttggaaaatcagctttgttttccttttgaaaaatctgtttgttctttttcgatttttggtgaatttttttaaaataaagtttcgaattttggtttaattcgggccctgggttcgaaattgatgacgcattcgtgatcagcgatcccgaaaactaaatattgtttttttttgtttaattgaaaaaaatataaaaaatgtggggcctaaacggaatgagagccagaaaattctatgtgtttgaatttctcaatccaacagtttatttatgaaatttttcttcgaatttcaaactcatgctttgctaacaaacgtcctttgctttgcagtgagaaaatgcgacgccaacaattccatgggcctcttccggcggctgtcactgcgcaattggccgctgcgatgatgccgggttggccacccaagtgccggtgcatccgttggcctcagttttcaatgcgagcatcaaacgcaccgcaacgactccgtccaatgctggacttttcccagcaccggcgaagaagaaaatcaatcccaatttgattccacttgaaccgactcgtattgcacagtgtgacagtaccaataacatcgtggacaatggcaatgccaataaagtcaccagcggtgtcagttgcagtgccagcaaaattaccaacaatgccaatggaaatgccagcaaagttcccagcggtgccaataaaatcaccaacaatgccaatggaaatgccagcaaagttcccagcgcttccaatcgaagtcccagcaaagttaccagcggtgccaataaaatcaccaacaatgccaatggaaatgccagcaaaagcggtgctaatggaagggccaataaagtcacaaacggtgccaatgctagtgccggcaaagttcccagcgcttccaatcgaagacccagcaaagttaccagcggtgccaatataattaccaacagtaccaatggaagtgccaaaattgcgcgaaatgccggtgctattgggacaaacggttcgacggcggtgacacgaacgacgagcgcaactgagcaacggcagcagaacatcaagatcaggaaagtgagctttgagaaggcgatgagatacatggagagggaggcgtggaagcaagcggagaagcgaagcga

SEQ ID NO: 60585 - DNA, 86 bp, Heterodera glycines; identical to SEQ ID NO: 57243
  Genomic contig location: Contig_ID=SeqID_6173; Location=1..86; Strand=-
  SCN-specific regions: Sequence locations=1-86

SEQ ID NO: 60586 - DNA, 746 bp, Heterodera glycines
  Genomic contig location: Contig_ID=SeqID_6174; Location=3710..4455; Strand=-
  SCN-specific regions: Sequence locations=1-117,150-746
ccctaatattatgctcactttatccaataatggattttttctgaatttctttttcatttttgtgctgatttatgcaactaattacggatatgctttatttgctgttgtgagtaatttttacatattaaattatttcaatgcttaaatatcttttcccagcaaaatgaacgccggcaattggatagtctcgacggtttgtggacctttgtgagagagcccccgaatagtgtcgggattggtctccaaaaccaatgggcttcgttggaattggccctgtttgaggtcagctgagccacaccaaggcaatgaattgttttggcagcccaaaaaagtgtctgttctgaatgtttggtgcagaattcttcacaaattcccgtcccttcggctttcaacgatttgacggcggacagtgagcagcgcgaccatgtcggatgggtgtggtaccaacgcaaatactttttgtctcattttttgcgggacgcgtcacccaacggaagaagatcatttttgcgttttgaaagtgtcaattattacgcttttgtggtaggactttgttggacatttgtgaaatttgtcgcagttttcagtttgtaaatggaaaattggtgacggaacattgtggcgggcatttgccattccaagtcgaagtcgaactcgtcgatgtcaacctcatttcggtggcggtcaacaacactttgtcacatgacacaattccgcccggcgatttcgccaccataaaactgtga

SEQ ID NO: 60587 - DNA, 462 bp, Heterodera glycines
  Genomic contig location: Contig_ID=SeqID_30152; Location=749..1210; Strand=-
  SCN-specific regions: Sequence locations=1-462
tagctaacaccggagctccaaacatcatgggacttgattggattgtgccgtttgagaaggctacgcagtctcccatcgcgacaacattggatttgtcaagcgccccaacaaaagtcaacacaattgatgaacgtccccgtcatttcaaaatcggtgacactgttcgtgtgttgaactacggaaaatctggcaagcctaactggcttgaaggcaaagtcgtcgctggtaaaggtctgatttggaaagtcaaaattccattgttgaatattactgtcaacagacatgtaaaccaaatgcgttcttttgtcccttatcaatcagaaacgacgtttccgaatgatacagttgaccaagttccgcaacaaaagagtccttgccacagcactgtcacgactactccgccgaccaacttgccagttcaaccaacgcaacgtcctcagagacaacgccgtccgccgatac

SEQ ID NO: 60588 - DNA, 541 bp, Heterodera glycines
  misc_feature (515)..(515): n is a, c, g, or t
  Genomic contig location: Contig_ID=SeqID_30155; Location=695..1235; Strand=+
  SCN-specific regions: Sequence locations=1-114,137-332,424-455,479-541
atgacaaaaaatggttagccaattttaagcaagacttagctgaagttcaccatttgttgttggaaaatttgttagaaaactcgaaaaatactaattttgatactgtaccgatgcgaaaattggcagatattttttccaacaaaaaagcaatttgggaaaatgaattgacattccgtctacgaatggttgtttttttgaagaatgctttaaatccaaacttaatgaaaacgctgatcaaagatcggatttacgaaatatttggggcgaaaaatgccgaaattacgcaccaattgtacgacaaatacccatcattaacatatggaattggtgacttaatataaactataatttttttttaaattcagaaaatcaaatcatattaaaaattataaatatattttttcaaaaaaataataatattttcgccaaaatttgaatttttaaatgagtttgtgaaaatatttttaacatttttatgaggaagtttttgcttacaaaaaaaaaagaaaatttanatatctttcattcggttttttgtcaa

SEQ ID NO: 60589 - DNA, 951 bp, Heterodera glycines
  misc_feature (938)..(938): n is a, c, g, or t
  Genomic contig location: Contig_ID=SeqID_30155; Location=1370..2320; Strand=+
  SCN-specific regions: Sequence locations=1-40,62-226,248-392,418 -424,446-951
atggatttttttgcctattttcatgccattgaagtgatttttgaacaaaaagaatacccaataagtgaatggccaaagcttcgaattcaatgtgctcaattaattgatacaattccattagaggtaaattttaccgaaaatgatgaaattatgaaaatgataaatgagctcaatgcaaaaattggcaaaatgcaatcatttttaaaggagaacaaaaattgcatggatgagaaacaaattgagaaaaccagcaacgaacttgagaaaaagattgaactgttaaagatacttaagcaaatttctaatgagattgatcagttgttagctagagaaaatcaggacgaagcccaggaggaggagggtaggaaattgtatgaaaaagttaaaaaaattcaatcagaatttgaagaaattgagctgggtgatcagcagaagcagcagcatttgttgtcagatgttgaatttggatcggaggacagtaaagaatttgaaaaggataaaacttttggattaggagaccaaaatgggcaaaacgttgagttctccggatcaaggcctgatcaaaacaagcaaactgacaacacagattatgatcagtatccatcatcatctaatgaaatgaggtccaatactgctgctgatcgtaatcaatcgtatgccaaatatggacaatttatacctgctgatcagcagattggatcagatgccgaaaataaagctagaagttcaaaaaattgtggcactgtaccaaatccaccgtttatcaatttgaagacactttttttgttgaaagcggacatggaaaagcttaaatcaaatgacaaaaaagaaaaggaatcgaaaaataagaacaaaagcaaagaacggaaggcaaattcaattgatgatttaacggcagtgcagaatgatttaagccaaatgcatgtgcaaacaatggnaaaagtgcccatg

SEQ ID NO: 60590 - DNA, 386 bp, Heterodera glycines
  Genomic contig location: Contig_ID=SeqID_30156; Location=90..475; Strand=-
  SCN-specific regions: Sequence locations=1-81,103-198,221-386
atggttagcatggaccatccgaacgccgacttttattttgatcgcgatgtgcaatgtgtacgcacctttttcaatcggagatttaagtttgagtcagaggattggccccgttttggggacatggtcagaagacgcaatttggacgtggaattggaggcgagcggattcactcggaaaatgcgacgcgatttgaacaaagtctttttccattttggcactgatgtgccatcacagtgaatgatttacaggcatatgacgagggaaactttgaggcgcatttggccgaggacagtgaagaggaaacggaggatggatcatctagggatgaaacagaggagcaacaaaaggaaggcgacgaggaggaaaagcacgagggggagcaaatg

SEQ ID NO: 60591 - DNA, 127 bp, Heterodera glycines
  misc_feature (12)..(12): n is a, c, g, or t
  Genomic contig location: Contig_ID=SeqID_30158; Location=691..817; Strand=+
  SCN-specific regions: Sequence locations=1-21,49-127
aaattgtacaanacttactagttttaaaaaaaaaaattaaaaaatttacgacttttcatcaaaaatttcggaagtcggaattccgacccccaaaaatgttggaaatcggaagtctttccgtgccata

SEQ ID NO: 60592 - DNA, 1185 bp, Heterodera glycines
  misc_feature (730)..(730): n is a, c, g, or t
  misc_feature (736)..(736): n is a, c, g, or t
  Genomic contig location: Contig_ID=SeqID_30158; Location=1148..2332; Strand=-
  SCN-specific regions: Sequence locations=1-158,182-338,361-487,510 -517,540-697,720-900,934-1185
actcaacccaccaacatttcaatcactggggactcaatccaccaacatttcaatcactgggactcaacccaccaacatttcaatcactgggactcaacccaccaacatttcaatcactgggactcaacccaccaacatttcaatcactgggactcaacccaccagcattccaatcactggcactcaattctcctgcatttcaatcactgggactcaacccaccaacatttcaatcactgggactcaacccaccaacatttcaatcactgggactcaattctcctgcatttcaatcactgggactcaacccaccaacatttcaatcactgggactcaacccaccagcattccaatcactgggactcaacccaacagcattccaatcactgggactcaattctcctgcatttcaatcacttgggctcaacccaacagcattctaatcactgggactcaactctccagcattcaatcactgggactcaacccaccagcattccaatcactgggactcaacccaccagcattccaatcactgggactcaattctcctgcatttcaatcactggcactcaattctcctgcattccaatcactggcactcaattctcctgcatttcaatcactggcactcaattctcctgcatttcaatcactggcactcaattctcctgcattacaatcactggcactcaacccaccagcattccaatcactgggactcaaccgntacggngggccttcggccccactcaccaaatttttgcgtcaaaggtactcactcggccgcttcgcggactcgcactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacacaacaaagaaaaaaaagaaacatttttaagaccgttttttacacaaaatgacaaaagaaaaaaaatgtaaaacaaaaacatttcatttttcaaagcatttatacaacacaacacaatgttaatattataggattttcttagtgaacaaactaatgagtgtcctctttcttttgttaaattttttatacaataaa

SEQ ID NO: 60593 - DNA, 1135 bp, Heterodera glycines
  Genomic contig location: Contig_ID=SeqID_30159; Location=56..1190; Strand=-
  SCN-specific regions: Sequence locations=1-232,269-279,305-603,625 -804,842-1135
  Gene Ontology: Mol. function=lysine-tRNA ligase activity; Cellular component=cytoplasm; Biological process=tRNA modification
atggttttcacaaaattttccacctaaattttctctgttttttaggtcgtgctgttgaccccctgtttgcacatgctcccggtgagtatcgtctctataaatttcaaataaatttttgtttttaagcgctcacattttggcatcaaaaacatcgagacacggtaattttacaatttacttgcctcttgaacattggattttgatcattttattcgcgcgaagtgattcgcagattttttcaaaaaaaaaaaattttttttttttttttgcttacgttagaaattcttttttgttggttttcctcacgagttacggtatttttcattccgttcagctaccgtatgcgctacttggatctgatcgtgaacccggaagtgcgtgacaagttcgtgacgcgcgcaaaaattatcacatttttgcgcaaatatttggacgcgctcggctttcttgaaggttttttttgttttccagttttttttttgcgaaaatttagaattttatacaagaaatttttgtttttttttggagtgcatttcattccctccccccgtcgttttccatccgaaattttttttttaatttgcaaagcgctgaatgtttttctaaaaaagaaattctagaaattttcttaagaaaaaatttcctaaaatttttttttgaaattaatgtttgaaaatttttttttcaaatcggggaaagggggaagtgacatgctccgatcttttagcatgtccgaatttgcatgtttgaaaaaaattcacccgaattattcgagtcaattaggatccaaaactggaaattacgaaaaattgatttttaaaaaattttattaaaaaaaattccggaatttttagtcgaaactccgatcatgaacccaatcgctggcggtgcgactgcgaaaccgttcaccacgcaccacaacgacttggacatgaagctgtacttgcgcgtggcgcccgagctgtaccacaaggcagcatttatattttttaatgaaaaattctagggcaaagcaattggtttttaaccccttacccgtttccaaaaatttttgtaccaaaattcgaattttttgaaaaaaaatctatggcgtttgaattttttaatttttatgagtcaaattcattttattaaa

SEQ ID NO: 60594 - DNA, 655 bp, Heterodera glycines
  Genomic contig location: Contig_ID=SeqID_6175; Location=241..895; Strand=-
  SCN-specific regions: Sequence locations=1-53,79-168,209-655
atgtcttcagaaattctgtacgtttattatttctttcttttctgacatttcgcattttcttttgcttcacttttgaccagaattgggagatgcaaatttcaaaagcatttttgaaagattagctttttggaggctaaaaattcaatttcaattccctcgctttgatgcttttccttttcttaattaattcattcattcatttccccaatttattttcagtgtgtctaccgtgtttcttctattggtcgattgtgccaccattcttttttgcttctttttggacaatgccaaaaaacgacgacgccctcacaaaaaagaaatgtaaataaaaacaaaaattttaatatttcgaaaatttttttcaattttcagctttatctgcagcgactgttggcttttggtgttcgattttcttgcgccttctcaacttggcctcgaaattgcactgattagccatcgctttgacatttacgtggacgaacatttcaagacgcgcaaatggaaattgaacaaacaatttcttatccaatgggacattcaagaaaatgggacgaagaaaatgcaaattgtcaattccgatggaaatccattgccaatcccgcaaaatccgttgcctaacaaagtcatcggattccgagacattcatatcatgtaa

SEQ ID NO: 60595 - DNA, 1538 bp, Heterodera glycines
  Genomic contig location: Contig_ID=SeqID_6175; Location=3431..4968; Strand=+
  SCN-specific regions: Sequence locations=1-4,31-135,163-608,639 -667,689-699,721-752,774-778,811-818,848-1538
atggaaaacagcaacagcaacaacaatgaacttattggaggtggtggcaggttggcagttccggaacgaaatgtcgccttagaacaagatggagaagccgaggccgatgcggggagggaggcggataaagcggaggatgacgacgacgacggtgacgacgactactcgccgttcgctggggacaacatttttttgccagcccactggaagcctaatttctgggcccgccagttcactctggaggtgaaacagtagatgaaacattggcgcaataaaaaagctgttctcctcagacgttctgcacattgcacctggaggtcatgggacttcggaacaccatggccggcacattgagggactgtgagatgacagttggcaatttccatccaatgccacccgaagaagtgcccggcgcaatgcagcagttcgtcgcctggttcaaccacgagctggcttccgcgtcgtcatctgccgctgaattcgcagcgcgggctcagcacacgcttgtgagtagaataaattaaaaggccgatggtaattagtagggctacgatttttagttgctaaaaactgtgaaaatagttgcaaaagactttcaaatttagcgtgtaaaatcacaaaaattttatccaaaaaggaataaaaatagccaaatcagtattgagataaatcattttaaaactacaaattcttgtaaagaataattttaaaaattaatttcttaggggtgtattttcgcttttattgcgtttttgtttatatttttggaaaaaacgccaaaataatttttaaaaatttttttcaaattttcgtttgattttttcggttttgttcttaaaaacaaaaacctagaaaaatagttcgtaataactcgagaaccagtttaacaacaaccgaaaaaaacatgtttttcagtgaacaggacaaaatcacgccgccaaaatccgccgggaaaaaatcccacccccaaaatcgcgctgggacaaaatcacgccgccaaaagccacggggagctcaggaaaatattgaaaaaaactaaaaatcgtagcctcatatatcatcattttgacaaaaattgcctaaggacaaaacgccaaaaaaccccactaatttaaaaattttgccgagattttcccttgattcatccgttttacgacggcaatggaaggacctcacgcctgctgatgaacctcatcatgctgcgccgtggataccacccggtcatcctgcccgagaaaaaacgtgatgaatattacacgtggctggaggaagcttcagacaacaacaacattgagccattcataaagttcatcagcttccaccagcaatgtgctcaagacctggagcccgcgtcctccctcccctcatcctcatcctaattttcaatcactaacccatattatattgtacttatatgtgtatatattaggtatatttgagaaatgatcttcaatctcaccaattggaatttgatttgatgctctcattttctctcagactcactttttgttgaataattcattcgttcgaatatacaa

SEQ ID NO: 60596 - DNA, 438 bp, Heterodera glycines
  Genomic contig location: Contig_ID=SeqID_6175; Location=5394..5831; Strand=-
  SCN-specific regions: Sequence locations=1-438
atggacattctcccatcttttgaccgtccccaactcggcctcaaaatggcacttctttcgccacgttttgatgcgttggtggacaaacatttcgatggccaatcagaatttccaattttgagaacaatcaaaatttgcaaaggtgctgttgcagcaatgccgaaattagccgtgattatcgacgaagacaattcagtgccatttccgttgcccgaccattcgctgcttgagccatttgaattggtgaacggacgaaccaatgaaaagctgatattgatcaaagcaagcgaagatgaatgggtcgaccgatggataatgaaacggtgccaaaatggggagacgacggcggcgattcagtgggaaggcgaagaagtaaattcgagcaatttgaacaatgtgcacattgggattcacgatgtcaatatttgcattgggtga

SEQ ID NO: 60597 - DNA, 844 bp, Heterodera glycines
  Genomic contig location: Contig_ID=SeqID_30163; Location=123..966; Strand=-
  SCN-specific regions: Sequence locations=1-104,240-454,476-557,579 -678,770-844
atggatcctgctaataatgcttcttctgctgaacaggcaccgaatgtgcctttttttcgcatgcgtcgaaaaccgatgaatacgacgacgatgcgcaaacgaagggaggaggacgaaaatgaagaggaaaaacggagggaacggaagagggcggaagaggaagatgaggaggaagcgatggaagcggaagggaaaggagaaaagcagcgacagagaggggaagaaagcgacggaagtggcacttcaacagaggacgacgaaggggcgaaagcagcggcggaagcgacgcggatgaaactcgtggagagacgcaaacatttgcggggccgcaatttgatgcacacagtcggaccttatttacaccataaaaataaaaaaggtattcagactagcaaaaaacggaggagggaaattgaagcgttggcggaagaggaatcctcggaggacgaatcggacgagaagtcggggcgagaaggacagacgtcgtttgaccccgacgtgaaatttgcatccagcggaacgcagcggactgggccgagtgacatgggcgcaacggcgagaagtgaagtgagtcactccggcggaaccttcggattttagtattcaatggcatttttaggttgacactgaatatggacgtgattcgcaatctcaatttgaacggattcaagaaatgctgaagaaagagcgaatggagcgggaaaagagggaggcggaagaggaggaggacaggaagaaatacggggagaaggcgaagcgcaaggagcagccgggcacttcccagcaggtggtcacaattactattagcccatcggacattttgtctatgtaccaattaaattaa

SEQ ID NO: 60598 - DNA, 735 bp, Heterodera glycines
  Genomic contig location: Contig_ID=SeqID_30163; Location=1094..1828; Strand=+
  SCN-specific regions: Sequence locations=22-88,112-735
  Gene Ontology: Mol. function=dihydrolipoamide S-succinyltransferase activity; Cellular component=alpha-ketoglutarate dehydrogenase complex (sensu Eukarya); Biological process=energy pathways
atgaaaatccttctggcaaggccaggactgaagtgtccaaattcctcaaaaaaattaagttaaattttcaaaattttgcaatatgatcttttaaaataaaatttaaaaaatgaatgttttcattcgttttttcatttgacagacggatacatagaccaataattgtcgagcatttagccgtatctttaagctcaaaattcttgatgttttatgccaaattttctcggcatttttctccggctctgattgggcaactttctttgcttcggttggcccgttgcgctccgcgctccacgcgtctttaccatttgacacgacatttgggcgagtaacgacacaatgatttaatttaactaaaactatccaatttttggtgcatttcaggcggtgaagtggtcgaaatccaagggccggcttttgcggaatcgatctccgaaggtgacatccgctggaataagcaagtgggcgactttgtgaagacggacgacatcgtggcggaaattgagacggacaaggtttgggcatttggcctccaaaattacgtatgatggactgctttttaagacatcagtcgaagtgccagccccatttgccggcaaaatcgtggagcttttggtggaggaaggagcgaaagtattggccaaacaaaagctatacaaattggagaagggagccgaggggggtgaagggccggcgaaagaagcgaaggaggaaatgccgaaaaaggagggagaa

SEQ ID NO: 60599 - DNA, 588 bp, Heterodera glycines
  Genomic contig location: Contig_ID=SeqID_30164; Location=1006..1593; Strand=+
  SCN-specific regions: Sequence locations=1-62,84-173,196-339,365 -455,477-588
atgcattcttgcccatggtttatgagtcatctaatgagcctacctcaggtaattaataaggttgtaaattatatggactaaaaacgccaaatatggacataaaatatggactaaaaactgccaaaatataagttttaagcgctcaaaaaatccgaaaaaatggatttatagtttttaaatgccaaattttatcaaattctagcttcacaattgaaaaccaaatacatttcaattttttggttaataatctcattctttgtcagcgaaatttttcttaagcgaagaaaaacccaaaaaaattttacaaaattttggagaaattctcatttctgggggtgtattttttaaaaatttcccaaaaagtcgatctttatgagtgtatttttctctttttttgcatttttttgtggaaatttgctaaaaaggcaaaaatggcgaaatggatttattcccgaaaacccccaaaatatggatttataaaaaattgtgactctttattcagcgtgaactcaatttcctcaaattttctcgtaaaaattcaaaaaaaaattcatgaacctagccaagggtatttattcagcttgaaaa

SEQ ID NO: 60600 - DNA, 500 bp, Heterodera glycines
  Genomic contig location: Contig_ID=SeqID_30164; Location=127..626; Strand=+
  SCN-specific regions: Sequence locations=1-31,53-126,155-163,185 -295,317-427,449-500
caaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgttt

SEQ ID NO: 60601 - DNA, 470 bp, Heterodera glycines
  Genomic contig location: Contig_ID=SeqID_30169; Location=82..551; Strand=+
  SCN-specific regions: Sequence locations=1-1,24-181,204-238,261-470
cccaccagcattccaatcactggtactcaacccaccaacatttcaatcactgggactcaacccaacagcatttcaatcactgggagtcaacccaccaacatttcaatcactgggactcaacccaccagcatttcaatcactgggactcaattctcctgcatttcaatcactgggactcaacccaccagcattccaatcactgggactcaattctgcatttcaatcactggcactcaacccaccagcattccaatcactgggactcaattctcctgcatttcaatcactgggactcaacccaccagcattccaatcgccaggactcaacccaccagaatcaatcaccgagactcaattctctggcatttcaagcaacgcgactcaaattaagcaattctccgatattcttccagtctctcaatcaccagacaaaaaattgtgccaaattcatcactgcaatataatatcgt

SEQ ID NO: 60602 - DNA, 500 bp, Heterodera glycines
  Genomic contig location: Contig_ID=SeqID_30169; Location=867..1366; Strand=-
  SCN-specific regions: Sequence locations=1-278,301-466,490-500
atgttcgctgctgttgttggcgatttctgtgggaagcgcgcggatttatttatttcgggcgaaaaactcccagaaatgtttgggcaattggacagcaaggaccagcttgaactaaaacgttgttttgtcaaaattgaaggtttttgcctaattgcttttttgtttatctatgatttaattattttgtagatgagtgtatgcagcttaatgttttggcttctgatgttaatgtgtgtggatgtaaagtgacgattggtgataagttggtcactccggtcaagagaaagagtgatgaagcaatttgagtccgcaatcggctaagaaatagtgtgtttttttgtttttgcttttttctttttatctacatataaataagtgaatgtttatgtttgtatgtttattgtgaatttattttggatggtgtttagctagatttttgtatgaatttaaaagtgttgtcagttctatgtttgtatttgtgtggtgttttggatattaaa

SEQ ID NO: 60603 - DNA, 454 bp, Heterodera glycines
  Genomic contig location: Contig_ID=SeqID_30171; Location=58..511; Strand=-
  SCN-specific regions: Sequence locations=1-454
atgtcctcgtcccatgccaaagtgactgtgcttcttctgctgttcgtcattgcctttgtggcactggcagtttcggcaccgattgaagaagaagcaaatgccattgttgaagcaaacaatggcaaattagcggcttccattggcacggatgaagcaacaaggtgagatgaaatgcgatacaagacaattaatagtataattaccaaatttcttcgattattagacccgggtcttttattgaactcaaatccggttcgaaatttccttgaaattacgtgtgtttttaagtttggtacgccataaacgatacggatacggctacggctacggtagacgctatggcggctacggtggatggggcggctacggctatggcggctggggtggcggctacggatatcgcagttgttattgtggctatggcggctatggctatggctattatggaaaataa

SEQ ID NO: 60604 - DNA, 538 bp, Heterodera glycines
  Genomic contig location: Contig_ID=SeqID_6176; Location=152..689; Strand=-
  SCN-specific regions: Sequence locations=1-57,484-538
  Gene Ontology: Biological process=N-linked glycosylation
gaaagccgggtccgggtccaagtttttaaaccgggtacgggaggaacagaaagtggaagaggaacagaaagtggaagagaaagtggaagaggaacagaaagtggaagagaaagaggaacagaaagtggaagagaaagtggaagaggaacagaaagtggaagagaaagtggaagagaaagtggaagaggaacagaaagtggaagagaaagtggaagaggaacagaaagtggaagagaaagtggaagagaaagtggaagaggaacagaaagtggaagagaaagtggaagaggaacagaaagtggaagagaaagtggaagagaaagtggaagaggaagtggaagaggaacagaaagtggaagaaaaagtggatgaggaacagaaagtggaagagaaagtggaagagaaagtggaagaggaacagaaagtggaagagaaagtggaagaggaacagaaagtggaagagaaagtggaagaggaagagaaagtggaagaggaccagaaagtggaagaggaacagaaagtggaagagaaagtgtaa

SEQ ID NO: 60605 - DNA, 380 bp, Heterodera glycines
  Genomic contig location: Contig_ID=SeqID_6177; Location=370..749; Strand=+
  SCN-specific regions: Sequence locations=1-380
atgcgaacacgaaacgcactaaaaacaacgaaaatgcgaaacgcaaaacacgaaataatcaacgtccctggtatatgcccctggcattttatttatgaaattatgcatttaaattaatattttagtgttctcagcaatactctcgaatgaatgggagtttaaaatttaaactagggttgggcccccgaccgtcggggttggaaaactcggggttcggggtcgtcggggttggaagcgtcggggttcgggtcggggtcgaccaaatcgttcggggtcggtgttcggggtttttcaatttttttcttccattttttaaaatttatacaagcaaatgattcaaaattaaattcttaatcatcaataatcaattcattttcata

SEQ ID NO: 60606 - DNA, 707 bp, Heterodera glycines
  Genomic contig location: Contig_ID=SeqID_6177; Location=774..1480; Strand=-
  SCN-specific regions: Sequence locations=1-5,27-237,259-556,585 -598,623-707
atgcacaattacagagaaaatgaattattgcgaatttcaatgttgttggacccccattttgcatatgatctgaatttatttatgggtggtttctggaaatcaattgaagaggatttaattgattttgcaaaggaaagtaatttaaacaattttaaacagaattttggatcaatcagaattggctcaatttacggattttagtgaaagcgacgagagtgcgttaaaatgtaaaccattaattgaatataaaactttaatttgtaataaaaattttagtggacatttggaacagtaacccaaaatctccttgctgttcataaattacaccatcgacactttctggagaacctgtccccgccgttggcaccaaaatcgaagctcaattagcgctttacaaagatgtttaacgatttggaattgatgcggacatatttatgtggtggagggaaaacggacctcgctttcctgagttggcaaaaattgctcaaattgtgcattcaattccagcaacctccgtgtgcagcgagagactttttagcaaggctggactaatttatgcaaatagtttgagaaacaggtgaattggtttatttgatcgtaaaacaaattaaaaataattatatcttagactttccggaaaaacagtgcgacagatgttagtagttaaggcaaatatggatgatataaagctggcacctccaatttaa

SEQ ID NO: 60607 - DNA, 481 bp, Heterodera glycines
  Genomic contig location: Contig_ID=SeqID_6177; Location=1942..2422; Strand=-
  SCN-specific regions: Sequence locations=1-299,321-481
atggcaaaccgacttcaactccttcattatgaaggttttaagttctcgttatttcgtatttaattgactacttatagcattgctgtccatcatactaacaatgaattcaatcgaaacgattttgttttggacgccattcctatcgaatcacattcaggcaacgacattgcagactcaatttataatgcacttgatgaaaacggattaaaaattgtgaaattaatttccattgtccgtgatgacgcaaaaaacatgcagcgaatggctagggtcttaggaaaatcaaggtaaaacattttataaaacgaaaatgattcaaaatttaagtcatcaatgtgtggttcattttttacatcttgtggttcatgatgtactgaaattgggccaaatcaaggaacttacggacaaagtacacgaatgggtaaaattttgcctgacaaggaagggatttgatgtttgaaacgccaccaagaaaaataaa

SEQ ID NO: 60608 - DNA, 1004 bp, Heterodera glycines
  Genomic contig location: Contig_ID=SeqID_6178; Location=1116..2119; Strand=+
  SCN-specific regions: Sequence locations=1-65,95-159,181-316,353 -396,418-614,672-745,767-1004
atgatcaaaaatgtgatgaatcgtcgtcatggctcagcacattcaccaatggaaattggtaaaagaaaataaaataaatatatttattaataaacaaattctagcaattgaaaagccgataaaagcaatagaaaagaatattattagaccaaaaattgaaataaatttggaaaatgaattggatggacaaagcgccacaaactcaaacatttcgccaaatttcaaatgccctatcaacgaatatttggccgctgttgtggcttatcacggcttttactacaaagtgcccgcgaaaacaatcgcaaaaattgcaatgaatttgatttttgctgttctgttctcccaaaattggtccaccaaacagcaacagaattctgatcagccaatttttgatggcattttgatatttgaccatttttcggtgatccgtcaaaatgaatttgaatttggcgccgaagaattggcgggaaatttgaaaattgaatttaacggaacggtggaaaaagtcaaagactcacgggaaagaacacttccatcagaacagagatcgaaaaagcagatgatttggctgaaagatgtgctgtttatgagtccagagcaaataaaagtttgtcattaattgcttaattacccatttaattacccaattaaataaataaaattaaataattcaggataaaagaagcacaacaaccggcaaagacttggtgtggttcgttggtttgctgctctaccgaatgttgttcaacaacaaacaccccatggacaattgggagccaaagcgccgtttggacatggaattcatggccaagatgggcttctccaagttgaaccagttcaattgcatgtacaaaacggacgattttgtgacgggagactttggcatcgttccattgaagccgaaaagtcggtggatttggatgccggagagtgagcgagatgaaactggggaaatggcactggtggaggaacggattggcatggaacaggtggctgccaattaa

SEQ ID NO: 60609 - DNA, 357 bp, Heterodera glycines
  misc_feature (11)..(11): n is a, c, g, or t
  misc_feature (45)..(45): n is a, c, g, or t
  Genomic contig location: Contig_ID=SeqID_6179; Location=18..374; Strand=+
  SCN-specific regions: Sequence locations=1-79,102-109,167-318,340-357
atgcattcaanttattcaagatttgctggtgatgaagagtatacngcgcctcagaaaaaactgtttgatctgaccaaagtaattataattaattaattattcaacaaaattatttaattttaatttgttttgctttaattaattgatattgcatttatttttatttaaaattaatattttagatgtgccttcatacatttcctgagcatcgaatctcgcctaatttccttgagcaaatccttgttttgatttcaaactggcagatgtattgtgattaattgtcgaaagcattgcttcgttctaattagccaaaatgatttgataattcatattattgttgtaccggattgtttttaa

SEQ ID NO: 60610 - DNA, 757 bp, Heterodera glycines
  Genomic contig location: Contig_ID=SeqID_6179; Location=700..1456; Strand=-
  SCN-specific regions: Sequence locations=1-121,143-162,187-280,320 -380,411-465,497-570,593-757
atgaatgacatccaaattcaaagccaacaacacaatgtcggagggcatttacagcagaatgacaacaaattgaagcaggagttggacgaagtgattgtgaacagttacaaattcattggtttgggcggtggacggagaggcggtgccaatttgaatttggcggaacaaaaaattcaaaaacatttcgccagaaacaatttatcccaagcaatagatgaggccaatcaacgtgattttgtcaatttggaatcagaatacattgacaagcagatagtagctgatttaatttaatttaacatttatttgtttatttatttttggatttttaaatttcgaattattactagcgaaattgatgtagtcattttttttgaaacaagtaaaaaatatttcaaaaattaataatatttgtaaaacttgaaaatgattccgattaattttaattggcagccgtgcgatggtcccattatatttaatttatttttctaatattaaacagcagaacctaatattagtgttgacaggctgttccctatagttcgatattttttgaattatttcgtaaaaattcaaaaattgatcattttctaaaaaacagggacccaaaataccattaactaaacatgaacttcgatattattagctattttttcagtaaatatggcctaattttgttgaaaagtaacaaaatttcatattcttgttattgttcgatatcccagaattttctctgatagcctgcaaaaattcaaataaa

SEQ ID NO: 60611 - DNA, 1590 bp, Heterodera glycines
  Genomic contig location: Contig_ID=SeqID_30174; Location=167..1756; Strand=+
  SCN-specific regions: Sequence locations=1-507,529-584,606-793,815 -1056,1080-1106,1128-1590
  Gene Ontology: Mol. function=tachykinin receptor activity; Cellular component=integral to membrane
ttcttccaccgcaatattttcctcgcatcgccgccactcccccaggcgatgagttcccttgacgagtgcgaatcggaccccattttgggccgtccgatcattcgcattcccattattctcgcgtacatcgccgtgtttctgatctgtctgatcggtcggtcggtcttcgcttttctatttgacccatcgctcccaggcaattcgttcgcaattctcgtcatttgtgcccaccgttccatgcgcaccgccaccaatttctttttggctaatctcgccgttgcggaccttttggttgccattttttgcattttctaggcaaactcttctccccgaagcaataggcattctcactttgttgtagaatatgttccatttggttggcattgtcaccaacgacggacgttggcttttcggtgagaatggtcaaatggcgtgccattcactcatccttcgctttgaggtgccactttgtgcaaattgtacgcgttcgtacttcacctcttcccctgcaccagcattggcattctcgtctgcgcctctgtcgagaaatacatcgccggtttgctttccaagtgtgccttccccttttaaagtgaacattcgttttggtgctccacccgcttttggccctcaaagtgttcaccccgcgcttccgcgttttgctaatggcctccatttgggccatttctctcctgttcagcttgccctattacattttcaccagttacatcttttacaagaatgttgcggtgtgtactcggttgatgcctttgactaattcgacaaaaaggtcgaaaaatgcttaaaaagggaagaggggcgctttttgtgccaaaatctttgataagctttaaaattttccccggatttttttttggcttgaagaaaagtccttggattctattctctctgcgaattatttctggttccggcgttggccacagttatttagtggtggggagtgtttcgaattttgttgtttcatctgctaactgattggaattgtcacaggttaacaatgtcctctccttttgagcacgcgttaccgaattttccattattattattattaaattttagctgtcattgtgattccaattcccttatctctaaaaaagcaatgtgtttgtttggaagggtttgttgtgaaagatacgataaaagggcagatgaatggtgcaaaactggaaaattgattagcaattagaattggacaacgacaaaatgggaaaaatgtgcccattgattgagtgaaggggcgggggcggcaaaaacaatcgcttcattcgccgctttcactggcattctccgatcagtctgatgagcacccgaaacatcgtcacctcctccttcgtcctttggtactgcgttccgttgctgatcatcctctttctttacactcgcaatggtttggtcctgtggcatagtgcgccgctgaagaaactgacccaagtgggcaaattgcgaacaaacagcaacggttggttaagagaagggaaagcaaaggatcagcacaaaaaggcgattgatcattgatcagagacgacgacaattgcctcggggataggcagtgccaaaacaagagccaaa

SEQ ID NO: 60612 - DNA, 1352 bp, Heterodera glycines
  Genomic contig location: Contig_ID=SeqID_30175; Location=34..1385; Strand=-
  SCN-specific regions: Sequence locations=1-77,101-101,153-339,667 -779,843-924,964-1074,1103-1296,1339-1352
cttgcaaattcatttattactgggcatgcaatattcagcataatcattgtcctaaatccagtaaatcaggccgctgaaaaatttttcaaaattccaccaagtaaatttaaaatttatttttgtattttttctaactttattttttttaattagaatttggcatccaacgtattttggtccgtgccattgtgatgggaatggcaatttttgtggccgaatctgtgccaacatttggcccattgttggatttgagtggaggctcaacgcaaagctcaatgtctttgatatttccgccaatttgttatttgtttttgaacgccgctgagaagtatgaaaaagaaaataaaaataaattttatataataaaaatttagatattaaaataacatttaaaaaatttttcatttatttttaaaaataattttacatttttaatatttatttaaattttcaaacaattttaaagaagataaatttattgtatttctataataaataataaattaatatcttcaataacaaagaattatcgtattaaagaaacaattatttaaatattacaataataactgataataaatttatttgcataaatactcagcaattttacatttaaaagtaaattaatatattatttttttttattttaattttttttatatatttgaatttttcatgaaaacggaaatgcgccgagcatggttaaataaggctgacaagcaaaaggagaagcattttgaatcctttcaacaacgagccaccatttctgagtgacaacgaaaataaatcaaaataaaatatttttaatcaaaaaatataaatagtaaattttaatttaattacctaattgctttagtgtgatcaattttacggaacctaaactgttgtttttctgcacttttattagcggtgacaattttgcacaatttttttttttataaataattttattttaataatttagtattcggtcttttgggaggatttgcggcaacattttcggcaattcgggcacttacatcaacacattttgtcccaccatgttacgtttcggcactaatttctgcttcagtcaatgatgtaattaatgaataaataaaaatcggatttttacacacaaaaattcacggattttgagaaaattaagattttctatctcaattgtttctaaatttcttttttttcaattttaggaagacaaaagcattgctggtggcccagtaaattgttgtggcgccttccaaaacatctcaatttacggcgagaatggagcctattgttcaagagtggatcttcatttttatgaataaaactaaattttttatttaaagaattaatgtgatgggaataaa

SEQ ID NO: 60613 - DNA, 839 bp, Heterodera glycines
  Genomic contig location: Contig_ID=SeqID_30176; Location=58..896; Strand=+
  SCN-specific regions: Sequence locations=1-107,130-360,382-635,674-839
atgagtgatttcgacagtgaagttcggctccgaccggttcgtccccgttgctaataatttttctcattacccatcaaattaaatatatgttggtatcattcgagagctatataaaatttaaaaaattttggtcagttaaaaaaaaagttatggccaaaaacctcaaaaatcaactttgagcttgttaccagatttgctatcgtgaactgacaaagaaaaaagttatagcatttctaatttgttggcgccgaaacgggccgtgccgaactgatctcggccctattttaagggggggggggggggagagaccgaattatcagggctgctgctttaatttaattgatgggcacactaattaggagtttatacaatatttgttttccaactagtccaaagagaaggggcagatttaatttggatttttgttttgaattttttatgaaaaatggtgaaattcaaaaattttaaaaattaaatggcttttgtatgtgaaatgaaaattttcaacatttaagctcacttgtatgatttatctgagtacggtttcttcactgaaattttcagttgattgttagcaaaaacatttgtcgaacaaatgagtacaagtgtaaaaagaagaataatattcattgatctttattaaaattttgcataaatattaaaattattcattgttattttgattgcctaaagcaatatgtttcataatgttaatgactacctaaattcgtaattacctccccataaatgccacgaacacaaattgatttattttatggttttgtaaaaaaagccaatttccgatttatttggcatacctatgtttacgtttgtgacaa

SEQ ID NO: 60614 - DNA, 940 bp, Heterodera glycines
  Genomic contig location: Contig_ID=SeqID_30177; Location=1..940; Strand=-
  SCN-specific regions: Sequence locations=1-183,205-346,368-812,834-940
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaatttggtgcgcattagggcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcct

SEQ ID NO: 60615 - DNA, 540 bp, Heterodera glycines
  Genomic contig location: Contig_ID=SeqID_30178; Location=115..654; Strand=+
  SCN-specific regions: Sequence locations=23-125,147-362,384-540
cgagtaccagcagcagtgccatcggaacaacatcattaacagcggcggcagctgccctttggcactttcgtcgtccgagcgaatggtcagcgaactgatcgcagcggtcattgagcagagcagacaaaggcaacagctgcagaaacaccagcaacagttgctgatcagtacgaacaaagtagaggagaccaataacagcggaggaagcgaaaatgaggcggagggggaggaaagaggggacgaaatggcaccggaggagggcgggagcatttggcaacagagtaagggcgagaacggcacggtaacggcggaagctgtgccgaaccatccgacgacggcaaatgccgggggagacgaagcacaacagaaaaaggaaatgttcatgagggtacggcatattggacaatcattatcagaatgtatgctaattggtcaattaatgtcccctttcagtgggtccatcagcacggcaacaacatgtacccgtcccgagaacagaaggaacggttggcggcacagatggacaccagctatgagaag

SEQ ID NO: 60616 - DNA, 297 bp, Heterodera glycines
  Genomic contig location: Contig_ID=SeqID_30179; Location=84..380; Strand=+
  SCN-specific regions: Sequence locations=1-297
atgcttgaactgctcggagtcgacgtggttgaggaagatggagtcgaatccgttgaagtgctcgaacagctcggagttgacgaggttgatgatgctgaacttgttgaactgcttagagtcgacgaagttgatgatgttgaactagttgaactgctcggagtagacgatgttgaactactagaggttgttgacgttggtgttgttgcagttgaggtacttaaagttgttgtggaagttgatgaagtcgatgttgaagatgtgcttgttgtcatgctttctttgcagcagcaaatgtaa

SEQ ID NO: 60617 - DNA, 669 bp, Heterodera glycines
  Genomic contig location: Contig_ID=SeqID_30181; Location=589..1257; Strand=+
  SCN-specific regions: Sequence locations=1-33,55-249,271-669
atggatggtcaactgattgcttctgatcagaaatcgctttcttctgtctctggtgcttcctcaagtgggactcagttgacttgtactgtttgcggagatgtggccaccggtcgacattatggctctgtaggcaaactctcaataaacaagaaattcttgttggttaaggtggcgtgcaacggttgtaaaggtgggaaattacggcatttggtaaaagcgaaggacatgacacatataaccaacttaggctttttccgaagaaccatccgacgcggctacaaatacacgtgtcgtttcaactcaaactgtcagattgacaaacgtagaaataaaaacccatccagagttattgaatgaaaggcaattcacagataaccgtgctgtttgtcgagcttgtcgttacgcgagatgtattcagttcggcatgaaagtggacggtgcgttcgagggaatgttctgtcatttataacgggattgcgtttgatttagcggtacagagtgagcgcgatttaatcggaaaacgctcgcgtactttccccacgacttctccttcagcagcctctactgctgctacggatgcacccacagaagaagaatcgcagggggcgttgtctccagagcctaataaaaatacaattgttcaccagaaaatggaggagaggcataaat

SEQ ID NO: 60618 - DNA, 1386 bp, Heterodera glycines
  Genomic contig location: Contig_ID=SeqID_6181; Location=1804..3189; Strand=-
  SCN-specific regions: Sequence locations=1-34,62-453,475-699,728 -728,752-1354
atggcatttgtggcacttgcgacggtaacagcaatggtggtggtggtcgtggtggtggtggaaaaggcaggtatggttggtggtgtaccggcaacggaaatgtcaaaccatcataccacgcaggctgaaaccgggtaagaaatgtacatttattcttaaaacgaaaaaataacaaaatttgtttgtccattaaatgcaaacggtgctctaatttcagtgaggttctaaatatatttttaaacaggaaacattgctgtgacaacttgccctcgcattcgacactgagtgctttgtgcagaaaaaaagaaaagctaaaatgtgatttttttaatgtgcaaatatagtgacttagcaatagttatccctgccttttattacgcaaaaatagttgcagtctttaaacgaaaaaatagaatcgctaatcgttgtaacataataaaaacttaacaaacaacaatcagaaaattaaataaaatccccccccccatcatcatcatcatataaattttaatgcattacagtatttaagaaaaggtttgagaccaagattgccaggaacggagtatggatggatagatcggaggggaaaggagggggggggattatttgttccatggagcaaaaggagcttaagcaacaaaagaatccaatggaagacatggaatgaaagcaagtatttactttattttagggcaacggattcaattcaatccaattcaattgaattattattattatagtttatttggttaacagtgttgaaaaactttcaacatcacaattcccaaccaatcgatcgatcatccactggcaaatgacagtacacccctcagaaaggcaacatctcgaccaggttgaacagaaagtcgggcccgaaatttgcacgcacagaatcgttcatgtcgaccagagtacaacacgcgtacataggcaatgaattggcttgcataaatccgcatgcttaagaatgaggcaactcgaaattgtttttactcaattcattaacttacaaattttgcgtccattcaatgtgaagtaaacacccctgttggatgcgtcaatgccacatccgaccacgtcccctgtaccaaattgcgcgaatccatccatcatatccggcacgtgcggcaaattacagtggatagacccatcagcccacagcgcaatgctggactcaaaatgcccgaccaattcatgcatcaacatatgctcgggtgccagtcccactccaacatcacttaatatgatcaaaatttttcaaaacatttttttttaattcacgattccatgcgcagaatggtaacttcgaagtaaaacaagccaaaggcacagttggcaggtaacagacaacggaccgacacaaaaccttttttaaaaaataataaa

SEQ ID NO: 60619 - DNA, 598 bp, Heterodera glycines
  Genomic contig location: Contig_ID=SeqID_6181; Location=4129..4726; Strand=+
  SCN-specific regions: Sequence locations=1-19,42-182,204-259,281 -348,377-462,484-488,518-549
atgccgccacttcgagctgagcaacatccgccaccactggcgccacaaacaaacaatgtacagcagcaacaaccaactgtaccgagtccgctgaacgagcgccaacagagtgtacaaccaacgcagggtgaacatccacaaatccgggcaaacgccaccttgcaaccaaacgtggttcaagcgcagcagcagcagcagcagcaaagtcatcagtttttggcacttgaccacgacaatgacgatcagcttttgaaccaaatttttttggtagtaaaaatgtaaaaaaaaaatagacatatcaattacaggatctcaccactacagctgaaatggaacctatcgctttggacaacagcaacaacaacaacaacaacaatatggttgttaacgatttttggttttgtctatttgtttaatattgcattttgtttagaacccacaaatttcttcatctcggcgccgaaacaatgccaatgccaatgccggacgtggccgaggaagaggaggaggaaccagacgcagagcggtgagacgcatgaatgaatgaagattaaaaaaaaaaacattttgtgaattattattatttgtttatttttaa

SEQ ID NO: 60620 - DNA, 694 bp, Heterodera glycines
  Genomic contig location: Contig_ID=SeqID_30183; Location=869..1562; Strand=+
  SCN-specific regions: Sequence locations=1-694
atggtcgacatgtcgaaaatgtggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggacggggaattgaccgaaattgagcctttgcattctaggaaaatcctaatgcaaagggccgaaaaattttcagttaatttattcactgaaatggcgaaaaacacaacgacgggactcggcacaattatgtccattctaatggcacgccaaggggaacgaacgcctccacaaaattcatgggatgagctattcgtagctacgtctgctgatgttgaccactccgaccgggaattgctgctgctgcttggttgtcgtcaagaagactaaaagcaaatttaaattatggcaattccatgttataccatcggagagtgcaaaatggaggtggaacaaaatgctgatcaaattttaaaattttacatttagctaaggatgggactgaaaggaccgtcgctgatacggtggccccaaatgtgaacaaaatgttggtaccgaagcgaaaagtcactgctgacgcattgttggattcttttcggagagaagacgg

SEQ ID NO: 60621 - DNA, 653 bp, Heterodera glycines
  Genomic contig location: Contig_ID=SeqID_30184; Location=361..1013; Strand=-
  SCN-specific regions: Sequence locations=1-314,336-414,437-501,528 -547,578-653
atgcaattaagtaatgaggaatttggtacaaatgaccaacaattcaaaactgcacggatcggcaaagtttttgtggaagtgttccgtgcgaccaaaaaattggttaattgtgaggccaattcgctgatgatcaaattattaatggcttttcttgatgaaagtattgaccaattagacgcattcttttgccgatttaatttggccaaaaaagatattcacaacagagtgacggagaagggattcatcagtgactatttgatggaaaattgcgttaattacataattaaaacgaatgataccaacggaaacagcggctgaacaaaaaagagacaaatcggagaaattttagcaaattccattaaaaaacgtataattttttctccgccggacatggaaattttcgaaattttccctaaaaatcaagaagactgtcaatttcggtgtaaaatctgttaattgcataaaaaattccaaaaatttctcgataattgaaaagtctccaatatttttaattatatattaaatatgggtggactaatgagatccgtattttttattcaaatataaaattaaatatggtcaaattcgttgatttgttctggaatagtgacactaataattgatataatcaaactttgaatggcatcaataaa

SEQ ID NO: 60622 - DNA, 361 bp, Heterodera glycines
  Genomic contig location: Contig_ID=SeqID_30185; Location=1..361; Strand=-
  SCN-specific regions: Sequence locations=1-187,220-361
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaa

SEQ ID NO: 60623 - DNA, 583 bp, Heterodera glycines
  Genomic contig location: Contig_ID=SeqID_30186; Location=318..900; Strand=-
  SCN-specific regions: Sequence locations=1-105,140-146,169-314,353 -418,440-459,489-583
atgcaaagcgaatgcccgaaagactgcacctggggagcgtgccatcctcacgaaggcgccatcggagacgaatgctgcaaagccggctatgggttcaaatgctgtgaagaggtaaaaaattaaaagatatttttaacatcgtatttatttaatacccatttaaaaaaggaaattctagatccccaaaaaggaaacggactgtgaccttctgaaaaaaagatgcgtccgtggctctgggaaatgtttcccggcgaacggaactaaaggcgatggctgttgcgcagctgaccatgagttggtgtgcgcccaggatgtaatttttttacatttttaaaattaattaataaattttgttttagatgagtcacgatcaaaggaccgccgcttacccgctctatgtaagtttggataaataaataggatttgaaatcataagcattcaaatgaggggaccagtacaaattttgaaaaataattttaaatttgagtatcccgaattctgaagcattttatacccttttttccggttctcaatttctgatcaattttggatgcaattatttattagaattatgccaataaa

SEQ ID NO: 60624 - DNA, 1172 bp, Heterodera glycines
  Genomic contig location: Contig_ID=SeqID_30190; Location=116..1287; Strand=-
  SCN-specific regions: Sequence locations=1-55,86-130,169-223,245 -437,481-1075,1128-1172
atgttccgctttgattcaaagaatgcaaaatcagaaaatggtaaaaaatatttggaatattaatctattaaaattattaaaattagggattaatgagggaccggatttttatgtatttccattttttcacatttatttcttaaaaattaatttaaataattttttttagcttagtttgaagcgtttaggaatgtattttatgttcagttttacacataccattttttctatatttagatattttaatcatatttcagcaagttaaaattagcctctttttattaccttaattaattttcaattagccaccactgattatcctgtagaggtccccgatgttgaagcagcagcgttcaaagtgatgttgagcttcatttatacgggcgaattggctgaattgaacggagacaatgcaatggcagtactttacgccggtgaattttatttttttaaatttaatttattaattttttttaattagccaaaaagtacaatatcccaggcttggtagacgcatctttgcaagttcctgtttcatcactgcgcaatgttttcgtggcttatgttcaggccgaactttatgaattggaggtgggttggacagattgaaatagtgaatttactgaattttaagcggctttgcccgcttatatttatgagttaatcaaagaccattttgcctaccattgcttgttttacattgatgaaaatgcggacgatttgatcaaatcggaggaatttttgcaaattgaccaaaatttgttgtgtgaaattttgggacgtgaagaattgaaaatccgtgaagaaatttcaatttggaacgctgtaattttactataaataagtaatatttctaattaatttgttatttctcattaataaaggcactccgttgggccgacgcgaagtgccgtcaaaattgcattgaacgctcggcagggaatcgtcgtgtcgttctcggtccggcactgttcaaaattcgctttccattgatcccaaatgaggaattttcgaagaaaattggtaaaaataaccaagccaaaatgtttgaattttttccgatgagcagctgccgattttataaaaaacgaatttattttattataattttttataagttttaaaatccagttttttagttccatctggtgttttatcaaaagatgaactga

SEQ ID NO: 60625 - DNA, 118 bp, Heterodera glycines
  Genomic contig location: Contig_ID=SeqID_30191; Location=1..118; Strand=-
  SCN-specific regions: Sequence locations=1-83,115-118
ttcttaactttttaattttttatttcttgcggctaatatcttctacaataatttgtcagtttggtcggatgtgcgtaaaacggaaaaaataattaaaattttataaaaatataacaaa

SEQ ID NO: 60626 - DNA, 388 bp, Heterodera glycines
  Genomic contig location: Contig_ID=SeqID_30191; Location=287..674; Strand=+
  SCN-specific regions: Sequence locations=1-388
cggtaggggtcaactccgtctggccaactccgtctcaacatcgttcaaaaagctataacttttatctttgttggccaaacttcacaatcatggtatcattcgaatgccctagatgtttagaagatatttataatctatttctcagtgattaatccgctctcaaaaaagttgtcagttgaaaaccgcaaaaaaggcagaattttcgaagttttttatttcaatctttttttatagttcgaaattttctgtaatttttagtaggctaatagagcctgtgaagagctttcgaatgatatcaagattgtttgattcggtcaataacttcaagagttatattgactaaagtttgctcagacggagttggccagacggagttggcccgttccgc

SEQ ID NO: 60627 - DNA, 1898 bp, Heterodera glycines
  Genomic contig location: Contig_ID=SeqID_6182; Location=2056..3953; Strand=-
  SCN-specific regions: Sequence locations=1-121,145-374,538-898,920 -1048,1092-1105,1127-1176,1206-1255,1280-1349,1379-1539,1586 -1864,1891-1898
  Gene Ontology: Mol. function=ligand-dependent nuclear receptor activity; Cellular component=nucleus; Biological process=regulation of protein activity, epigenetic
atgatcacccggcacatgcgcacccatttgttgctggacggctcgccggtgccatttttgttcgccggcacgccaacaatggaatatgccgaaattccgccgatcagcaaactgtcgctgaactcgtcgtcatcgtcgtcgcctggtgccgctgtcaacgccgcaactgcgagcagtaccagcactagcggtagttgtggcactacggccacagctcaacagtcgctcagtgacactgggacaacaactgcactcgctggcgggtcgctgtcatcggcgtcgtcggcgactgtgccatgggacgagccccaagcgactcgcgtcgtcgcgcaaccacaacctccggcgccgcctgacccggcaccggcagagcccggcaacagcaacaaccacaaaacggcggcaatggagcaacaacaacagagacagcagcagcacatggagcacatggttgcggctgccaagctgttgtccgccgcggcacagcaacagaaccagcagcagcatcaagcagtacaagaagcggcggcggcggcacgcatgccatccctggagggcttactgaaccagcaaatggtgctgtccacgctacacggtaaaaaatttttctgatcaattttctgaaagctgctgtggctgatcaaaattccccctgaacacatcaatttgtatatcgcgtggtcttgatcaaattccctgatcacattcattgtatatcgtattggaaccaatatttttcgatcaactttttcgatcactgccaattttccgatcacccgactgatcagtagtaactaattcccctccaaatatttcagcccaattgccggcacatatgaggcggtccactccaaatctgttcagcgtccctgactatcagcagccgagcgcatttcgaccgccgcctcccgcagccgccgcggttgccaaccttttgcagtcgcagcaaccgcctcaacagtcgccctcctcagtcgccgcgaacgcgtcagcgacggttgcggcggtcgcactgagcaacgcactgtcttccgttcagcaactgctccaacaccagcaacaacaacaccagcagcaacagcaacaacaacggcttgccgcgatggcagtcgctgccgccggcgccgctaccgccaacggactgttccggcaacactcatttggcggcatcggcttcaccgagcagcagcagcagcaacaactggtgcaactgcaacaaatcgctgctacacaaccgacgcctccaccactgctgcaacaacaacaacaacagcaacaagctgctcacaatcagcaacaaaatccgccaaaatgagatggatggcattagcacacagcacacaaaactcgttgttgttgttgttgttgttttgttgttttcagcagggctttcttttcctcttctatgtattaataagtgattttttgtatggttcatggtattttctgatcactgccttagtgatcgtttttttaatggatttcactgatcagagatcaaaattttctcggctttctttgatcatccactgatttgagttgatcattgatcattttctgtctgtttaattttttcaattttcttgtctcattgatcagttcatgatcaagtgatccagcctcctttttgatcagatttctgatcggattattatgactaatcaattaattaattcattagcttattcaattgttcaaattcaaattgtacagaattcattcatcattttttttctgaattgtcctctctttctttgtacagtacaaatgttctatgttattacattggccaaactacggtatacttctactctaataattaatatacgataattacatttctaattatacattgtttcctatctttaatttaattaattaattaataatggaataaa

SEQ ID NO: 60628 - DNA, 64 bp, Heterodera glycines
  misc_feature (57)..(57): n is a, c, g, or t
  Genomic contig location: Contig_ID=SeqID_6182; Location=1..64; Strand=-
  SCN-specific regions: Sequence locations=1-64
gccaaattccctcgcctccctttgccctttgatctgttcctttttgttttcaaatgntgcggtt

SEQ ID NO: 60629 - DNA, 627 bp, Heterodera glycines
  Genomic contig location: Contig_ID=SeqID_6182; Location=4718..5344; Strand=+
  SCN-specific regions: Sequence locations=1-191,225-627
atgtcaaacttaaatcctggtaattggtggtattattttgagcgtcaaggcaaatcaactgctaaatgtaaagccgatggatgttcctactcaaagacattaaatgcttctctcagtacaacagtgcttgcttctcatctcaaaaatcaccacccacaactttacaaacagcgtgaagattttgttcaagcagagaagcaaaaaacagaaaagaagggacaaagtggaataaacccattaaaaagggcttttgtcggtttacgtgaggacaaggacaatcgttattcaaatataaagaaaacaattgcgaatgccatcgaattgcggcttaaacaagccgaagaacaaaaaaacctagttcttgcaactattttggacccacgttttaagaccatttaccttgacagcagtcggctgaatcagtacaaagactggttgataagtgaagttgagagttaccatgcaaagactgatgtgattttattttttctatttttgtaacttaatttttttaggaaattgatttacaaattgacgtaagagactgcagtggttcaagttcggctggggatattttttctcgttttgaaaaggacgcagaatttgagcaaataatgaatactgtaa

SEQ ID NO: 60630 - DNA, 1015 bp, Heterodera glycines
  Genomic contig location: Contig_ID=SeqID_30195; Location=70..1084; Strand=+
  SCN-specific regions: Sequence locations=1-426,476-603,647-683,720 -836,885-915,938-1015
atgccaatacaacaaaaacaccaacaagttgctcggaaactgaacacatcaattctaaagtcgctcaatgagcgtttatacccgcaaccgtgggtaagaagaaataaaacaaaatgccaaaatcaaaaatcaaaaaatagtggatgggaataggccgaaatatgcatttatagccccatttattactaattaacttcaggaattaaaatggcgcaaggtgaatgtgtcagaaactgaccaaaacggtttcattttgacacgtaagaatagtttttttaaactaatatgtcgaattttctgttatattttagcgtgctttcatgatttggccgaattccccgcggcaaatttgttcaacaaaaaatttcgaattcgaatgaaggccgaacttgagcaggagcagaaaacatgtaatttagtaatttaaaaaatagaaaattaaaaataataaaaaaagaaaaataattaaataaaacaaacgcttgaaagacattgtaaaattgaaaaaaaactattattgtttttccaattttaggtcaaattcgatttccgactggcgttcgtctccgttatcggtttcgcttcgttaatcccaatgtggccaatttttttattttacttattttttaaaaattctaaattaaatcacgtaaatattcaaaatatttttgtaattcatcaaatttccattttttcaaattttccatccattaattttcccgagttcgtcagactcaagtcttttttacgtatggcagctcaaaggaacgaatggtgttcttttcgcggaaaatctcaacttttgagccgggacttcccgataatatttggaagggtaattaattttaaggataattaattatttttaatttaataaatattttcaaaacatttttaggcattattcacatcccatgcaaattttctctgctgatttttaacccatttgtggccggcgaagtgttcgaatttcatattctcgacggcgttgaacatttggacaaatgctctgctg

SEQ ID NO: 60631 - DNA, 504 bp, Heterodera glycines
  Genomic contig location: Contig_ID=SeqID_30196; Location=117..620; Strand=-
  SCN-specific regions: Sequence locations=1-107,134-263,292-504
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaa

SEQ ID NO: 60632 - DNA, 75 bp, Heterodera glycines
  Genomic contig location: Contig_ID=SeqID_30197; Location=939..1013; Strand=+
  SCN-specific regions: Sequence locations=1-75
atgagttgttataatagcattaagcaaaagtccgaaaagagtgaaataagcagcacagacagtcaacgaaaaaag

SEQ ID NO: 60633 - DNA, 1385 bp, Heterodera glycines
  Genomic contig location: Contig_ID=SeqID_30198; Location=335..1719; Strand=-
  SCN-specific regions: Sequence locations=1-595,618-636,674-685,707 -741,764-895,918-1209,1231-1385
ttggctttttgtgcatttaaattgattttgttttgttttttagaattattcttccgtttttaattgcaaagggaacgaagtgaacgaaggtgtgccgttgaaactcactgagtttgcccttttcacttttgactgtttgctttttcgctaggccttctcatcgcttttcgtaacgaccatttccattcgctggcggagggtgacggggacaattttacggtcaaattgtcacagtttttggaggaggacaccgaaaattcggacattcgctcgtatttgaggcatagggaaatgctgcgcaagaaaatcacctcacgtccgacaattcttcaggtttttcatcatctaacggaaataaaattggttgtgaagtccgatcaaatctcggattatgccattaaaattgctccactttttttaagttggttcgactacgtgctaaacatgggggacaacaattgttgtgtgcaaacacgcatttgtattatgacccgaaatacgaggaagtggtcagtgggcggtgctttcatttggctttgttagccttccattcattccccgcttcttcaatttgtctttgaataaaaaaaaattcaaaatctttggttcccatattgatggtcgtcttttttgctcattttttaaattttttttaaatatttcatttttttatggaagaaaacggtaaaagttttgttttcttaaaatgtcgttctttttaagaaaatcattcaaacccttctctgtcttcggtacattgacaaaatccgtgcgcaactttcaaatgattcgtcgtgccaaatccaagtgatattcgccggcgatttcaacaggtgagtcgaatgcttaattgggcatcgtcaaattcgaacagttcgttcgtcgtttttttgagtgtttttcattttgtttaaatgcaagtttcgtttccttgttgtcccgccctttttcagcactcccgaaagtcgcccaattgcattgattggtggcgacgaccaaactttggaaatgaaaccagacgaaaaaaactacgaaactaacgctgaatctctgaaagttaaaggtgactggccaagctgagtgattagcaccgaaaccctggcccttcctcccctgtcgtggttgaatttttttggcattccgtctgtttagcgcccttcaaaagccaacttctgtccggttctcccgactacaccaacttcacgtgtccccccggctcctccctgggcttcaacggctgcttggattacatttgggcccaccctccgctgcgcattgagcacatttggccaatgccggaccatcggctggtcaccaaatacgacgcacttccgtctccaattgcgcccagcgaccatttgcccattttgtgcgacgtccaattg

SEQ ID NO: 60634 - DNA, 60 bp, Heterodera glycines; identical to SEQ ID NO: 52045
  Genomic contig location: Contig_ID=SeqID_30199; Location=219..278; Strand=-
  SCN-specific regions: Sequence locations=1-60

SEQ ID NO: 60635 - DNA, 321 bp, Heterodera glycines
  Genomic contig location: Contig_ID=SeqID_6183; Location=237..557; Strand=+
  SCN-specific regions: Sequence locations=1-34,56-321
atggctttgaccatcgagcaacatttgcaggaaatttcgcagcaaaatcaaaacccgtcactttcaggcattgacgtatttgaattgggcgacgaaaccaccaacatcgaagattggctgcaacaattctgctttgcgttggattgttcggcgcccaatctgaaagatgagcaaaaagtcaagctactgatgacgaaattgagcaaagcggcattcagcgagtacaagaagtcgtgcttgccgaaagatgtgaccgactccaattttgccaaaacggagcagcaactcaaggcattgttcgccaaaccacagtcggtgtag

SEQ ID NO: 60636 - DNA, 2328 bp, Heterodera glycines
  Genomic contig location: Contig_ID=SeqID_6183; Location=803..3130; Strand=+
  SCN-specific regions: Sequence locations=1-80,110-2136,2158-2328
atgtatttgtccacaattgctgaagctaaatgcatcgaacagccagccccatcaaagcaaattttggctgtcaagcaaaattttgttccaaaaacaaaaggctttgaagcacgtggtcaatttcaacagcagcttaaggtgtgctggcgctgtgggcgaggctcacattttccaagtgcatgtccgcatattaaaattgcgtgccgaaagtgcagcaaagtgggacatttggaagcgcagtgcaaccaacaccaaacatggctgataaggcaagggaaaatgcaaagccgtaagcaaggcaacctcaagcttggaggtgtgctgatcaatttggtgaaccaaccgaaacggctgattgaatgccctattaaaatgaatggaaattttgtggaattcgcgctggactcaggtgctgaggttgtagtggtcaatgaagagacacatgaagcgatcggaaaaccgaagctgagtccatgcaatgttgaagcgaaataccacgacggaacaaaatgcacccttcttggaaaaggggaagctgagttcgaattcggagggataatccgaaaagggcaattttacgtctccaagagagggtcattgaatttgttcggcatcgaaatgttggatgcttttggcctcatggacgacgtcagaaagaaagtggccatgacattgaatgtgaataatgtcaaaaaggaagagtctgttgttgatgaaacactgagcagactcagggcgaagttccctaatgtcttttcgacaaatttgggccactgtaaaaaggcaaaagcgcgcctttccttaatggctgacgcaaagccagtgtattgcaggccacgtccggttccttacaacaccaagttggttgttgaagctgaattggaccgtcttttggctgcaaatgtcatccgtcctgttgaccacactcggtgggcagcaccaatcgtggtcgtcaaaaaggcagctggttcggcacgtgtatgtgctgatttttcaacgggtcttaacaatgttttgctgtcgaatcagcacccgttgccagtgcctgaggacatttttgcgacactaaacggaggacatgttttctctcagatcgatttccgtgatgcgtatcatcaaatcgaattggaagagggatcaaaagagttgtgtacgatcgcaacgcaccgtggtaattttgagtaccagcggttgccattcggagtgaagtccgctcctggcatttttcaatccattatggattcgatgttagcagattgtccatttgccattgcttatttggatgatgtcattattgtgagccggactcggaaggaacattggactcatttggcagaagttttcaaaagaattgacaattttggctttcggatcaagccagagaagtgttccttcggcaaggaacgaatcaaattcctcggattcatcattgataaggatggccgaaggcccgactcaaccaaaattgaggcaatccgaaggatgcccattccaaccaatgtgtccactctccgatcatttttgggaatggttaaccactaccaacaattcgtaaagaatttgcggttcattcgccaaccgttggacgaccttttgaagcaggacacggtctggaattggtccagcgaatgtcagaaagcctttgatcaggtcattggcacgcttcagtcggaccaactgctcacacattatgacccatcacaagaaataattgtgtccgctgatgcctctgagcatggtatcggagcagttatttcccatcgttatgcggatggaagcatcaaggccatcgcgcatgcatcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaattttcggcaacaaaaaaggaattaaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaattaattgttgagattggaaaagatgaagtgctaaaaggtcatgaagtaccttcgcactcaatggcccacttcaaagaatatgtctttaaaaatcattccatttcaccgcaggcgagaagccttatcaattga

SEQ ID NO: 60637 - DNA, 691 bp, Heterodera glycines
  Genomic contig location: Contig_ID=SeqID_30204; Location=208..898; Strand=+
  SCN-specific regions: Sequence locations=1-691
atttgtaccccttctaataatgctgtacctcttttaatcactgttgtacctcttttaatcactgttgtacctcttctaatcactgctgtacctcttctcatcattgttgtacctcttctaatcactgttgcacctcttttgatcactgttgtacctcttctaatcactgttgcacctcttttgatcactgttgtacctcttctaatcactgttgcacctcttttgatcactgttgtacctcttctaatcactgctgtacctcttctcatcattgttgtacctcttctaatcactgttgcacctcttttgatcactgttgtacctcttctaatcactgctgtacctcttctcatcattgttgtacctcttctaatcactgttgtacctcttttaatcactgttgtacctcttctaatcactgctgtacctcttctcatcattgttgtacctcttctaatcactgttgcacctcttttgatcactgttgtacctcttctaatcactgttgcacctcttttgatcactgttgtacctcttctaatcactgttgcacctcttttaatcactgttgtacctcttctaatcactgttgtacctcttctaatcactgttgtacctcttctaatcactgttgcactcttctaatcgctgttgtacctcttctagggcgcgaagcgcccgcccaagccca

SEQ ID NO: 60638 - DNA, 870 bp, Heterodera glycines
  Genomic contig location: Contig_ID=SeqID_30204; Location=1..870; Strand=-
  SCN-specific regions: Sequence locations=1-831,861-870
gaagaggtacaacagcgattagaagagtgcaacagtgattagaagaggtacaacagtgattagaagaggtacaacagtgattagaagaggtacaacagtgattaaaagaggtgcaacagtgattagaagaggtacaacagtgatcaaaagaggtgcaacagtgattagaagaggtacaacagtgatcaaaagaggtgcaacagtgattagaagaggtacaacaatgatgagaagaggtacagcagtgattagaagaggtacaacagtgattaaaagaggtacaacagtgattagaagaggtacaacaatgatgagaagaggtacagcagtgattagaagaggtacaacagtgatcaaaagaggtgcaacagtgattagaagaggtacaacaatgatgagaagaggtacagcagtgattagaagaggtacaacagtgatcaaaagaggtgcaacagtgattagaagaggtacaacagtgatcaaaagaggtgcaacagtgattagaagaggtacaacagtgatcaaaagaggtgcaacagtgattagaagaggtacaacaatgatgagaagaggtacagcagtgattagaagaggtacaacagtgattaaaagaggtacaacagtgattaaaagaggtacagcattattagaaggggtacaaatctgattagaagaggtacaacaatgatgagaagaggtacagcagtgattagaagaggtacaacagagattaaaagaggtacaacagagattagaaagtgggcattcaaatattgcatttacggtaattaaggaattgtttttattcaaaatagataaaaaatcgatgtgttatatttttcattttttaaaatataatacactttttat

SEQ ID NO: 60639 - DNA, 962 bp, Heterodera glycines
  misc_feature (881)..(881): n is a, c, g, or t
  misc_feature (945)..(945): n is a, c, g, or t
  Genomic contig location: Contig_ID=SeqID_30204; Location=1364..2325; Strand=+
  SCN-specific regions: Sequence locations=1-85,329-357,396-503,684-962
  Gene Ontology: Mol. function=cytoskeletal protein binding; Cellular component=cell-cell adherens junction; Biological process =embryogenesis and morphogenesis
atggagcaggaaaatggagaaataattgaaaaaatggacaaagaaaaagcaaaagccgatcagaaaatgaaagaactgatcggggaagaaaaaaggacaaaaaagaaaaacaaaagagcaatgaaaaggaaacaaaggcaaagatcagcagctgatcagaaagagggagagagtgagcagaaggaggagaaaggaaaagaaagaaatagggaagagagcgagcagaaggaggagaaaggaaaagaaagaaatagggaagagagcgaaaggatcagtgaagagagtgagcaggaggaggagaaaagaaaagaaaggacagaagaagagagtcaatggaataccaaagagagtgagcagaaggaggagaaaggaaaagaaagaaagggagaggaaagtggacaggattttgctagagaggaaaacgacgtggaaatagtgaatgaccaaaatggtggtgagagaaagcaagcaaagaaaaattgtgaaaacaattcaatggagttaagagaaaaccaagagagaaaaattagaaaagaaaagaaaacgcaaaaaagagagagtgcgcaaaaagagttgaaacgaaaaaaagacaacgatggaaaaagtgagagaatcagtgaagaaaaaattgaagaaaaaggcagaaaaaacaacaatgagagaaaggagagcagagaaaaaaatgaaggagagagtacgcaaaatgagaggaaaagaaataaggaaaaaagaaaacagaaattgaaagcattggaggaaaataatgaaataaacataaatagttggaataaaacagcaacagattcagtgacaacagaagaaagtcaaaaacagggacaagaatatggagaagagacaatggaaaagggaggaaaagcatncgcagagaaagaaagggaaaatgccatcgaatgatgggagcgaaattggcaaaagtcaatttgngaagtaagtaattacaa

SEQ ID NO: 60640 - DNA, 93 bp, Heterodera glycines
  Genomic contig location: Contig_ID=SeqID_30206; Location=365..457; Strand=-
  SCN-specific regions: Sequence locations=1-93
ggattatttttcaaaacacctcgtagactggggataattggagactgcgggattaatagagactgggctataattagagcatatacggtaatt

SEQ ID NO: 60641 - DNA, 807 bp, Heterodera glycines
  Genomic contig location: Contig_ID=SeqID_30207; Location=143..949; Strand=-
  SCN-specific regions: Sequence locations=1-171,195-337,359-807
ggggaccgtgccgggtgcgcgggggtaagcagtgctggtccgtttcatcacggcaccgaaccttttggctagtcagcaatcgttgcttacttgccagatcggacgggtgcgcatgattccactgttccaagcaccccaccaaaagcaaaacgatatacccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatttttt

SEQ ID NO: 60642 - DNA, 684 bp, Heterodera glycines
  Genomic contig location: Contig_ID=SeqID_30209; Location=266..949; Strand=-
  SCN-specific regions: Sequence locations=1-206,230-403,426-684
atgaaacgcccaatggactcaacagcaactccgccttcttccaaaaccacacgtatttccgcggacgctttggctggacaaatcgactcactttctgctgcagtcaacgcactgcttgttcaggacgacatttcacaggccgtcaaacttcagtttggcgttttgcttactaccctccacacgtgccaacacgtcatcgatggtctgaacaacaacgcaaacaacaacagtgccgaggaacaggaacgccgccgttccttggtcatagtcggtcttccggagaacgcttcaacccgtccttcggagcgtgttcgcgaggatcaaaaggttgtctcggggattttggacgaattgggtgttgtggcggtgccaacgacgacctaccgaatgggccgaccctatgttcaccgtgcctctccacgcctgctcaaagtggtgctgcccgcgtcggtccatcagcacatcgccctcggcggctggaaaaaggagcgcattcgcctccgttctctgccaaactggggccgtttgctgattcgcccgtctctcagccgtgaacaactccaggcggaatacgaacaaagacaggccaaacgcaacggaatgaccaaccatccgcctaatgccaacaccatttcaacccaattgcatgaacttggacgacagatgaaccaaaattttcactga

SEQ ID NO: 60643 - DNA, 304 bp, Heterodera glycines; identical to SEQ ID NO: 51570
  Genomic contig location: Contig_ID=SeqID_30210; Location=212..515; Strand=+
  SCN-specific regions: Sequence locations=1-304

SEQ ID NO: 60644 - DNA, 303 bp, Heterodera glycines
  Genomic contig location: Contig_ID=SeqID_30210; Location=592..894; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 60645 - DNA, 305 bp, Heterodera glycines
  Genomic contig location: Contig_ID=SeqID_30212; Location=113..417; Strand=-
  SCN-specific regions: Sequence locations=1-305
  Gene Ontology: Cellular component=membrane; Biological process=cation transport
atgtatatatttggctatggaagtcttctctggaacccaaatttcctttacgacgaagcaattcaaggcgttgtgattggatacgttcgcagattttggcatctttcgcctgaccatcggggtacccccgacaacgtaacacttcatcaaatatcattcagataaatttgtttcagcctggccgtgtcgtgagtttgtttcccgatgtcagtggaagttgctggggtattgcgtacaaaatcaacaggaagaacatcgaaagcactttgaaatatttggaccatcgggagaaggcggggtaccaa

SEQ ID NO: 60646 - DNA, 302 bp, Heterodera glycines
  Genomic contig location: Contig_ID=SeqID_30218; Location=178..479; Strand=-
  SCN-specific regions: Sequence locations=1-148,171-302
gtcaatggcgagtcattagtcaatgcgcggcatgacgagggtttgttttgcatttggaagtgattttcatgccaaattttaattaatttgctcttttgcagctgtccgtgcacttaaacaagccgggaaaatggtcaatttgcaaggcattcaattgattcattcatttatcttcaacatttttgaattcttttctctttccagtgcaatatcgacgcgatttgcacctccgtcgggagaatatgctgcaccggctgagttgggaggagagtcgggtcggtgcgtcgtcggctgggccgacg

SEQ ID NO: 60647 - DNA, 812 bp, Heterodera glycines
  Genomic contig location: Contig_ID=SeqID_30220; Location=541..1352; Strand=+
  SCN-specific regions: Sequence locations=1-95,400-511,573-783
atgaaaatctttttaaattccatggacaaatgcgaaaatggcggaggaacacgaattattggagtaattaacgaccaattgacggaagaaaaaagtaaaaaaaaaaaaattcaaaaagatattattaataataaaatcatattaaaaaatagaaaacaataaaattttattttcataaaaaatgaaatctataatgtaatctaataattttaaagacatttacataaaaaaaaatattttaacggttattttttagtttttattgacttaatttaatttttggctataagaaatttcattattggaaaattttaaaaattcaaaaattttattttattaatttaaaaaatttctcaataaattttatatttaatttcttttttatattatatttatttacaaatattaaacgcttttttatagagaaaggcttttccgcatcaagttcaaacattcaatttggaaagcatttgctgacaaagaattcttttctgacaacagataaacttggtaatattttgaatttttttaaaaaaaattattgaaatataaaattgttgtatttaaataatgccaaattttagaaatatgcgcatacagcttgagctttatccgttccattttcaaccttggcgttgaatcgctgaattatcttcagctagtgacgaccgcttcaaaagctaatattaaaatttttaaggaacaaatcaaacaaattgacagcatttgtaacaagtttcaaattggcattaatgccaatgtttatttcgaagcgccatggggtaattaattaaaaatatttatttatttaa

SEQ ID NO: 60648 - DNA, 4793 bp, Heterodera glycines
  Genomic contig location: Contig_ID=SeqID_760; Location=730..5522; Strand=+
  SCN-specific regions: Sequence locations=1-656,706-1035,1057 -1081,1103-2353,2375-2745,2800-2880,2902-3291,3392-3498,3525 -3580,3620-3798,3821-3904,3953-4096,4123-4518,4540-4793
gcaaccggcagccgaacttttgccagttcgacgtcggcttttgtcaccaatgaccaccaacaacagcagcaaattcatcggcggaccagcggcaccacaacatttgttaagggaactgccttaattagtcgtggtagcattgttggcggattggtggaactgaaaacgtttggcatggcgtcgtcgaacggcgcggagttggggctgaacccgtgggactttgacgtgcagccggacgacgactttgtcagccaagtgagtgatagctcaaaatggaattgattgattgtgcaggcatatttactctgatgaatgtgccaaattttgattccgactcaattttcggcaggcaatcccgagagtgaaatcgggaatgacaaaatttaagcgatttgtctcttattctcctgtgatggtgccgtagtgttattatgccgtcgtaaattttaaaaattgaaaaaaagttttcccaatttttaaattgttttcccatttttgtttttatatatttcctttattttgtacagaccaaaatcttggaaatgccaaattcgcatcggctcggcgcctgtcacagctgtaagggtgaaatgttggtgcactgtttccactgccgtgggtcgggcaacgacaaatgctcatactgccggcaagtgtttttttattatttatattttttgttataattttaaaataacatttttagtggcaccggcatgaaggcgggcgttgctcatccaggtaaaaaactgacgtggacaccacaaaatgggtatttcggcacaaacccttaaatagttatgtctgaatccaaaatccttgaccaaaaaatctctaaatttgtcgtatattccaaaaactcctcaaattaaattttttatcaaaccacaaaaacctatttgtttataggaggcgcactacctttttagaagaaatttctatacaaaatgttttcgaagtgttatatagcgttttttcaaaatttatgatgaaatattattttttttaaacagtgaaattttttcatttttttaactttttcggggaggcggggaataaagagcacacattataaggactcttgatgctatttctttctgttcatcctctgtgtccccaattttcagctgtgtacacccatccgatgattggcggcggcacttttcccggcgcgcccgcttctgttggtggttgtggtgttgctggtactgctccaaaccgtggtgctgctggtttccaccaccaacaccagcttcaccacccgtttgccaacccgtcaatggtccgtccggcactgctcggtgcccagcgggacaaaccgtacgcggccggcacgcccgtccatttcatggcaaaggctgggctaccaccaccggtgcgagtattgtattatacatcttacatgtacacccaaatgtcgccagcagaaaatcgcaggaaaaaacaataataaaaaaattttcaaaaaattcaggaaaagttctaaaaaaattttttaaagctttttgttttttgaaaatctaggtgttactggaaagcaaatttctgaatttccacaagaataaaaaaacataagaattttcttttatcttattgctcgaatgaaaattaatttgtattttactgtattccgacagtatgccaagtgaaaatcatttccgggtgcatttaaaaaaatcaacctgattatatgactccgtgaaagccctggcaggatccgatcctgatccgggcccttccctatacaatcatcataaaaaaataatttctgttttccagggcattggccaacacgacctgtgcattttctgccacggccggggcatccgcgactgccagcactgcaagggccagggcaaaaagcactgtttgacatgcggtggcaatggccaagtgcacgtgtacaccaaactcaaagtggtcttgtgagtcgtttgttcatttttttatttcggtcatttcaaatgtttggcgtaatggtgttgtgtccgtacccaaactctggacttttcccggttacttttcagcaaggcttcttttaagacaatttattaaaatggaaatcaaaagtggaaatgcaaagttaaataaagaatgatcgctttttaatagtaagaaaaacaaagcaaattgttaagtgagttgtatcgctttaggcagggatcctgaggataagagaataagcaaagacttaaataccaatgacaaatgggaggggccaaacagatggaattacacaaaattgtttggaagaatattttccgatggattggacgaaggggtcacttttatgagtgagtgaggaacagaagggccagggaaattacaacataggaaatgccaaaaacggagaaaagagaaacaaataaataaatggcaatgattaagccaaaaatgcagatccaacaaatggttttttcaaattttagttctgtcgagtgcaccgattattacagcgcgtgcggcgtgcctgaagttctcttacgacaggcgaacggcgagctgattttctccgaaacgcggccttatgtaagtgccccccccccctcaaattttatagattttttttccaaattagactaattaaattatccgatcaaggaaaatatttcgaccacttttacggttggagaaagatcactttttgtggagaaaaatagtttttttttttgcattaattcattttttaaatattaaatgtcatttacgctttaaaaattcatttgtcagaggcaaaatacggtgataaataaattaaaatcaaattattgggaatatatttagattaataaaaaatttcaatagaattatggtgaaattcttttaaggtgcagccaattaaacgggacggactcaccgaaatcaacgatgtcagccgacgcttctgtgccgcccacctgaagaagttgttggactcgtgccgtgtgctgaagcaacggcactgtgtggagagcattgaggtggccaaagtgcgctttcgtcttggctcaaaaatgggccatttttttgtgtacggacgccaacggttgtgctacattccggaggggccgacccggtgcagtgtgatgtgaaaagtgtgtgcacgaacgacccaaaaagcggagggaccgtcaaatgacggacagacaaactgacaaaactaccgtagtactattactacggtgtaaaaatactgtattagacaatgccaatgaatgaaccgccggagaaattaggccgccgtatttgctaatgagcgcagttagccacccccgaaaaaatagtgaaattttactttctctgcactttgggaaatttaaaatttaaaaaaatctttaaaattattttttgttttctattaaaatataaatttgatttgaagaatggtaattaaaatttttaattttttaaaggaatttcaaatttcgaaaaaaacacagaacaactatttctcatttccatttgagcaaatacggtattctcagctcgaatgtattcccatcctcaggcctcttccggtgaaaaattcctaaaatttaaatttcgacagtttttcctcttgtccatggtttcttaatcctgatttttggactaaaagccccaaacaatcaatttgaatttatcttttttgtgtttaaatgcaacccaaagaatgatctctcgcgttttgcttactttttgttcaattcatcttttcctagcgtttttctccctcatcaagttcaagcagttcagctttaatatttacatttaaatcccaaattcggttgatttttcgcctcggtttttgttgttattttctagtcatcatttttttttattcttcctcaccttttttcattacaattttttgttcatttaccttatacaaatatatttgtggtgcaaatgctaataaaaatgcaagtattcatttttctcatacatttaaataaatatttttttaatatacatttagttgaattattaaattgccacattttttattaaaataattcaatgttttttaagtgttttagttttttgttttttgctcgtttatgaagttcgtctttctgttgctgttggtcagctgcttcctgctgctgattgtgaacattgcttttggcattgacgaccattcatcatcatcatcgtcgtcagcagccgacggcgttggcacgtgtcccgcgctttcggcattcccattttggctgcgccgccagtgccccccatttgaggatacgcgttgtgccatagcgtttccaagcgatgtgccggcaccgcccgggcaactcagctgcgcgttgggtaattctggcggatggacaactgggccccggaaaactcaaattgtggcagaatgattggaccaccgcccaaattgggttgactcggacaacggagttatgtttcaaaaaacttttccgatgccaagttgctctcccaccgtgattatatggatcggaagaaattttgtagttggaatcggttcaatatgggaataaattgtttgtttttgaatcctgacaaagaggcccctaatattgggaattgcaattttggaggggacaaacaaaactcggcaaaccatctgccggtgtagggaggggtaatttttttttgaatttccaatttaaaaaccgagtctgaatttcgtgtttgaatatgctgctgaaccaacatgttttacagcgagtgcccagcccaacgcgcgccttcgccagctgtccgcccgtgagctgctcgcgttcgcgaagcggcgcgacccgtacgggcgcccggtgtgcatgctgacactgttctacgcgcccgactgtgtgttctcggccaag

SEQ ID NO: 60649 - DNA, 647 bp, Heterodera glycines
  Genomic contig location: Contig_ID=SeqID_761; Location=1023..1669; Strand=+
  SCN-specific regions: Sequence locations=1-350,372-499,526-647
atggctgcccagtttgagaaagcgaggcctgaacaatggaagaaaatttgtcaggtataaagtctgtgcgtaaaattgaaagctaaatttcattataatccacgcgacatgccccaccatttccaccctttttcggccaccaaaattaaaatatattttgtcctggacttgtgctatattatttatttttttgctcttcgggccaaaaaatttatctagtgttatttttcaaacttttcagcgccgggtgaaaccccaggaaattggagcagttttgcgggacaaatgtttgcctttggaggcaaatgttcaataaataatggtacaatgggttatatgtaaggcaccgcctgggaaaaactcatggaacttttaatgaaaaagtgagaaaaaaattgtgcaaattttccgccacccacccgtgtctccgtgtcccattggaaatggatgagtgcggacgggaccaattcgtagtccaacagcgtgtgctcctcctcgcgcaactgttgctgctgctgctgattggcaccaagcgcagcggtcagtgtgaaagtgccgtgatggatggccaagtgttgggccacaaactcacgcacattggcaaaccgttcgtgcacattgaaaatgccctgaacaaaagtggggta

SEQ ID NO: 60650 - DNA, 1272 bp, Heterodera glycines
  Genomic contig location: Contig_ID=SeqID_761; Location=1442..2713; Strand=-
  SCN-specific regions: Sequence locations=1-797,827-937,965-1166,1193 -1272
gaaaaagtgctgccagtgaaagggaccattgaatttttgaaagcgattggttttcgtgaggaaatgcgtgccgcccccgcggctgatggacagcaacaatcggcggagcgttacctggtgctgtcggcacagccaaccgccggtggtgtggacacgctgcgcaacgcattggcgacactgttggacggcaaaccgattgcgatccgagtgtttcgtgaagcgaaggtgggtgtgaccaagtgtttgatattctgtcagtcctgtagtaattaaaattatttgccttttttgcggtccaatttttcaaaaaaaaaacctgtcaagtttggttccggcggtgctgaaaggcgcaacgagaattttttatgaaattttattggataatttgtttgtcactattatacctatacccatcctaccctcacattcaactatttcaaacaatgtcaaaaaaccaaatttgtctcaggtgttcaaaattgagtcgaaccaacagcagttgccgaacccggaaattccgcccgactttttcaagcgaactgttgaagaaatccgacgggagcaacagcgaatgtcggaagagttggagaagataatgacgttgcggactcggaagatgcgcgaggcggacaccaagcgaaaggacgcggagggcaacccgttcaagtactgctacatccgggtccgcttccccaacagctttgtgctgcaggcgagtgaacagtttttgccgggagaaaactgattgggggcggcaataaaaaaaattctagtgattttttcgaaattctatggagtattttataaaaaaaaattttttaaatttcatgaaaaatcgttataaaagattttccgtaaaaacccggccagagtaaatgaataatcgtgcaaaattttaaaaaagcgatttgcttttcggtgcgaaatttttgaattctaatggttttttgttgttgtttgagttagacttttattgcattctataatgattcgactttttcaaagcgaaaacccggcgctttaataattttatgttccttttattaccccacttttgttcagggcattttcaatgtgcacgaacggtttgccaatgtgcgtgagtttgtggcccaacacttggccatccatcacggcactttcacactgaccgctgcgcttggtgccaatcagcagcagcagcaacagttgcgcgaggaggagcacacgctgttggactacgaattggtcccgtccgcactcatccatttccaatgggacacggagacacgg

SEQ ID NO: 60651 - DNA, 149 bp, Heterodera glycines
  Genomic contig location: Contig_ID=SeqID_761; Location=207..355; Strand=-
  SCN-specific regions: Sequence locations=1-149
atttagcccgcaaaaataatcgaatattttattcaaattcatcatggaggatgaatgtaacggtaatggtgcttcttcgtcttcatctcttttgggacggctccgtcgctttttgccccgaattgcagccgcaaatgcagctttgtcag

SEQ ID NO: 60652 - DNA, 890 bp, Heterodera glycines
  Genomic contig location: Contig_ID=SeqID_763; Location=2346..3235; Strand=+
  SCN-specific regions: Sequence locations=1-331,353-434,456-614,650 -857,879-890
atgaggcggaggcgacacttccgctggctctgcaaatgcctcctcctcctcgtgaggttcgtcatcctgaggcggaggcggtgtacttctgtactgagtgacttgtctatagaatccttctttctagtgtatttggcttgtaccactcacttaatgagtgacttggatacagaactcttctttctatagttttcgtatacttggcttatgccttactgagtgaatgtctatagaactcttgtttctatagtgtatttggcttgtaccactcacttactgagtgacttgactatagaatccttctttctatagtgtatttaaatattttgacgacaccgaaaagacccttcttttgaatgccaatgcaattgtgggcaagccccttttttcctcaaaactatcaaatttggacttccatttactcattttccgacaaaaacaagaacatgaaaaaatgggaacctcctgtgccgtttgcggcgctgaaatcgctgccttggatcataaaatttttgatgacccgatgaaacattgagcctttgaagtgcaacggtttgcccgtcactttgaagcagcgccgtctctcagcctttgacaccgatttttaaactgtcttttaattaaattaataattttttttaatttttttctatacaaaagcaaaaaatggcatactttaattcaaacaataacagtatttaggtaatcattttaaaaaaatgaatcaaaatttcgagtttaaacgagcccctcacccgaggaaaacactcggtgttcgaaacggcattctgcggtcgaatgcagaagggatcgacccatttccataccgccgtttccataccagccatttccataccaaaaatttttcgaaaattttcaggtaaaattca

SEQ ID NO: 60653 - DNA, 1733 bp, Heterodera glycines
  Genomic contig location: Contig_ID=SeqID_763; Location=442..2174; Strand=+
  SCN-specific regions: Sequence locations=1-306,328-409,431-997,1020 -1198,1220-1669,1694-1733
  Gene Ontology: Mol. function=cyclosporin A binding; Cellular component=plasma membrane; Biological process=protein folding
gtgtcaaaggctgagagagggcgctgtttttttgacattcacatcgatggtgagccggttggacgcattgtgatggaattgtttgacgagcttgttccccacacaaccgagtttgcatttaatggacatttttgcgtattttatttggcaataggaattttgtgatgctttgtactggccaggctggcattggcaaagtgacgggcaaaccgttgcacttcaaaggctcaatgtttcatcgggtcatcaaaaattttatgatccaggcagcgatttcagcgccgcaaacggcacaggaggttcccattttttcatgttcttgtttttgtcggaaaatgagtaaatggaagtccaaatttgatagttttgaggaaaaaaggggcttgcccacaattgcattggcattcaaaagaagggtcttttcggtgtcgtcaaaatatttaaatacactatagaaagaaggattctatagtcaagtcactcagtaagtgagtggtacaagccaaatacactatagaaacaagagttctatagacattcactcagtaaggcataagccaagtatacgaaaactatagaaagaagagttctgtatccaagtcactcattaagtgagtggtacaagccaaatacactagaaagaaggattctatagacaagtcactcagtacagaagtacaccgcctccgcctcaggatgacgaacctcacgaggaggaagaggcatttgcagagccagcggaagtgctgcctcccgctctgatagaaaatgcaaaattttcagaaatttactcattcttgtttgaaaaattctttcaaatgagtcaaaaaaattacaaatgattttttcatgaaatccgttaaacactcatacctacagtcgtcttaacctactcgtctcttaaaaaactgacccaaatgatttccccagtttgctgcttgaacctgattctcatttcttcaaaatcgaagcaacagcgaaagcggatgaattcgtcaattccaaatctaaaacatattacattatggatgcaattcctcaattctctgaccgaaacctacgtcaattcatcactgtcattttccagcacagcgcatcggaagccagtctccacaaaccaattttgttcatcgtcatcttgtatttcaagcgtcaggttgttcactctagattttttgtttgcagataattgttcactaatttaaaaaacccactggccaatggaagtctgtgaggggccaaaaacaccggaaaaacgcttccgattgttgggatcaagcatttgataataagtgtcaacattggcatggtaaaaattgccccccatgacggctgacgtacatcctgtgagaatgtaaaactcacttcaatcaaatgctgtggatcaaagctctcacccgtatccaataagatagcgttcacttctgttttggagccaagcagacacatgtgtttggcgcccatacaagtcattgtttgcgtagttctgatcaaccatgtctgttgttgaagcacttcttttgagtccaaaaagaagcctgacacgcaacgatcctagccaagggggtgccaatatctaacgacagagactgcgcttcttcaccaattggccactgttggcgatgacaacgtcggccaacgtctagaaaagtgaccattaaatggaaactaatttaaatatatattaaaaaaacaaaccagacaacgagcacacataaagtgcttaaacgagc

SEQ ID NO: 60654 - DNA, 781 bp, Heterodera glycines
  Genomic contig location: Contig_ID=SeqID_6187; Location=70..850; Strand=+
  SCN-specific regions: Sequence locations=1-76,104-238,271-759
atgctgggctttgtttacgcggacgatttgagcgaattgaacggagacaatgcaatggaagtgctttatgccggtgaatttattattttttaaaaatttaattgaaaattgtgttagccaaaaagtataacatcactggcctgatcggcccacctttacaaattcccatctccgaattgcgcaatgttttcttagcctatgcccaggctctcctcttcgaattagaggtgagaaggtcaaaataaatttaattttattatttttttttttgtatgaattatgccttagattttctgaagatccaataatttttttgtataattttctgtaattaatacatttttaaggattttgtcagcgaatgtttgcggtacatttgtcaaaatgcagccaaattgttcaaatcaactgattttttgcaaattgatcaggaaatgttgtgctatttttttgaacgcgatcagttgttgatcagcaatgaatgtgaactttggaaagctgtaatttcaattaaattttgcattttattttgtttttcatttttgctttaggcacttcgttgggccgacgaaaaatgccgacaaaatggtgttgaatgctcaccggaaaatcttcgtgccgtcctcggcccggcattgttcaaaatacatttgccaaacatccatgaagcggatttttcaaaatacgttggtaaaaatgtttgaaatcggataattgaaatttttaagctcggaattaatttccttttaatgtttgaaattaattcaacttttttaaaaaa

SEQ ID NO: 60655 - DNA, 1210 bp, Heterodera glycines
  misc_feature (171)..(171): n is a, c, g, or t
  Genomic contig location: Contig_ID=SeqID_6188; Location=1340..2549; Strand=-
  SCN-specific regions: Sequence locations=1-333,356-546,568-597,619 -641,663-774,796-1210
atgcggccaaaagaagaggccaaagggtgtaaaaaatgggattcaaaaattttgtaacttgcaattttgtttataattgggaaaaaaagggtgcgaattgaactcaatgtccattagcaaaaatcttctttcaaaacttattattattgtaagagtccattctataaattngcttcgatatgatcagtttttagaggatgcataaaactatttcgctttttgacatttcatgagatgaattatagcaaaatgttttattttcgaatttatttttgagaaattgctattttgaaatgtcttgtcttaaaaaagacagactttttattttcaggtgccattgaaattttggtatttacagagaaaattagcaatataatagaaagttaatttcaagctccagaaaaatcggtttaggtctgaaagtttctccttatcaatcactatttgcattcgctaccaaaaggtatgttctttttaaaatgtgttttctataaatctagaaaatggaacaaccacagataaataatactgaaaaatcgcccctagacgaataaaacaattaaaattatgcaagtttgggacgggtaatttagctgaggtttaaaatttaaaatttctgagaagaaaaatcagcatgaattgtggtcttttccattgtttcagatgcggccaaaggagaggccaaacgtgtaaaaaatggattcaaaattttgtaactgcaatttgtttataattgtgaaaaaagggtgcgaattgaactcaatgtccattagcaaaattcttctttcaaaacttattattattgtaagagtccattctataaatttgcttcgatatgatcagttttttagaggatgcataaaactatttcgctttttgacatttcatgagatgaattatagcaaaatgttttattttcgaatttttcagatgcggccaaaggagaggccaaacgtgtaaaaaatggattcaaaattttgtaactgcaatttgtttataattgtgaaaaaagggtgcgaattgaactcaatgtccatttttaagttgaaattaatctctacctcttttgcgtcgccgtatcccaccaaaaaatgcacatccgaatgatcacccgaggtttttatgtttttacatatttttttggattgttatggcgagagaaaatagcattttttctccaaacaatttttgatttagagcgactaataaa

SEQ ID NO: 60656 - DNA, 2994 bp, Heterodera glycines
  Genomic contig location: Contig_ID=SeqID_6189; Location=337..3330; Strand=+
  SCN-specific regions: Sequence locations=1-115,139-290,319-391,413 -523,554-556,578-677,699-2448,2472-2836,2860-2906,2928-2994
atgcatgtaaatcctttaaatgtcattcaactgctccaaaaaaaattctcaaaatacaaagaacaaacaccaattaatgcatttgaatcggatattgcaaaaaactttgccgaagaaattgaaaggtgcaataaaaacgatgaggaaatggagatctcccatgatctggtgattgacgaaaatgcaaattatgtcagaattgaaggccaaaatgatgacttttccgattttgatgaaaatacagatgaagaaaccgatgaagtcgggagtcctttcggttcaggtggtataatatgcttttaaaaatattttaaaatctagaaaaatcgagtgggtcgagtttctttccgtcccccgaaaaaaaaacaccacggaaagacacaatttcatactctgacaagaaaaaggcattgcaattttatcgctcaccaggaaagggatgccgttctttaaattgtatgaaatccaattttcgttttatcaagtcagaatcggatcttaaaatgatacgaaggtgaaatagaaaataaatcttttaaaaaatatattttaaggtttgaaattaatttaaaaagccgagaagaggctttaaaacaaattgatttgtttgtaatcgatcgcttcaaggaaaaattccagaacaatttgagcatatcagatctcattttacgaaaatgggcgattcacacgaacaattcacttggggaaaacaaaataacggaatttaaggcttcgaaaaattggttggccaaattcaaaaaacgccatcggattgtttcccgaaaggtcaaccctattctccggaattaataatttacttttttagatcacaaagttcatttcaaaaagtcattatattaatcttgaaaaggtcaaaaaagaggcggaagaatttgtagagtgtgttaagaattttgtcaaagatgaacaaatctcatcccgtgatcttttgaatgccgatcaaagcgggttcgagttagaacttcatgctaaaagatcgttggcaccagtcgggaccaaattaatcgaatgcgttgtgcaatctgtttccagcacaacgcatagctatacagtaatgccaatgataactgcaagtggctcgcttttatccccgttatttattgtgttagccgagcagaaagggaaatttcctcaaaaaggaatatttcaggttttgagaaattgaaaaaaatattacatttaatttaaggccaaaaatatatatgcggtcccaaatactagtcatataatgacaaaaaagttaatgattgaatggctcactcatgttttatgtccgtctttgcgtgttgatcaaaaaacattgttattggttgacagttggacagggtggaatgattttaaaccaccagagaatgtccaacttaacgttaaacaaattccgaaatcgagaatccgctcaaagcgctgttgacaatgtttctgctgaagtctgaagcggtcgcatcggcatctgctgccaaaaagctcatttcgcaaattctggacacggatgccgattgggaactcgcaacatattgcagtgcccgagaagacgacgtcaaaaacggcacatttccatccgaatcggacgtggaaagcgttttgcgaatttggatcggccactgccaaattgcccgaaaagaagtcaaaaatcggcatttgggccaatttcaattgagctgccccaaggcctatcacttctgcccgaaactgaaagagaaggcatgaggaaatcgctcgaaagtgcgccatttttgctggagaagctccgtgccacggaaatccaaaagaagacactcgtcaccgccgaaagagtgattttaggcgattcaaatgcctaccaattgaagaaactatggccgagatcagcatttgtcggagtgcaagaaggatccacagccgaagtgatcagacaatttgatcaagtggtgctggcctcaaaagtgaagtggctgattgcgatggtcggaaaggactcaattttggctggcgactcggtggacagtgtcatcgaaaaagtgaagagactgcgccaactttgcctccgatttgcgcatgtgaagatcttctggctgttgccgccttttatctacaacaaaaaggccgaatctgaagaattctgtggaagaatgagggcgctgtttcggaagaaaagcgaaattgagctggtagcagtgacagaagaaggaagaagtttgctggagatttggcgtttcgggaagaattttaacaatgaacatgttaatcataacggatggatgacagaaaaggggctgaaaacgctgaatgcctggctcacatcattggttccgaattttccgggcgatcgagagctcgggatcagaaccgtgaagtcgaaagtggtgaaaattggtgccgtgaagggtggtggtccaggagacccttccttaattcgtggcaatgcaccagagagaaatgtgagaggagaaggcccaggtgacccctccccatctcgaacgattggcatttctgacaatggccccacaggttccgcccgaccaatgaccaatcaaaatcgcgggtttgagtttggacgagtcggcacaggttaccgctcggtccctcctccgacgttccgtggcccgtcttcacgtttccatccatatcagcaaagtcgtggtcgtccggcgttccatccgactccgatgaatcgtcgcaatcggttcgagccgcgtcgctgagcagtgatcccagacgagcccccccaccttttgacagccgaatcgaatctcatttttgttttatttttttgtctttccttctttaacggcagggacgccgctcgtaattgggtgggatgtgatatttgacctcgtttttaatttaaataattaatttgtggcattttgtctatttaattttgttccccttctaaatttttttgttttctcagtgttttctcatattatattttggcttcaaaatgatggtaatttattctcatcgctctccgactttcgaatttttattgaa

SEQ ID NO: 60657 - DNA, 764 bp, Heterodera glycines
  Genomic contig location: Contig_ID=SeqID_30222; Location=232..995; Strand=-
  SCN-specific regions: Sequence locations=1-123,170-215,238-415,446 -497,563-655,723-764
atggattttaaagcagtaattgtcggatttatttactatttttatgtcacttataaatcaattgttaaagtacatacgtttggaaatcaaaatataaatctagacagattaagtctaagtgacaaattattaattaaaaaataatagtattttaatttttcttttttttcttctcccgtaatctcggaacttgggcaattaaatcattgaaatgtaattaaattacaaaatgaaatgcttccaaagaacatgattcataatttgactgtagatattaaattagttataataaatcgtatattcgtatttatgataataggctcatcattttctcatgatatttgtatttttttattattatcatccgtaaggttcaaataaaatttaattttctgtctaaacagtatcatttttcaaataaatttaaaagaatatttttttatttggaatgatttattatgttattaataagtccggccggttccattatcttatgcattaaaataataataaattcaatttcttgaatgtttaatatttattacaaacaataaatataattcgattttgttttatctttttttttactttcatgtctttttaatcgaaccaaatcgccataaatttatcattttaataatttttctgcagcttgattaaatttaaaaaattatttgttttaaattttttcattaattttcagtatttattttttataaattcaatcctaaatcagaaaaaaagaaactaatattttcaataaa

SEQ ID NO: 60658 - DNA, 1122 bp, Heterodera glycines
  Genomic contig location: Contig_ID=SeqID_30223; Location=85..1206; Strand=+
  SCN-specific regions: Sequence locations=1-276,298-451,473-670,693 -701,754-942,994-1122
atggcagaaaaattcgttttgccattgactgcacaaaattttcgattggaaaggaaaacttcaggttggtttaagcttatttttataatcgaactatttaataatacaagaatattgccattacttaatcaaagaatgtcaacaaaactctaaaaatttctactgacaaaagcgatttgaatgaagaatcctaattgtaattgctcttcaaaaatcatagaatcaacatctagataaataaaaattgcgaattttctgctcagaattcgcttttaagtttttaaatttgttatttaaattcaaattcattttccatattcccagagaatcatatgaatttttcatcatttaatcaatttcaaccaaatttgtcaatttttgaaggttttccctttaaattagaaaaagactctaagcataattttgaaaatttagcctcattaggctctaaaaaaccacaaaatgaggataaagcctcacatcttagggaatactgaatatgatcccggtcaatgccgatccgatcccgactctacccataattttcatttagggattaatctacgctgtgttagtagttttgtccatttagcatcacgccattttcccagatcactttgcatatcaaggctaaacaatgttttgcgcaattaaagattaatgccagtaagaaaaatgctgataaatataaatcaaaaagctaaaatttttaaaatatttcttaaggaaataaattaaaaaaaaagaaatttagttgaggagcctttattcatattaggccagaatttttttgaacaattgcattatggtgcatttttggacgattacgcgggcatttggttgtttggcattgacacgatgcaaaaatggggacgaagatcaacgaaaattgttgttcacagacaccaaaaatgtggactaatggtataacttaattaagtgaaaaattaaataattaacatatcaatttaatatttttaataatttatttaagtgtgaaagttgtattggtaaattagaaaggaaatttgaaaagtgcacaattttcaacacaacgagaattaaacggaaaaaaagaggaagcgacttacacattaaaccattggtaaatattttttaaaa

SEQ ID NO: 60659 - DNA, 1145 bp, Heterodera glycines
  Genomic contig location: Contig_ID=SeqID_30224; Location=160..1304; Strand=+
  SCN-specific regions: Sequence locations=1-153,190-190,212-393,417 -718,741-806,829-1145
  Gene Ontology: Mol. function=pyruvate kinase activity; Cellular component=cytosol; Biological process=glycolysis
cattgcggcatcggacggcgtgatggtcgctcggggcgacttgggcatcgaaattccagcccagaaggtgtttctggcccagaagatgatgatcgcaaagtgcaacatggccgggaagccggtgataactgcaacgcaaatgctcgaatcgatggtaaaaaattagggttttaaaaaatgaatgaaaatgtgtgtatttaatttccaaatttgtcattaggtgaacaagccgagaccgactcgtgccgaggtcagtgacgtggccaacgcagtgctggacggctcggactgtgttatgttgtcgggcgagtcggccaagggcgattatccggtggaatctctcaaaaccatgcacgacgttcgtttccctcgttacatttgataattaaagactgaaaatttaatttttcagatttgtctggaggccgaaaccgcctttttccactcgaggtacttcgaggagttgttgcagaacacgcccagccccaccgggccgggcgaaaccatcgcaagcgctgccgccaacgccgcgaggagatgccgggcaagcgcaatcattgtgctgaccaccaccggaaagtgggcattcatttttttattgtttgaactatttgcaaaactaattttattgtcctaattccaattacaaaaaagaggcataacttttgaacaattgcattctgcagattctctggtcaggagcaggtcgtttccctctccctttcgccgcccctccccccgaaaatattacttagtttttcctttggttttgaattataaaatttaaaaaagacaaatatttaaacctcaaaattttgaactttttccagtgaaatatggactataaactaattaataatcaaaataaaatatctgaaaataacaatttttcaaccgcaacacacccaacacgcactctcaggtcggcccaggagtgttcccgcttccgcgtgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtg

SEQ ID NO: 60660 - DNA, 632 bp, Heterodera glycines
  Genomic contig location: Contig_ID=SeqID_30228; Location=335..966; Strand=+
  SCN-specific regions: Sequence locations=1-1,24-53,75-422,460-543,565- 632
atggagaaattggctcaacagaatccgagtctagtcgattcaacagcatcatctttggaaaaagctgcccaaatggagttggacttcatccagcgcgttttgttgggcccacatcggggcaatttgacggcaattgaatgtttattggcccaaaattttagccaaaattcatcgatgatgcctaattatggcggcgcaacatggaaaaattcgaaaatgccaaaattagaaaccgaaaagcacattgttggtgatgttgatgaacccaaatcagacaatgaaagcgaaacggaccgaggtgatcagaagctgaagagaaaaggagtggaacgaccgaaaaggaatccgagtgaatgcaaagtgtgcgggaggaaaagcatgtactgttattacagtgtcagatgttgcgaaggtgagtgacgaaaaaatattaaatttttaattttaattattttattagagttgatggattataaaatactagataagcgtttgaattaatcttggtataaaacggaaaaaactgagttgcagcaaatcccgcactatcacgaaaaaagactcgggaccggaacttagacgggattccgattcagtatgctcccggtcgtttttccaaatatcttcggtaa

SEQ ID NO: 60661 - DNA, 118 bp, Heterodera glycines
  Genomic contig location: Contig_ID=SeqID_30229; Location=94..211; Strand=-
  SCN-specific regions: Sequence locations=1-118
atggcaaaacggcaaatttcgcttctgaaaattgaagagatttacgaacaaatgggcaatgtttatcatgttgttaaccttaacgagcttgaatgggtgaatctattttttgagaaag

SEQ ID NO: 60662 - DNA, 1007 bp, Heterodera glycines
  Genomic contig location: Contig_ID=SeqID_30229; Location=359..1365; Strand=+
  SCN-specific regions: Sequence locations=1-607,638-769,834-1007
atgactacagtagggaagacagacggttcgcagggacggacagtcgcgcagaatgtatggggcgaactgtcgcaaacatcggaactccgctggccaaaattccatgccgcagactttgccccggagcaatggccaaagcttgcacataaggtactcagcagtgcgatcagtgagtgagccaaatccaatggacaaattaatcccagaagagccgaaaagagagcgaaaacggtggagaaaggagacgacattttggtggaagtatctgaaaaaaaacgagaaatgttagccaatttttcataaatgttcaattcactcgattgtaatgcatttaaatccgatgattttctttggcatcggcttttgcggaattggcagtgccttcccatgcgaattgacaattagtacttctttggtgccattctctccgattttgcgccaaatgtccattgaatcgaatgcccattttctcgttttaaagtgttcatcgacaagacagtcaaatcggtggctgagcagtgcaatttcgaggccaagctgagaaggcgcaagaaaagcaaagaccgccagccgccaatcgccacgggggatgaagcagctgaaaaacaattataaacttaattaattattaatttttgctacttttcttttttgtcgtcaatggggcgccgtcgtcgtccttttttgacgtgtcgttttttggcgtagtcccaacacatccaaagaatggcgcaacagccgaccaacaaaggcacaccgaacaaactgaaaagacggaatgagagaaagaaaagagggataaaaagaaagagagaaggaaagagaaaaagaaaaacatacagaatcttttttgaagacattgcggcggcaaaaggaaaagaaaaagtgagtgaaagagtgaaagaggcaaagagaaaagccaggacttttatagtgaagaacagtgaacaataggaaaaagagaggtacctaatttctgcgtaatacaacataccgtatttcctaaa

SEQ ID NO: 60663 - DNA, 1921 bp, Heterodera glycines
  Genomic contig location: Contig_ID=SeqID_6191; Location=203..2123; Strand=+
  SCN-specific regions: Sequence locations=1-22,58-110,132-472,495 -1005,1028-1441,1466-1480,1502-1921
atggaggagccgaggaggaaatacgacgacgaggaagaggaggaggcggaagcggcgttggtcagcgacggcggcgactcgtccgccgccacagacagcccaccgctgagccgcgcgttgctcgcgctgtggtgggacgagcactcggagacggacgaggcggacgacgtgcgcgcgtggggacgcgcggcactactcgcgccgcggcgtttgccatgccttggcaaaggaaaaggggggaaatgccccgattattaatcaactaattaggctattatcagaatgagtctaagtatttaccggttatgtccatttgccacccgcgtctgattattatgggcatctttttgttgctctgcgactgtcgccggtgtcttttttggcgccgggccaatggcagtgaaacgcggagagagtgacgcgcccaaccaccagcccatcgagccttaaaagcagagcaaatcaaatagattagcatcggtttcgtcattcgctgcttcttttacctgccgtactttcggatgcgctgcgcgcactcgccgaaccgcccgaagtcgtcggcctccggcgcgtgcatttcagcgccgcctccgctttgcactgtccgtgcagcgaacatgagcacattttgcaccgcacgccatgccgcatccaaagctgaaagtgcgtgatcaccaaaataagtgccaaaagcgtccacgccgaaatagtgtcctttttggtcagaccaaatgaccgttgggccaaattgtgcccgttaaaaccaaaaccgggattttcgattcaaaatgatgaggcgggaacacaacccgtaatgccggctaatatccctattctaattgaacaaaaatcccgtgactgtacccagagagtaattccggcggatacagttcaaaattcaccaatttgttgcaatgggcacaaacagcgggtgccagaaactgagcgtcagtccattggtgcgcgagtccgttgcggcgcaggccggccaccaaaacgctgctgtccgcctcctcctccgcggcgcccgccggacattttcgtctgttcaaccgttggaaatgcctgcacatttctgcccgactgatcagtcctgatcaaaagaatgatgtgagactgatcagtcatttaattgccgataaattcgcttgccatctctgtccgagtcaatttcgccaaatgcgtcgagaaagggaaaattggaggcgaactgtttgaactcggcacgcgaaatgtagctgaacaacaagcaaattgaaatcccaaaaagagatgcgttctcttttttggcttcctacccgtcccggtcgttgtcgtagtgtttgaacacggcgtcgaccattgcggcgatgtgcctgaataggaaatttttgcattttttggcaggaggtacggcggaaatctataatgaaaattctatcataataaatgataaattttgcaaagtttggccatggcccctcccccatcgtgccgggtctgatcagcagactgatcacacttcggattgattgactgattggtaacatggtcagtcagccaatccctcgctaacaaataagcattgtcccaacaccgacttgtccaccgtgtccgggtccggctgtgcgcatacgcccgccgcccaatcagcgaacaccgccggcggctccgccgcgccgctcggcgccgactgcgcggcagcgacggaagatgccgtcttcggttcacgctccagcgacagttggtacagctcacgctcatcgtacgcgatgtcgaacagcactttgagtgtgttgatcagatccaggttgacgtcgccgaaacagtgggccgtccgacaaacgccgagaaaatgggacaaaagttgcgagagttggaaaaggcctgcggaagtgcggcaccgatgaaacaaattggatggcaatgccctcggaggtaa

SEQ ID NO: 60664 - DNA, 4155 bp, Heterodera glycines
  Genomic contig location: Contig_ID=SeqID_6191; Location=1..4155; Strand=-
  SCN-specific regions: Sequence locations=1-92,119-278,302-315,337 -942,964-979,1001-1123,1149-1275,1297-1476,1498-1514,1677-1889,1932 -2452,2474-2488,2513-2926,2949-3459,3482-3822,3844-3896,3932-4155
  Gene Ontology: Mol. function=lipid binding; Cellular component =membrane fraction; Biological process=RAS protein signal transduction
gccgattccccgtgctgctcgaattacgcaaccgaaccgatggatttgttcgaattgatccgtcgatgttgcgattgtttcggtgtcctcccataataataataataataataataatttaatttgcatttaaaaattcaattcttttcagagggcgacccggctgagcccgatcccgactttccctgctggtttttctcggcctccgaatggctttgccccgaattggccgaattaatggccattttcgtttcgctttaccaggcaattgaaaatggaaaaaatattaataattaaaaatgatgtttttgcagaatgatccgctcggatatggccaaaaggtttgttcggccgtcggcttttggatccgtcggcacccggcacatttcgacgccaacgcccaattgggccgactgttggaccgattgaaagtcaaaatgagcaaacggtaaaacaataacaaagccaaaatggtttagaaattggccgccgccgatgaaacgatttcccgggcattggtcgacgaacttttggacatttcggcgatgtacaaaatcttaattttgaaaaatgaattaaatggcattttgtttggcattctgtccgtccagtccctcctatgcttggctgcgcaatgtctctgtgcgaaacccggtctctcgccacgtttcgctgtgttttgaacagtggagccccgaagacattgcgacttcgatgaggtgaaaaagttgagactgctcgagaattgaacgtttccgagactcgagaaccgaaaattggtgccgaaaactgagaatcgtccccaaaaacgagaccgagaatggcaccaagactaagaccacaaaaatccaagagattttccaaccgattagcgacgtcgagaatctcgagaatcctcgaaatacaagacgaataacaattgaaagcattttttttggtttagtcacattgatcacaaagtgctcagccgagtcaacgtgagtattttatgcaaaatattagcaaaattttggccttttctcccaattaatggcaaaggtttccgagttgaaacgctacgtccgcgtggggagactttgccaacaaacgccacttttggaacgatcgatcggaattttcaatgtaattaaatataattaaaaatttaagttttcaaactgtttcccctttagtccttctccggttgggtgcaatgccaagtgttaagcaaagcgacggcaagcgaacgcgctgaaatcatcacgaaatttgtgcaagtgggcagggtacggtaaagggagtgggggtgggtgggatactgtaggtacacagaaacaacagtaaccaagtgacaggtaacaaaataattctgtttattttttagcatcttcggcgcaacaataattttaacactttgatggccgtaatagtgagtttttttgatcatttaatcccatttcttccatttttggatttttcgttcattttcattctgaacatacactttaattactcattctcagtaagttttctgatcactcattcatttttctattcggtaaatcatttttcttttttcccatcgatcgatcatacattctaatcactcgttttccatttgatcactcacccattttccattctgatcactcgttttccagttgatcactcacccattttccatctgatcattcgttttctcttctgatcactcctgctgatccttcccctgttgagggtggcattacgcattcgaacgtggcccgcctcctcctcacccattccctcctcccgcccgacattctcgacgacctttccgccctcaccaaattgctttcccatgccaataattacgccgcttaccgcaaaactttgcgttcggtcggtggccgcttcaaagttccgataatgtgaaaagagggacatgactttctccttttttgaattcccataacatacaggggagttcatctgaaggatttgatcgcattttggcacagtgccgggttggaacagttcgaaaactcgcgccgaatgtccgaaaaatgtttgtttacctccgagggcattgccatccaatttgtttcatcggtgccgcacttccgcaggccttttccaactctcgcaacttttgtcccattttctcggcgtttgtcggacggcccactgtttcggcgacgtcaacctggatctgatcaacacactcaaagtgctgttcgacatcgcgtacgatgagcgtgagctgtaccaactgtcgctggagcgtgaaccgaagacggcatcttccgtcgctgccgcgcagtcggcgccgagcggcgcggcggagccgccggcggtgttcgctgattgggcggcgggcgtatgcgcacagccggacccggacacggtggacaagtcggtgttgggacaatgcttatttgttagcgagggattggctgactgaccatgttaccaatcagtcaatcaatccgaagtgtgatcagtctgctgatcagacccggcacgatgggggaggggccatggccaaactttgcaaaatttatcatttattatgatagaattttcattatagatttccgccgtacctcctgccaaaaaatgcaaaaatttcctattcaggcacatcgccgcaatggtcgacgccgtgttcaaacactacgacaacgaccgggacgggtaggaagccaaaaaagagaacgcatctctttttgggatttcaatttgcttgttgttcagctacatttcgcgtgccgagttcaaacagttcgcctccaattttccctttctcgacgcatttggcgaaattgactcggacagagatggcaagcgaatttatcggcaattaaatgactgatcagtctcacatcattcttttgatcaggactgatcagtcgggcagaaatgtgcaggcatttccaacggttgaacagacgaaaatgtccggcgggcgccgcggaggaggaggcggacagcagcgttttggtggccggcctgcgccgcaacggactcgcgcaccaatggactgacgctcagtttctggcacccgctgtttgtgcccattgcaacaaattggtgaattttgaactgtatccgccggaattactctctgggtacagtcacgggatttttgttcaattagaatagggatattagccggcattacgggttgtgttcccgcctcatcattttgaatcgaaaatcccggttttggttttaacgggcacaatttggcccaacggtcatttggtctgaccaaaaaggacactatttcggcgtggacgcttttggcacttattttggtgatcacgcactttcagctttggatgcggcatggcgtgcggtgcaaaatgtgctcatgttcgctgcacggacagtgcaaagcggaggcggcgctgaaatgcacgcgccggaggccgacgacttcgggcggttcggcgagtgcgcgcagcgcatccgaaagtacggcaggtaaaagaagcagcgaatgacgaaaccgatgctaatctatttgatttgctctgcttttaaggctcgatgggctggtggttgggcgcgtcactctctccgcgtttcactgccattggcccggcgccaaaaaagacaccggcgacagtcgcagagcaacaaaaagatgcccataataatcagacgcgggtggcaaatggacataaccggtaaatacttagactcattctgataatagcctaattagttgattaataatcggggcatttccccccttttcctttgccaaggcatggcaaacgccgcggcgcgagtagtgccgcgcgtccccacgcgcgcacgtcgtccgcctcgtccgtctccgagtgctcgtcccaccacagcgcgagcaacgcgcggctcagcggtgggctgtctgtggcggcggacgagtcgccgccgtcgctgaccaacgccgcttccgcctcctcctcttcctcgtcgtcgtatttcctcctcggctcctccattcgctcgtcgttccatcgattgatccgacggacgccgaccgtaaggggaaaaagagagaaatgccaaaacgaaaaataaaacaatgcctaaatttgaaaggtgtccaaagaaacggtctcagaagagggcgaaagacagcgaagtgacgcaccagcggaaagtgaaaagtgagcaaaagccaagggaaggcgcaccttttaa

SEQ ID NO: 60665 - DNA, 659 bp, Heterodera glycines
  Genomic contig location: Contig_ID=SeqID_30235; Location=851..1509; Strand=-
  SCN-specific regions: Sequence locations=1-534,556-659
caaaaaaatcgattttttcaagtgtccgtgtggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 60666 - DNA, 587 bp, Heterodera glycines
  Genomic contig location: Contig_ID=SeqID_30236; Location=585..1171; Strand=+
  SCN-specific regions: Sequence locations=1-587
atggtagagaatgggaccgaaattaaaacataccgaaatgaacttaaatcttttcaagaagaagtagataaagccaaaaacacaacattagagcatgtggcaaataatgacatgaaacaagcaaagaaatcagccgacgtcgcaaagggaatcgccaaacaggcaaagatcaaatatacatcaattctcgagggatataatgataaatcggaaaagggttttagtggtaaggtgaataggcttaatgaggtgcttggtgagcatattaaacttaaagatattgaaaatagacaagtatctgaagctgagaaaggccataaaaaagagagagactagccaatgaggatgttcaatttcaatatgacagcattgatcaaaaatgtattgtctatctttccgctgctgtctcccacatagatttgtcaaaacacctcgcctatgtgctcggttttaagaacgcaaggctatttcacgcggaagaggcgaattatatgccagatttgacgggtggcgtaaggcaactatacatttatgcaccaaatttaatagaaaacacaattatcgggaaccagatggctccactctaa

SEQ ID NO: 60667 - DNA, 167 bp, Heterodera glycines
  Genomic contig location: Contig_ID=SeqID_30237; Location=1099..1265; Strand=-
  SCN-specific regions: Sequence locations=1-167
gcaagaaacatccgcgtaatccgcccctgtgcaccattgacggagtgcgaccgccgccggcaccgttgcagaagttcacgctcaccaagaagcagttgagccacaactttggcagtgcggcggtgccacaactggtggccgagttcaacaatttggtccgactttaa

SEQ ID NO: 60668 - DNA, 985 bp, Heterodera glycines; identical to SEQ ID NO: 30238
  Genomic contig location: Contig_ID=SeqID_30238; Location=1..985; Strand=+
  SCN-specific regions: Sequence locations=1-130,167-249,271-290,312 -439,461-463,501-614,636-741,769-985
  Gene Ontology: Mol. function=microtubule binding; Cellular component =spectrosome; Biological process=body morphogenesis (sensu Nematoda)

SEQ ID NO: 60669 - DNA, 465 bp, Heterodera glycines
  Genomic contig location: Contig_ID=SeqID_30239; Location=342..806; Strand=+
  SCN-specific regions: Sequence locations=1-465
tttttttgttttcggggcagtccccccgaaccgatgcgcccagatttatggggagaccgaatccttcgggaatagcttccctataccctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccattattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctcaggaaacaattgtttgag

SEQ ID NO: 60670 - DNA, 557 bp, Heterodera glycines
  Genomic contig location: Contig_ID=SeqID_30240; Location=407..963; Strand=+
  SCN-specific regions: Sequence locations=1-168,190-359,386-557
atgaacattgccgcacaattacatatcagcacggcaaagaccttgcagaagtgagaattacaattaattgtaacaaatctggggctatgagacctcagcataattatccactaattattctttccatggagtctaattaatatgctcaatggagattatttttgaataaaattgagaattatttcaaaaatattttgaattcgaatatttcggattgttcctctgatctgatttgctttttcacctcattttgatcatcaatttttcaaaccttattaggaatatggcatgttgttcttcgaatcaagcgcatttactgggcaaggcattgaggaaacgatgcaatcgttggcactgtgaatttaaaattattataattataatagtacaaattatgcatgattaattcgaatttagtcgtcttcaacagagagaggatgatcagttgaaggaattgataaaactcgaaaaaagacagggcaaacggcgaaattggtgttgtatttagctgggcctttttgttttcttattttcatcatttttttatatattacgga

SEQ ID NO: 60671 - DNA, 409 bp, Heterodera glycines
  Genomic contig location: Contig_ID=SeqID_6193; Location=336..744; Strand=-
  SCN-specific regions: Sequence locations=1-409
atgttatctcgtgtatttgggatttgtgttttttccgtcgttctcgactgtccgcgttcatatcctcgggccggtccaactgttacatttaataaaccaattatccaccctaatggtgcgttttgagttgagaatctgacgagtttaatttatttcagtttctaatgccagtgatcgtacgcggaatcaaatgtgtattaatttgttggatttatggaacgacacaaacaacttatcgcaagttgttgaaggcattcgaagtggaactatgagaatgcggccaataccgatgcagctgtaagttcatctgtttaatctgtcaaatttatcaattattttgttttcaaggcagcatatggtcggaacagggccaactacgaagcaatggtccgagggcatgagtagttaa

SEQ ID NO: 60672 - DNA, 123 bp, Heterodera glycines
  Genomic contig location: Contig_ID=SeqID_30243; Location=944..1066; Strand=+
  SCN-specific regions: Sequence locations=1-123
atgcgcgtggttccaattccggccaacaccgacaattacatgtatttgatcatcgacgatgacgacaaataccaaaaaggacatcgaccggcggcactcgttgacccggtgaatgtggaaaag

SEQ ID NO: 60673 - DNA, 515 bp, Heterodera glycines
  Genomic contig location: Contig_ID=SeqID_30246; Location=345..859; Strand=-
  SCN-specific regions: Sequence locations=1-194,216-238,272-515
tgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtaccc

SEQ ID NO: 60674 - DNA, 592 bp, Heterodera glycines
  Genomic contig location: Contig_ID=SeqID_30247; Location=267..858; Strand=-
  SCN-specific regions: Sequence locations=1-592
attttatgctaattctggctcttttctaagaacccctgcggaaatataaaagcaaggaagtattatgctcgcctttgcagcctctgtacggcactggggccaacactttatgtgtcgttaattttatgctaattctggctcttttctaagaacccgtgcggaaatataaaagcaaggaagtcttctgcacgcctttgcagcctctgtacggcactggggccaacactttatgtgtcgttaattttatgctaattctggctcttttctaagaacccgtgcggaaatataaaagcaaggaagtcttctgcacgcctttgcagcctctgtacggcactggggccaacactttatgtgtcgttaattttatgctaattctggctcttttctaagaacccctgcggaaatataaaagcaaggaagtattatgctcgcctttgcagcctctgtacggcactggggccaacactttatgtgtcgttaattttatgctaattgtggctcttttctaagaacccgtgcggaaatataaaagcaaggaagtcttctgctcgcctttgcagcctctgtacggcactggggccaacactttgtg

SEQ ID NO: 60675 - DNA, 1210 bp, Heterodera glycines
  Genomic contig location: Contig_ID=SeqID_6197; Location=533..1742; Strand=+
  SCN-specific regions: Sequence locations=1-177,219-265,374-382,406 -578,600-662,685-944,966-1117,1139-1210
atgccggaccggaccggactggtattttcaaaaatgaccggattcgggatccggtctctcataatccggtcaatccggtaatccggtcaatccggtaatccggtcaatccagattttcaaattgccggatccggaaccggattccggattggtaaaaatttaaattttcacatgttaattttggaaaaaacccttaaaatttcatctattatatgtagaaatttggtgcaccagaaaatgtcgtcatagaaaagacaatgcgccgaaaaaaatatataaaatttcaatttttcaaaaaaaatttaaaaaatttattttagagttttttatttttgaaaacctatgtttaatgaaaaaataaaaaattttttttgcggcgccctttttccaaaaaacttttgggaaagaaagtagtgggtccggcggtgccgataggcgccgccgggaaaaattttgaaaatttgaggcgatttgtaaacagattttcaccaaaaatgagcatttttttttgcttttttgggcaaattttttaaaaagaaaaaagttttggaggcccggcggtgctgacaggctccggcgggggagaaattgaaattttgaccatttaaagttaaagacattatgccaaatagatatttttcaaagaaaaacgaacaaacgtcaaggttttttggttgagaccaagccggaccggatccggtcaaaaattcgccggaccggaccggattggcattttcaaaatgaccggattcgggatccggtctctcataatccggtcaatctatgtaatccggtcaatccctatttttccaaaaaatcgccggaccggattcctgatccaggaaaatcgggtaccggatccggtccggtccgctctctacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctattagctattcttattttcagtgtcttcaataagtcgtttcaattatcttaggttcatgaaacaaattgttttcggattctttctgttttatgaatata

SEQ ID NO: 60676 - DNA, 75 bp, Heterodera glycines; identical to SEQ ID NO: 54636
  Genomic contig location: Contig_ID=SeqID_6197; Location=269..343; Strand=-
  SCN-specific regions: Sequence locations=1-75

SEQ ID NO: 60677 - DNA, 73 bp, Heterodera glycines
  misc_feature (19)..(19): n is a, c, g, or t
  Genomic contig location: Contig_ID=SeqID_30252; Location=1..73; Strand=+
  SCN-specific regions: Sequence locations=1-73
aaatgcgaaacgccaaaanatgcgaataatgcgaaaggcgaaatgcgaaaagcgaaacctcggcccatccctg

SEQ ID NO: 60678 - DNA, 1148 bp, Heterodera glycines
  Genomic contig location: Contig_ID=SeqID_30256; Location=207..1354; Strand=+
  SCN-specific regions: Sequence locations=1-278,300-459,482-528,550 -854,881-1038,1060-1148
caaatcccgataatcccgcgggatcccgaaaaaaatcttcgggattcatcgggattcggtcgggatcccgactcgggatccgtctcgatcgtttttccaaaatgttcgggattgatcgggatcgggattcagtcggtatcccgactcgggatccctccgaccccagttgtccggtctctactgcaaaagcccgcagcaatggacataaactcaaaccctatgtgttggtcaacagaaagcgaccggttccgcaaattatcaaccaatttgctggaaaattgttttgtttttcagaaaaaattagtgccaaacaatgttctcaaaattctatttatcccccatggggggtaaatggagactgggtgattattttttaaactcctcagaaagggggggggataattggagactgcggtattaatagagactgggctataattagagcatatacggtaagtttggcgttttataaattatttttgactctatagcactatgtgtccaatcgcattttttgagtccaatcaattgataaaacctaagtttgttcatgttcgaacaaaccctatctttttggtatcattcgaacgcacaaagtctaaagagctaaaataataatttcagcgtttaggcaattgccaaaaacgattgattaattaagcaatagttgattagtttcgtttgtaactttctttaaatgttaccattttcttgttttcccgtattattatcttattcagactttgtgctttcgatgataccaaaaagataggctttgttcgaacatgaacaaatgtaaaaaaccaggtatgttaattgattggactcataaagtgcaatagagcctaattttttgcttttctgaagtcatacttctctggcggctgctctagcgtcggctaggtcatcagcatggccagtgctaacaccgaccaatttgatttccacggccttgccggccatcgttgccattaatgctgctctcaattgcgctggcgtgcagtcttcattcggcctccgtgttgacaatgtttggccatcaagaccattctggccaatgatggtggtgctgatgaagcttttcgcgatgtcctcattcaataggaccactattgaatgtgccgcttcgtgcgcagcgaccaatgcgg

SEQ ID NO: 60679 - DNA, 854 bp, Heterodera glycines
  Genomic contig location: Contig_ID=SeqID_30256; Location=1074..1927; Strand=-
  SCN-specific regions: Sequence locations=1-459,506-662,684-854
atgaggtgggattggtatcgtaactgttgatgtatttttgaatgcgatcgattggccgttctggtctgaatcggcgttcgatttattgatagatcattcttgtcgaaaaatcagtccgatcactagtgaactctgaattcactgttcaatttgagagagcataactatttgtgcaccctttcgtgagtctaaaatggtgcagcgcccgaggagggagcagcttgttccccccgtatcatttctcaaaattttttttaaagaaattgaaaaaatctcagaaattatcatcaataaatttggttttggaatttttaaattaattttaacaatttcttaagttttcaatttcaaaaaggaggcaaatgggggcgagacactaaaaaagggggcaccaaacattgttttgtcagtttttttgcgggttttcgatcattcctccccccggtcattttaatgttcattatttttcaattaataattaaaaattaattttaaattattatttcagctcactgactacacttacgtggtgctgtcaaagcgcattacgactcgaaacaggtgaaactacacccgcattggtcgctgcgcacgaagcggcacattcaatagtggtcctattgaatgaggacatcgcgaaaagcttcatcagcaccaccatcattggccagaatggtcttgatggccaaacattgtcaacacggaggccgaatgaagactgcacgccagcgcaattgagagcagcattaatggcaacgatggccggcaaggccgtggaaatcaaattggtcggtgttagcactggccatgctgatgacctagccgacgctagagcagccgccagagaagtatga

SEQ ID NO: 60680 - DNA, 600 bp, Heterodera glycines
  Genomic contig location: Contig_ID=SeqID_30257; Location=2..601; Strand=-
  SCN-specific regions: Sequence locations=1-194,216-549,574-600
atgagtttgtttaatccaaacgaaccgttcgaaatgcgaattgaaacggtacaggaggagggtgaaggtaaggcaaagcaaaggattcgaaaaatcggcataaatccacaattattagccaattttagtccaaattataatcattgtactatgttgaaattgtggataaaactgataaacaacataaaatgatgaagcaaaatcacattttaatgttctggattttgacaccaaaaatatgctttatccgaattatgtttaattgaaatatgtaattttctaattccttttcattttaccccattgaattaagcgatttttcgaatacaatgcaaatttagtttttcttttttttgagcggatttcatctcacattgaatttattgtctttggcagagtttgggcagctcaacatcactattagcactccaaatggaatccgtcaaacaatctatcgcctcgtgtcaatgacctttcgggacattaactttattaatgtcaattattcctactaattatgactaattaattattcctactaattatgtctaattaattaaattaattatttttcctttttcagattgtcggttctcttga

SEQ ID NO: 60681 - DNA, 382 bp, Heterodera glycines
  Genomic contig location: Contig_ID=SeqID_30259; Location=316..697; Strand=+
  SCN-specific regions: Sequence locations=1-382
gttggcgactatctttgggtgttgcagtggacaaattgggagggcaaaagacaggaattggtgttggattatgtggtggagaggaaaaccctcgacgacctccgggttttatttccattttaaagagaatattcatttccattcagaggagcatcaaagaaacgcgatatttggagcagaaacagcggctgaaaaagtgtgggctaagaaatgttgtttttgtgctggagggagggacgacggccaacgaccggcagttggagcaggcgatggtgtcgagtggcgtggagagcgggttcctcgtccatcggacgccgaatgtgcaggggacggccaaatttctgcaaaatttgacgcgatggctcagagagcgttgttctaa

SEQ ID NO: 60682 - DNA, 125 bp, Heterodera glycines
  Genomic contig location: Contig_ID=SeqID_30259; Location=1..125; Strand=+
  SCN-specific regions: Sequence locations=1-8,32-125
ttaactcgcttcctccgtcctcctcttccgctgtgccgtccctctccccatcaaatgacttggacattgtccttctctctccgtcttcctccgttgccaaaccttcgctgctgctgagccattcg

SEQ ID NO: 60683 - DNA, 622 bp, Heterodera glycines
  Genomic contig location: Contig_ID=SeqID_30261; Location=438..1059; Strand=-
  SCN-specific regions: Sequence locations=1-89,136-271,293-317,339-622
atgaccacagtgttgttcaccaattcgatcatcagtcgcgagttccattctatgcaattgcgcttcaattcactttgcaggtcgattcgaaaaataaaattgaatttctaaattaattataattattaattttaagggatctttcatcagttgttcgttgcactctcccaataatcaaagataattgtggcgaaaagccggccaatttgttgctcaaattcatcggattggaattctcgaggtattttgatgaacacaggaggaattcgagaattgtttatgagcaatatgagtggggtttagttgggtgttcgacaatccataatgtttgaatggtagtcagacaatacagttggttcaaatcaaccgtaaaattacgtcttataaaatccggaatcttggctttttcaaaatttttttggcattggcactgcccgacactcgtaaatcaacttttgttgaagatttctctcaaaaaaaatctttggtgcaaaaaatttagtaattcctcattcgagaatgacaactgctgctatcatcaacatgtggtccttgtaaaaaactattaatccaagaaataatttttgtacatataagatttagtgattaatttcataataaa

SEQ ID NO: 60684 - DNA, 1249 bp, Heterodera glycines
  Genomic contig location: Contig_ID=SeqID_30262; Location=184..1432; Strand=-
  SCN-specific regions: Sequence locations=1-630,652-677,722-729,751 -1032,1055-1249
atgatgtccatgtgcgagcacacgtgcggcctgtgcgcagccgacgcatgttttgacgcggccgacgactgcacgtcgttaggccatctgtgcttccaccaggccgtctctccgctcgtccgtcagcagtgcgcgcgctcgtgcggtctctgcacgccgcagcaacgagcggagacggcaccacgcggcggaggcgcggagtcacgagaagtggttggcgtacagaagacgcctaaggaggtaattatattaattaagcgaaagccggaggaataaacagtttaaatggtcatttattagggaaggatttgaattccaatgcctaaaaatacggagtttggtttattaattcgagctttgtgccatcccctggaattacgttcataatttctcatcgaatggcatacgcatttaagcaaaataagtatgtggataataagtagtagtagatctaatctttcagctcagattattcatactaattgtaagtttaattttcggtcattgttcttgtgcggaaaaacagtcaaataactgcgagtccaaaaagtgccatttgccaggatatgtcgccttcgtgcgcggacaattcagggctttgtacagataaagtgacttttaaccaaaaactttttgcatttgttaaatcaattaagaatgtctaattattatatcccttttaataatattttaatttatgaattaattttttaaaaaataactgaaaattaacaaattttacacataaaattggcctttcagatctattccgactttctcaaggacaaatgtgccaaaacttgtggccattgcttatccgaagaagacaaagttcggcttgggaatgattacggcagtgacagcagcaatagcgaagattatgaccaaccctttgaatctgttcgacgcattcgaaatcgtccttcagctgctccccccgccggcgggcagaaaaattcagcggacaatggcactaccgttgcccaaagggccaagggtacggtatttcaataataaaaaaagtcaaaatcatttgcattaattgtgattttttggttcaatttatcatttttcagaaggctcttcaaagcgaagcaaatcaagtggaaaattttccgagcgaattatcatagaaattgggggcggtgatcaaaaagaacacatcgaattgcgggggaaactcggcgaagcattacggtactaaaaacaaaaagatttaaaatcgaaaaacaaaatttaaaaaaataaa

SEQ ID NO: 60685 - DNA, 112 bp, Heterodera glycines
  Genomic contig location: Contig_ID=SeqID_30264; Location=518..629; Strand=+
  SCN-specific regions: Sequence locations=1-39,103-112
atggaaaaggagaaactttggggagggattgaatttcgtgagaaaaacggagaatggaaggaagagatggagaggaagaaggagcagggagaagagagagagcagagcggag

SEQ ID NO: 60686 - DNA, 751 bp, Heterodera glycines
  Genomic contig location: Contig_ID=SeqID_30266; Location=612..1362; Strand=+
  SCN-specific regions: Sequence locations=1-217,260-359,382-460,495-751
atgaacgccttcttttcgttcggcatttttcttgccattcaattccatgcccaatttgttttggctgatgttacggcctcaataaagccatcgtccacatggaacggtggtggccaatacattttgagcttcaagaacaatgacaactccaagacagtgtgctccgtcaaattcacgttgaccccagcaagcggagtaaaaataaaagaaatgtgcaaaatgccaaaatataattttttaatggggaaaagtggaaaaatgccatggaattaattaagtataaatgccaaaaaattttggaaaatgtcaaagaataattttaaaaatggggaaaatgtcaaaggataattttataatagggccaaaaaatatttttaaaatggaaaaaaatcataagcaattttttctttttctttgtccaaaaagaaaaatatttttcaaaatgaggtaaatggccaagaaagctttaaaaatagtaaaataaatttactccacccattaattgatattatcttcctaattactccgctgattcatcattcacaaattactaattagacgtccatctcggccaagtggggcttcgacgcggtcagtggcgcttccaaccaatacactctgtacaacaatgccgacatagcaccgggcgccacaaattcaaatggtggcctcaacattcagggcaccaaccctaacggaccaccagcaacgccaacactccaactgattgaggccaaatattacagcaacg

SEQ ID NO: 60687 - DNA, 787 bp, Heterodera glycines
  Genomic contig location: Contig_ID=SeqID_30269; Location=9..795; Strand=-
  SCN-specific regions: Sequence locations=1-679,701-710,732-787
atgaatcgtcattctattcaatatttaacaagtattgggtgtctcaaacaatccactccatctcataatcggcgggtgtcctctcaagagtcccctcgcgcgttaatgacgctcccggggtcgagctctcgatcactatactcagatctggcctctccctccgggcagtatctgttcccgagccgaattattgtaggtagagagcctaagaattgtatcattcctttcccggaataaagtcgttactgttgcatactgtattgaaatggtaataatgggatataaaggagtctacagtaagccagggcattcattgtcatggttttgaaagggaaatacaaaaggaaagatcaaagtaaaactgagacaaaaattggaagattattaggaacaaatagaaatttaatacagaaatgggaaaatgaattaaatttaacaaaaacaaaattaaaaagcgcatttgaggagaaaatgaaagaaattattgaacgatttgatgaacttaaagaattatatatgtacccaaagaaaacagcagaaagaatttgtgaaagaattgggcatttcggaaatgacctttatacgatggaaaaaagaattggtgccaaattaccataatagtaagagaaatttcaaaaaaacttttttcttatttaattcaccattctcgaataatgaaaaatttaaaaagatgcaacaatattttgaactaaaagaaagaaacttcaaaattagtgacgaaataattgccacgaaattggggattggatcagcaacgctgaataaa

SEQ ID NO: 60688 - DNA, 428 bp, Heterodera glycines
  Genomic contig location: Contig_ID=SeqID_30269; Location=1223..1650; Strand=+
  SCN-specific regions: Sequence locations=1-106,147-155,178-192,214 -247,281-313,351-428
atgtgtcgaccatttagatatgctattttatattataatcagattggcataatttcttttaataatggcctagtaacaccgaaacaattcaagagaatgatcagcataaatattctaatcaaatataaatttgtagtaatttgttagagaatcaaattttcttgaaatagttataaatttgacccaagctgacaaagaaaattttatgggcacctatttataggacagaatacagcctaaataatggattaattttttattttatgaattattaattttagccattaaaaaaattggatgaaaatgtaaattttagacaattttttggaatttacattttgatattgattttaaatttgtaggtacaaattaaacatgaattgcattactttttcagaatgtgtcgaccatttagatatgctatttga

SEQ ID NO: 60689 - DNA, 529 bp, Heterodera glycines
  Genomic contig location: Contig_ID=SeqID_30271; Location=299..827; Strand=-
  SCN-specific regions: Sequence locations=1-529
atgaatgtcgacacaggagctcaggcgacagtccttaccattgaaacatggattaaattaggacaacctaaattgttgccaaccgacattgagactcgcaactgcaacgacgtcacatttaaaacaattggcaaatttagatgtcttgtcagcattatgggacaaccagccaaaaagctaacagcttatgtgactgaagagctcaattacgatttgtttggtttgccatggattgaggcaacggaactgattcccaaagaaatcatgtttccggagacgcacacatcggttggaatccgagcatcatctgccgcacctttccaagaaatagccgatgttaagtcactcacgacggctctcaaagaaaattttccggatgtttttggtaaagagctaggacagtgtaccaagattaaggcacaattgattcttaaatccgacgctcgaccggttttctgtaaagcccgacccgttcctcatggctcactggaagcagtcaacacggaactggaccgcctcttacagatcg

SEQ ID NO: 60690 - DNA, 1718 bp, Heterodera glycines
  Genomic contig location: Contig_ID=SeqID_6200; Location=545..2262; Strand=+
  SCN-specific regions: Sequence locations=1-297,320-325,347-568,593 -692,714-1030,1052-1289,1315-1718
  Gene Ontology: Mol. function=structural molecule activity; Cellular component=clathrin coat; Biological process=vesicle-mediated transport
ccttccaaatctggtcttttgtatttgttcaccaaacttgggtatgttcatttgttcgacatcgaaactggtacaaaagtttgcaacacgcgcatttcggacaaagccgtgcttttgtcgacagaactgaaagaggatgacgaagtgctctgcatcgatgggtcgggaaaggtccgtcccatttcaaaacggaaatgcatataaacatttacaatcataataggcaattttaaatctaaaaatgactaccaatttattatatttaatgacttaccaaattcaggtcattagtgtcggtcttgataagtcagcaattattccgttcatattgaaacaccataaaaacacggaattggcgcttaaatttgcttctcgttacaatcttgacactgatggggtcactgtaattgtgattaatttacttttaagacatattttccttcttcagtctgacagtaacaacaatgatcaacccgtggctattcaagctcatcaccaatgccaatctgtacaacaggtgcttcaaagaaattcatctgtaaatgcaatgggattacttatatctgtttctaattgttttaaaaatttagtcgagcatttccaatggagcaaattctggcatctccaatgggacggcaccaatgccattgttcgagtcgaccccgagaaacgtgcttgttttcaaaggtgttcttttaaatcctttcaaaaaactctttcgttaaagaaaacgtcggacgcatcggctccgtttcttttacggtcacaaatcgtgaaacgtgtgccatttacttcaagatcaagtcgacttcaaatagcttttattcaatttgtcctgaaaacggaattatccaaccgaaagaaaacgtcgaagtgattattaagccaaatgatgacgagcttggccaatttgcaagaaataacgaccaaaaagcacaagttcttgatcatggtatcgagctgctgttttcggtttttcttaaattccttttcagtcggcaattgtttcgaatttggcagtgcaagcggaaaatttttggaaaggcaaaaagcacttctcagaaggtgtttattccaaaaagctgaagacgaaggtgaaagtggcattattatactcaaaaataagttttaaggtgcaaaaaactcctcacaatcagcaaaattccgaacaacggaaaggctcaacaaacaaaggaaaaatgtctaagaaggggaaacaaatgatggaacaaaaagaaaaagcatcagaaccgattgaaatcccaaaagcggatttgggagagacatcacaacactctgagggactgttggaaaagcggtcgaaaaagacgtctccaatcccagagaatttggaaacgatcttagagagcgatcgggagcagagtcagggattggcttcaccagcaccggagagctttcaaggctttgagttggttccacgtgtcgccgagacgtcaaacaattcggaaggagtgtctgttcaggaaccgaaagtggaggccaatcgctccaattcatccgtcaatcgtttatatggtctaaaaatgaattaccgttgtctcacctcctaattggtatttttttaaattttagctcaatattctgccgaaattgcattgtcactgctcgaaaaaatgtcagcgagggatgccgtgcagttcagaatcgatttgaacagctttttggagaaatacgaggctaaattccttgacgaatga

SEQ ID NO: 60691 - DNA, 1221 bp, Heterodera glycines
  Genomic contig location: Contig_ID=SeqID_6201; Location=693..1913; Strand=+
  SCN-specific regions: Sequence locations=1-252,274-372,394-533,565 -1221
atgtcaacattggccgactttttcctcgacgattacatttttatcgcttacggcacggaacgcatttctttggacgatttttttgtcatttctgaaggtattcattttcccccttttctgtctgtttttaattttgccgggtttttaagaatataaacggatggaaatcaacaagaacaaaccaccgcgattgaacggacaattccgactcagaccgacgcagctgaaaatgctaaacaaacgcagcgaggggaaggagcgccggaagaaaggggacggcacttccaacggaggtggccaatcggagggggcggatgacttttgttttcggccattgcccgtgggacggacttttcaaatcttggccaaagaagcgtatttcttacatccgattcccaaaacacttcaaaatggagtgcgtttttacatgttcagaggtcgaactgccaatggaactgaaggaacaagtgaaaatattggaagtgctcggcgacggaaacaccgctttggtttataaggcggcattcaggtgggatggatttgcaaatgtttaattactcaaagttttctgttttgctttattattacttaaaaaaaatttcttttaggaccgaaaaaagggacaaaaacgaggaagagcaatggatgacggatgcgcttaaaattgtgcgcgaagaaacccttcagaatgacgaagtgcttggctttgtgcgcaccgaagtcggactgctcggagtgctgagccacgagcacattgtgcagttgagggacgtgcagattttggacgggtcctggttcatccgcatggaacttgtccaggtcggagtccaatcttgaaattggaaaagacaaacccaaccaactcgggaggattggaaacgccatttcacagagaaaattaaaattcggcttcaggacggcgatttgttcgaacttctcaggaaaaaacgaactctcagcgaaacggaaaggtcaatccgtaaaaaaataacaaatatttgtttattcgccttttccatgcctccttagtctctcctcatggtcttttttgtttgttttgttttgtttacaattcctttgcgtttcagtgcgagttgtgccgaatgcctttgccatgcgcttgattacctccatgccgagcattggatagtgcacagagacgtaaaattggagaatttactggtgattcattcaaaaactggatttcaataacaattaaaa

SEQ ID NO: 60692 - DNA, 793 bp, Heterodera glycines
  Genomic contig location: Contig_ID=SeqID_6202; Location=585..1377; Strand=+
  SCN-specific regions: Sequence locations=1-11,39-130,152-529,573 -604,646-793
atgcgttttggccaaaacgaggaggaggaggacggacatggggatgctgattcgtgcgattttgcggtgtccgagtcgagcgccgagtttttcttctcgagacgcgccagcatggacgagctcagcgagcagggcgggagcagcagcggaccaccgatggatcaacagcagaaaacaaatgcgaacagtgatggaaccaacaaaaagggaggcattgaagcggcaaatgttgtcggaacaagtcgaagagagagcgtccagaagcacattcaaattggcaccacgacaccggcgacattggcattggcactgaatgggacaacgatggacggcgagacagcgacgacgacgggcaaagaaacgccgaaagtgggccgacgggtggtggttggacagcagcagatgaggaagacatgagcagacagcgacgaagggacggattatggacggaggaaaagcccagaaaaacggaccctaaattatggaccgattgtttgttgccaaagttgctttctgttaatcggtttactattattatatatcatcatattattttattatttattttatttccctgtaacattcttctgatcaatcattgacattcactcttcacacactcccaaaatgactcgtttaaagttgccaattgttctcaacaccgaatgccatttttgtacattctttttcatatgcaaccattcgatatcgccaaatgctttatgatcaattacatggtgggcatttttgcctaattgattgttttgtgttaacagagatgtaaaatcaagaa

SEQ ID NO: 60693 - DNA, 377 bp, Heterodera glycines
  Genomic contig location: Contig_ID=SeqID_30272; Location=493..869; Strand=+
  SCN-specific regions: Sequence locations=1-119,141-185,228-281,303-377
atgaaatggatggcctcgcaatggaacactttgatagccggatggcattggttgtggctggacgaagtgaaaatggaggaggatgaagaaatcgaggacgtctcagtggtggtgccatgggcagaggaggcggaggaggacgagcagttcccaatgttttttaccggccttttacgcatccactgaaaaattttaaaaatttaaaaatggtttttttttaatttttagggcttatagaataccaatctttggcatcatgacaaaatacccaaggaaatgtacctcataaaataaattgagaaatttcaaaaaatctaaaaaatattatgacaaatcatacaatgtgggttggcaacttagaaaaaattttgagaaaa

SEQ ID NO: 60694 - DNA, 254 bp, Heterodera glycines
  Genomic contig location: Contig_ID=SeqID_30272; Location=1000..1253; Strand=-
  SCN-specific regions: Sequence locations=1-254
atgcatgtccatttgcaaagtgtttttgtgggctatgaccactgcttgacaacgccgtcctctccattccaattaaggtttgttttgggagagttcattcatttccatactcttttttcaaaatatgaaattgattttgactgttttttagggttgaaattggcctggcctatctgacctcgaacattgtcaaagacattgcacgcttgaaatttgactgccatctccacgatttgatcatggtctgtttttaa

SEQ ID NO: 60695 - DNA, 1422 bp, Heterodera glycines
  Genomic contig location: Contig_ID=SeqID_30275; Location=8..1429; Strand=-
  SCN-specific regions: Sequence locations=1-665,688-850,873-1054,1076 -1076,1099-1203,1225-1422
atggtggcaccggcgtggggagacgggccaaaaaaggaggagtggccgaggaacggaggccacggactttgtcaatttgctcatggcgaattgggcgatgtgagacggttgttggcaccggtgccggcagtgccatgccgtgccacaacaacatcaaaagcactcgcccattgagacgcatgagaatttgcaaagtccgtgcactttgtgttctataaaaagcccatgattgaaggaagacacgtggaccacgaaccagcaagtgttggtcaaaaatttgtcatgaaattcacattaaaagaaaattttgtcggaaatcggaatccccgcccgagaactgaagaatctgaattatcgacatttttgggctcttaaatcaggcctatgaatcacgctttcaatttgaaagccaaaaatctgtctcgaaaatccaaaaaaaaacggaaaggcttttaatttatgtttttcatcggactgcaagtttaaagcttgggacactaatttgtaagcgaagtgaccgagtgaggcagtgattgactaaattaaaaaaattccattaaatctcaaaagcggtaaacgaacatttctattattcatttggacgaaattaccctctgagctaccagcagttgcaatgctcatttgtctttcccttttgggttttatgcattttaactgtccactggctaatccttacaatcgcatgtgcggaaagcatagatttagcaaatcaaaagcgtattcaaaaacaattagcatattctatctgataaaaatagtcacatttaatttaacattcataggtattattatatttaggtttctaacaaatacacttctaaaaacagaatatttttgataaaaattcaaaaatatccatttttcatgttcaaattctagagatcggaattttcaaatctgccgggccggactgatattttcagaagcaactggtttccgggaccggcctctccaaactgaagttttccaaaatcacaggggccgacaaaaagcggtgccgggcccggcacggtccgttctttataaattcctattttaaataaattctttgaaagttctttgattttcaaaaacccagatgttcattttcatcctttattatttaacccgcatatttattacggaaacgccgaaaagttcgcaccattcgatggtaattgaattttgcagcgtttttgttacttttttagcaaattttaatttgcagggcacccgaaccgttcctattgactttgaggatgagcgcgtgtccgaatctccgcaacttccgcctcctccgactgtgccaattccgatgggccatctgaacgattcggagtttgaacagtggtgcgagacggaaattgacgaggcaatggaagagtattgcgacgctgtcaagcagtacacggacaaatacag

SEQ ID NO: 60696 - DNA, 954 bp, Heterodera glycines
  Genomic contig location: Contig_ID=SeqID_30276; Location=1130..2083; Strand=+
  SCN-specific regions: Sequence locations=1-240,266-626,669-731,771 -856,878-954
atggcacggactgcacttcgttgtgcccggcccaacaaatggtgtccaacattggccaccaaaaaccacgctgattttttgtggtggcttcaaatgatgatcaaaaatgggacagaaatgcgcaaattttttgacataatgcttgaacagatcaaggcggaggtggaccaattcaacaagaattgtgaagaaattgttgaaaaatgggcacaaaagcacaaaaaatcgaggacagcaacaaattcatcagcatcaatagcatcatgccaaaactttggacaaaatgtgccaactttgcaaagttattatgtctattatcaactattccggcatttgaacacaatcagagcagcacaaacggttaattagggtgtaaaaagggcaaattagtatcattaaaaaagtgggaaaaaacagtattagtggaaatcaacattcaaatttattacaaacattaggtacacccaaaaattgggaaccaaaattaagactttccaaaaattcggtcttagcaagttagggtttctggaattgtcattattctactagctatttttttacacagttatttgtccaaaaatgccaattaaataagcacttttttgcttataaaaattaaaactctgaaaattaaaaaaaattaataattttaagttaatataaaatttccaactttttagatgacatctgagcactatttgctcagttattgggttgccacaatgactgaccaattaaaaatacaaataaaatattttgcaaccaaaaatggatgtgcagagatgattcaatcgttgatctgatcattattttttttacctcaatttggttttcgaaatttttttttgtgcgaaatttaataattgccataattattgaattgagcctccggggtctgtatttccaatcccttccccttgaaaggctctgtggggatggacctaaaataattca

SEQ ID NO: 60697 - DNA, 321 bp, Heterodera glycines
  Genomic contig location: Contig_ID=SeqID_30277; Location=800..1120; Strand=-
  SCN-specific regions: Sequence locations=1-321
atggcattccaatctctgggactcaacccaccagcatttcaatctctgagactcaattctaaggctttccaatcgctgggactcaacccaccagcatttcaatgtctgggactcaaatctccggcattccagacactgggactcacccaccaactttcaatggcattccaatctctggggctcaacccaccagcatttcaatctctgagactcaacccaccagcatttcaatctctgggactcaacacaccagcatttcaatctctgggactcaaatctccggcattccagacactgggactcaacccaccagcattttaa

SEQ ID NO: 60698 - DNA, 116 bp, Heterodera glycines
  Genomic contig location: Contig_ID=SeqID_30281; Location=878..993; Strand=+
  SCN-specific regions: Sequence locations=1-116
taggctaatagagcctgtgaagagctttcgaatgatatcaagattgtttgattcggtcaataacttcaagagttatattgactcaaagttggctcagacggagttggccagacgga

SEQ ID NO: 60699 - DNA, 482 bp, Heterodera glycines
  Genomic contig location: Contig_ID=SeqID_6203; Location=257..738; Strand=+
  SCN-specific regions: Sequence locations=1-219,263-282,323-482
atgcgactacacgtgcatcacgcccaccaggctgttatctcatcggtgggtggatgtgaccataaatagccaaagttttaccgttaattattgcgaaataaacatttttaaagcgaatgccatgcggcagcgcgtgccggcacatccgccgatgcggcgcgacaatttgaggacgaggatggccaagaaggcatcagtcggaggaacgagaaggtgcggaaaataaaaatactatttatgaattaattttaaattaaaaaaaggtcgcagaatttaagtgcgaatatttattttatgttatttttaaataaaataaatttatgcttttaatgctttaactaacacttaaattgcctatataaggaagtgattttgttcagtctcttcagttagtcacttacagcaggaaagcgcgaagatccggcggaaatcaagagacacacactttctttcagattttgacagccttttctccaatttga

SEQ ID NO: 60700 - DNA, 2481 bp, Heterodera glycines
  Genomic contig location: Contig_ID=SeqID_6204; Location=539..3019; Strand=-
  SCN-specific regions: Sequence locations=1-583,605-1076,1293 -1447,1469-1478,1502-1652,1682-1762,1802-1838,1860-1957,1981 -2266,2289-2400,2444-2481
atgctttgttttcttatcctggtaccctgccagatcagcatgatgtaatccaatttcaaatgaaatcccatttatttttccagccaccaacaaaatgccagtctagcttaacaccattgatggcacatcgtggccaattgttgccgccacatcgtacgacggctcatttgccggccgaaagtccgcccccgccgcgccgctttgccaccggtggtcgtactcaagtgttgccactgacggcacagaattgtcgtcgagtgacgccgcttgtcatgctaatggctgaccagcaacagcaacagcgtcaacagcaggtgaatacggtagagaggtatacggtataaaaaaatagagagcgaatacgggccggaccctgtatacggtttttcgaccgatacgggtttttacagagtactgaattttacgggttctttagctgatacgtccgtaccccatataggtgcccagctcgtaatctttatccgttccgttttctgtaattttgcttttttatcctcctttaacattcgaataatgcaattagggggtcgaaaaatagagcccccgggctctattataggaaaaacggtaattttcttcataaagtttccggttttgcggtttggcatcaccagacctataatttgcattattatttttttaatttcgcccaaaaattacattagtgtctcaatattggtgaaaatgatttaatcccctttcataagatggatgaacagcagggatttgacttttggtggcatttttaattaaataatttgtttttttgatcagtgatcagacattgtccgtacagattgcacgcggacggatgccaacaacatcggacagtcgcgcaacaacaaccactggaacgaatagcgcaatgaaaagttgcgcaaccattcatgaggatccggaggaggcgaatcgactgttatccgacgagcttctctccattgatcgggtaaaattgttcgaattcaatttacttgtataatattccactctaatcagcagattaaattcaccaaccacccgtaatttttttttgaaaattttcaaacagaaatatcaaaaaaataaaataattttttttaaaagaattcaaatttttgaaatatttttctatcgtttttcaaattttatgatggattactaattttttttaaatttttccaaaaaatctctaaatttttcataaattttttcttagaattttcttataaaaaatttttcgaaattttatttttttaaatttctaaatttgaatttttacttaaaaaatttttgcggcgggggcggggaacataatgcactgttgcattttaaattgtacccatcttcccagacatttgtatcagttggagatgaacaattgcaacagaatatgtattacgctgcgcatcggttgccgataaatcagcaaccgcccacctttgaggcaagcgataaaattttttaaaaatagggccctctaattaaatttaattttaaatttccaattttccaggttcaacccccttcatattcaccaccggaaccgcccaataataaaccattgacaattaatatttgtcgtgaaagcatcaatttctcaaggtgtacggctcaaatattaatagggcatacataaaaccgttagatttgtgaaaataaaatttttttttaaaattattttcttttcattataaacttaaatgcatgaaattttaagaaaaccctcatcaattcttctactcaccattataagggatacatatttaaaagaaattttcaaaaatttttgctgaaaattttgcgagtaaatttctgttctgtttttttttgcagtgcgcaaaaaattttaaaataattttggagaaataatttttggattttttggcctgaagagtaacaaaaaaaaatttcaggctatgggcctgaattatgccctaaatccccataaaaatctaccaaaaagtttaaaataatttaatatttccaacaggtgcagttacggtggtgctcagaccccgttgaacaccacaactggctcatcctcagctgacccaagtgtggacagcattctgaacggctgtggtcgccgaggtgcgcaggtgcgcatttccgaattggagtccgaaatcaacgcggacggcacgccaaattgtgccaatgtcgttaccggacaactcgagccttcgtgccatgccgtgatgtgccgacgagtgccgcgcagcatttcgcagcagttggaactgatgaacatggcccaacaacaacaacccagtcctgaccagcaacagtagatatgatggatgacacgaaattacgatttctgaattttttggttcgaaattccgtgtttcggaaaaattttgggcctcagaatgcttcgatttgacaattgctcaaatcttttttttaaaaataattagaaaaaatttttgtaaatatttttcgacagtaacacattttactgtatgtatgtataataaa

SEQ ID NO: 60701 - DNA, 367 bp, Heterodera glycines
  Genomic contig location: Contig_ID=SeqID_30282; Location=504..870; Strand=+
  SCN-specific regions: Sequence locations=1-367
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacatacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggttatcataaaattcatttaaa

SEQ ID NO: 60702 - DNA, 1065 bp, Heterodera glycines
  misc_feature (10)..(10): n is a, c, g, or t
  Genomic contig location: Contig_ID=SeqID_30283; Location=182..1246; Strand=+
  SCN-specific regions: Sequence locations=1-123,145-1065
atgcgtttgnaggcgcgtcagttgggaatggcggtggaagagtgctttccggattggccaaagcttcggcaacaatactgtcgcattcggaaacaagcagtcagagagcgcatgcagcgcaattgggagatgatggtgatgatgcacggcggagagagaatgatcgacgaagactttgacgggcaggagcaatattacgacggatcaggtgccaccctaattaaaaaaagtttttgcagtaataaaggggaagggggccggggtaaaatgcaatttttttaattgaaagttggattttttagacttttcttatggtcggcaattacaacaaaaacatcgaattcctcctgacattgacatggacgtcgatgtggaggacgacggcgatggaaatttgcgctgaatgagacgagaaaagggaaaatctcggctacatgacatttcgcctactaacccaaaaacattcatttcgcctactaaggtaaaatcggacattttgcctactgacatttcgcctacttgttattccgcctaccaagccaaaaacattcatttcgcctactaattagtaggcaaaatgaatgtttttggcttaataggcaaaatgaatgtttttggcttagtaggcgaaatgtcagtaggcgagatgtcggtaggcgagatgtcgagtaggcgaaatgtccgtacaccaaaatctccattcttctattgactattaatttgtttttggtactttttgtaaatgcataaatttgtttatacttttttttgaatcctcaaaggtttctctcctacaaattatctattattttcgtttttaatggtaaaacaatttttaaaattcaaccttttttatttgcagatgaaccgattaacaaaaatccaatcgttgaacaaaatcaatgaacgggagctgagcttgggcatttccggcgatttgggcaaatcgtggcaccaaaaatacgccgattcggcttggatttacgtgggcaatttgccgtacgatctcaacgaaggcgatgtgcttgcagttttttcgcagtatgcatgttattttgttattta

SEQ ID NO: 60703 - DNA, 538 bp, Heterodera glycines
  misc_feature (27)..(27): n is a, c, g, or t
  Genomic contig location: Contig_ID=SeqID_30284; Location=731..1268; Strand=+
  SCN-specific regions: Sequence locations=1-138,160-204,227-251,274 -310,334-341,431-538
atgcaaaagatttcaaaacggcattanatacagcagctaaagaacagccaaaaagcagcagcagggttttggagccattttaaaaagattttgacgaaaaagagaaatgcaataccaaatattcaaatgctgaaaataaattaaattagatattaaaactttctttttttggcaaaatgcttttttattaccctttttgaaaacaaaaaaatttaattaaatattagaaaattcactttcattttgaaaatttttgtgcatattttcagtttttatatgtgcgtcttttgcaatttcatataactttacgcataaataataaattaaaaaacagcaagtacatataaatatgaaaattaaaaaatttctgtaataaattaaataaattttaattaacaatttagattataattttaataataaaattatagaaaatgcaaaaaaaaacattcatcaaagaagagaaaaccaattaatgtacaataatttaaaaggaactttcttaaatattcacaattaaatagaagtgatactgaaa

SEQ ID NO: 60704 - DNA, 812 bp, Heterodera glycines
  Genomic contig location: Contig_ID=SeqID_30285; Location=25..836; Strand=+
  SCN-specific regions: Sequence locations=1-33,55-136,199-254,360 -425,447-730,753-812
atggctttttcgaccgtttgcatgttaatggattttttcaaatggatggcttttggagttggcacaatttgcaatgtactaatgagccgcctgattatttggcacactcccaaattaatgcgaatttacagcaaagtaattataaataaaaaaaatttatctttttgaaataaaaactttttatttatagattttattgcaaacttgcgcagctgatcttttattgctcataatgaccatactttttattccggtaataataattgttaaattcaatattattaaaaaaaaatttcaaaaatttttaaaaaagtaaatgaaaaaagattctttttttgaatttattttaaaaaattattgaaaaaagtaatgctaaaaagcacgaaatttaagaatttctacaaacaaaaatttgtcagaaaattataataatttatttccaaaacaaagttttatgtcatttagtacacctttacaacgaacaaaggcgaacagatactgatagcaggtggtttgatcaatttgaatggatcaacggcagaaaatcatggcttgattttgctagcctctgtttcttggacttttctcgtaatggcatcattgtttagctatgtgtcacaattcatttaccgttaccttttgttaaattggtctgcaaacattttaacttttacttaatttgaaagaattggataaatgggcaaaccaacaaattctaaaaatttctaaaattgttgattttttggcaaaatttgagggaagctaagaaaaaagcaaccagtggcgcatggataaatttaaaatttttggaa

SEQ ID NO: 60705 - DNA, 814 bp, Heterodera glycines
  Genomic contig location: Contig_ID=SeqID_30286; Location=16..829; Strand=+
  SCN-specific regions: Sequence locations=1-500,522-596,625-683,809-814
atgggcactaaaaatgggagaattccttatgaattgcttttcgaactcatttccgctcttccgtttgacattcgatgggccgtcacccgggtttccaaggcttttgatggttttgtttggcagaagcaattttcatgggttagagctgaactgacccgcaaggaagcacaaaggcaaaaagtaggctaattactcgctaattatgtggggttttggcacaaaaaaattggcacaataatggtgagcacatttgtaatgcttcttcatttagaaactcgagttccaggaagctgcccaatctctttcgacggctgcccactctctttcgacggctgctcaatcgctttcgaactcggcgttcaacaaaaacaaattgttcttcaatttgcttaccaagcgtacgatttatttgggcataatgttttacaatattctttaatattttcagaaatgtgttctgttcgccaacttaccgttgacatgttgcaggtaataaagaaatggtaaaaaatattttgtaagttcggtttggtacaattaatagggaagggttgggggattagcatttctcacctattggtccttaattgttagacttttctttttggatttttcccatctttagggcattgaggcccaacaagccgtcaaaaagggcggacggattccaaaggctggttgctcgtcggcaggcggcggacgcggcggtggtgcgggtcgaaagggcggcggacgcggcggtggtgcgggtcgaaagggcggcggacgcggcggtggtgcgggtcgaaagggcggcggacgcggaggccgatga

SEQ ID NO: 60706 - DNA, 220 bp, Heterodera glycines
  Genomic contig location: Contig_ID=SeqID_30287; Location=730..949; Strand=+
  SCN-specific regions: Sequence locations=1-220
tctcaaattatgaggaaacaggcatgttcggtggaatgaacatttaccatcaaaaatatttcacagtcccgcttcctgaattccgtccagaagcagctgcactcggtgcttcgactcactctgtttcacaaagtccaacagttcgagcatccgcttgatcccaatcgatattcctctgttaattgccgatttaattatgacgttaaatacattaatttga

SEQ ID NO: 60707 - DNA, 1286 bp, Heterodera glycines
  Genomic contig location: Contig_ID=SeqID_30288; Location=177..1462; Strand=+
  SCN-specific regions: Sequence locations=1-125,148-299,342-458,480 -909,934-1090,1120-1194,1227-1237,1266-1286
atggacccgattaatgggttttacagcaacaatgaggacaacgtgacattgacagttgactttatcttaaagaatgctgaaatgggcctatttgcttcttctgtaccaagaacatccgacaggacaattaattgggaaattgaaaaagtttccgaatttttccgtgaagccattggaagtgagcgcaaaagcgaaactgtgcacatcaaaggatttccgtggaaaattgtggccaaactaagccaattcaaagatttggactttttccttttgtgtgccatcccaaaaagtgagtgaacttaataaattaattcgaattagtaataataataaaattaattgctttaagcatcgaattggagttgcaaatgttcggcaactttacgaattggctcggatgattttagtgataggttcgataacttgatttttaacaatgaattacccatctgtcgatttgatgttggccttccgttttcgcatttggtaagaaatatttttgttttttcgaataacaaaaatatatatttaagttgcgcagagctcgaattttgaggcatatgccttttttctgcgcattagtttcgatatattaagcataaataacacattttccacttggttttatgctttccgttgacttttattatgcgttttttttttgcctttttcgggattttcgtgccttaaatgccttttaaatgccttttttcatgccattttcgggatttttgtgcccttttcatgtatttttcaattttttggtgcttaatctagtgcctttttcgtgatttttataaagatatattttttcctggctttctgtacgctccaacataaggaaaacattcccgccacctataaaagtcaaaaattgtcagtaccaaaagagaccctctgattttttcattttaaaaccaaaacaaaatggcctaattgcttttttaatgatataattaaggaattgattggcacaaacaaagggtggtacgacaaggaggaggacaaagtgactgtggtcattgattttttatttgacgatgaaaaaatggagaagccgtacggctcgattttcagttaaatttatgccattttttaaaaattttttctataatttttgtattcattttcaatatccgctttttatgctcataaattcccatttcgcagatcggggacgagcaggaagagaactaaattaatacatatattaattatatatataacttatactcagagaaaatttggaaatttgaaaaagaaaatccaaatcttgctctgcaaaa

SEQ ID NO: 60708 - DNA, 785 bp, Heterodera glycines
  misc_feature (667)..(667): n is a, c, g, or t
  Genomic contig location: Contig_ID=SeqID_30291; Location=374..1158; Strand=-
  SCN-specific regions: Sequence locations=1-532,556-785
taccgggccgtccccgcaagtcactgaccaatttcgacccgacatgtgccgactatcgttccctgcaccgcattttgatgagtgataaggagagggccgaaatgtaccggaagcggaaccaacagcagcgcgagcggagacggcaaatgacgaaggacgaattggcagaggcgagggccaaggcacggcaaaaggcggaggagaggcgggcgcggatggacgcggcacagctcgaaacggcgcggaggaaacacgcggaacagaggcggaagtaccgcgagaaggtgcggagagcggagcagagggggaagagaaacgagtgaattggaagagagacggagcatttggaatgaaaatggagcgaaatcatcgtattgtcgggacagagtgttgtttaaggcatttttctaccctcccaaatttcttgtgtttgtcccccttcccctggtcattcagatttgtctctcattcctttggcattctctccatggtttcctctcctttttgttttttgtatctctgaatccgaaaattacatttttgatttttctatttgtatttgatatgctttattatgacgcctttctttttgttatcgtttagtggtaagtttttgacaaagtttcttttcaaatatctctgtccgtcttcacatttctacgcattnatccgtcgttgtttaagccggttgataaatacacatatttatgctttatgtttataccctccgtattcttatgtccacccttgtagcctccttcaaatgggttcctttgccgaataaa

SEQ ID NO: 60709 - DNA, 4727 bp, Heterodera glycines
  Genomic contig location: Contig_ID=SeqID_6205; Location=791..5517; Strand=-
  SCN-specific regions: Sequence locations=1-92,141-265,288-428,450 -488,510-511,533-542,589-636,658-1099,1270-1473,1495-1586,1609 -1647,1669-1754,1780-2416,2439-2554,2576-2904,2927-3120,3143 -3160,3182-3305,3327-3406,...
  SCN-specific regions: Sequence locations=...3438-3938,3960-4310,4344 -4727
  Gene Ontology: Mol. function=protein binding; Cellular component =axoneme; Biological process=N-linked glycosylation
atggccaattcccaagtcacttataccgttttcgactcggactgtctgatgctttccgatttggaattgaccgattcgacggtgctcagattggacgaggacgaaagtgacggaggagaaggggaggaggaggaggaagacgcttttcatcagaatcggatgtttttgctgacggaagaagcggaagagacaaagcgggggagttttctggacagatcggtcattttggacgggccaactctgaatttggcattgccagtgatcgaaagcaacaaaatgagggcggaggaggagaacgaagagacgcccactccgatggttgagatgagtcggacggacgactttcgaagggagcgggacgaggacagactgaacaggaaccatttgagactggagtttgcggccaaatcggagccaacgcaaaagacgacgacagcagcggtaaggactgatcaactgatcagcagcagaagagcgatgatcagagggagggacttgagcaatttgggaggaaaaggaaagaaatggaaatcggatcccttcagcagcagcagcagaacgcaaataacaacagcagcagcagcagcacaagtggagtggacagaagaggggacgggggattaagtgtcatcagccaaaaggaggagcagcagaacaataacaacaatcgcaacgacggggaaagacaacggcggggggaagagacccaccagcagcagagaaaagagacgccaaagcggcccagggcaagccaaccaagcggaggggggggggcaaaggacagcaaaaacactcccccgggcgagggaaacactcccccaggccattctcttttccgtatagccataaaagtgtgaagcggacattgtttttacacttcaagaatggcaggcatcatccaaaaagtgccaattcacttccctcctatctctgctaacccaggcagttccacttcatttttcacaggcctctctcttcccatccgcccctccggcaaatccaatgcgaaccaaatgcaaagcaccatcaaaatcccaaatgataatggaccaactgaaagcgagcatagaggcggaaaagcaacgggcaaagaggaaaaaggaggaagaggaggagaaaagaaaaagggacgaggaagaaaaaaagagaaaggaggaggaagaggaggagaagaagaaaaaagaggaggaagaggagaaaaagagaaaggaggaagaggaggaaaagaagaaaaagaaggaggaaaagaagaaaagggaggaggaggagaaaaagcggacaatggacgctgaaaagagcgaattaaacggtaaataggagaaggcaaaaaagcacctttatgttccatcgacacagaagatagagttccccccccccaccctaggggatggctgtagaaattttaaaaatatagcgaggaacacccttgtcgaggaataaatgttcaaaaaaacataattattaattttactaaaacaaaaaagtgtagaaacatatttaaagaccctcatatgactcgaagttctcataattcaacagcaatgacactcgcaattaacccatgggtcggggaggaaccaaagttcaaaatgaattaattgactttggaaaataattggtctttttgactatttaaatttaaaaacgttatgccaatttttaagtattcgctgccaaaaaattttttcaaaaaagttactgttttggagactaccttcgtagcatttagaaaaacttatcatcttccccgaataattttaaaccaaataagaaaaatattaacataccaaagtgtaatttagaaacagtcccaaccgaaagtaccgccaatttgactacaatggaacaaacggtccctaaagtaaaggaagtgaaaccgaggaggtcgctgttggcccaggcatcccaacaacggcctccgttgccacgcgcatctgcgcaaagttcggccagtgcccctacacagggtgatgcgtttttccgaatttactctgcgttaaatgttttcaatgtcgcttttcagttgctctcccacggagccattctcgctctcgaatcactccgtctgctcgtccggtgctcagttctcgcgaaaacacttccattgcactgaaaggaaccgcaccaatgtctgggatgacccgtcgttcaatgaccacgaaaagtcagtcggttgaacacgtcgcagtcgcacaaaaacatttgtccggcattggccgaaacatcgcaaacggaaggacgaaagagtcgaaaagtgcgaatgcatccgacagacagcgaaaggaagtcgaagacgaactgaacaggacgaagcaaatgctgaaacagaccacaaaaacattggatgtgttcgctgtggtggcatcacattttgacagaaaagtgagggggggggtattagtgatctgaaaccaaattaattagatttattaattttagttggacaatgccaacaccgaatcggctgttctgatggctcaaaagggcgacgaggcggcgcaacaccaaagggccatcgccgagcgtaagtcgtctactccttcgcatttgtggtgtttctcttgtttttgtgtggggttctttctttgtttcgactcccccgagcggtggtccatccgtcgcccctccgtccgcccattttatttcatttgactgcacaatgcctttcccatcgtttgatgcttatctccccctcattaccattcactccaattcatttgggcggttctccccttccattggtcatcggcttcggctccttccccccccccccatttccttttgcgtttattttctctcaaatgcttttccattgcgatcaaattgctttctcttttcccttttgataaagcattgaataacacaaagttattgaggcttatgtcacctatcaacagtcttttcttttcaaatttcaatgcaaaagaatgtcccaaagtttctccgtcctccgatggcccaaattgggttggctcccttctcttctgcactcacccccaatccgtctacactttattccttatcagtacctttttggccataatcgtttgttttgcagtggactgcaactggaaaaagcgacttcagcgggcgaaggaggaccatcgagtggaagtccgtaaaaggggagaaatggggaaaagagggcggattaaccaccgaaaaaatttcaaaaactttttacagttcgatgaattacgcgcaaaaatttcttctgaacaagcggaaaacatcgcgaagatccaactacagcatcaaaaaaccgtgaacgaattggaaaaacatgtacagaaactcggcaaaaaactggcggaacaagaagaaaaacaccgaagggaattggccgaatcggcgagtcaatcgacaaatgtgaacattaattgccatttacataaatatcacaatgcatatgataatttctttttaattttcagagacttcacaaagaattggagagtcggaattacgaattgcaaatgaagaacgaagaaatgttcaaattgagacaggcaaatcgcgaattgcaattcgaagtggacaaattgcccgaaaaagaggcccaaatagtcaaattggaagcacgaattggcgacttgcgagacgaagtgaaccgtttgagacagttgcaaaagtgagagagaaaaggcaaatgtagagggagaagagaaagagagataaacggagaaaaatgaaacaaaacttcgaaaaagaggaaataagcgagaatggttaatatgaaacgaattggttaaggaaattgattgtacagctcgagggataccaacacgagctcaacgacatccgagtcaaggctgacgccgtggtcaaagagaaggaagtgttggagtatcagctgaacggacagaacggaggggaagcaaacaacgggtgagtgaatcgcggaaagagaaaacccaccgaagcaatttgaaaatgactgtttcataatgagtttaatgaagcacttcgtttccaggacaccccggacgagaaaaagttttgccgtgccttcagtgagtgcgtccactccgccgaatcgaacacccgaaacgcagcgaaagcggacaagtcacttgagcatgtcctgtcattcgaatgggaaagcgaatacgccacgcttcggtcagtttcatatggaatttgcaccaaatttgtttagacgataaagatatgtctcgttcgatggattcttcgatgattggccaatctctgatcgcctgttacatccaagaaggacgaagcaaaccgcagaatacgccgactaaaatttacaccccgagggacgtcacggagagtcagttaaaacacgcatttatataaataattatttaattttatattttcactcattcagttccccccgattcgtcctcaaatggcagacgtgtggttaactttgactcaacgcgtgaggacaacgaagaacccaacagagccgtggacagtgaagaaaagtgtgaccgttccccttgactttttaattattactcgctttgcgtatgcttattcctaccacctttatttatgctatttctacctttattattattactcgactctgatctcgaccgcattttgcgcttatgccttcctcatctatctgtagattatcattattatcacttttattgttagagtcttgagcactttcgctccattgaccattgccgtttaaggaatgttatgcatggataaacatttccgatggattggaaggagtcaataaa

SEQ ID NO: 60710 - DNA, 758 bp, Heterodera glycines
  Genomic contig location: Contig_ID=SeqID_6205; Location=1..758; Strand=+
  SCN-specific regions: Sequence locations=1-758
  Gene Ontology: Mol. function=inositol-34-bisphosphate 4-phosphatase activity; Biological process=signal transduction
tgccagagagaatgaaaaacgagcaatggtttcgaccaaaagtcattttttggaacatcggaattaaccacgagggtaaatcatccgcagagagtgccatctttcttttacctccctttttttgcttcgtttttagcttcgctggcggcgtccatcggcgacataagtctcgaagaagaaatcaacagaaccgcacttcggcacacggttgaacattgtcttacgttgacttcagaagccgaacatcggacgattgaaaatgctggactgctagagcaattgcttacggaactgcagcaaacggtgggagggcgagtaaaagaagtgaggaagggtaaggaaaagtacccttttaaataggtctcttcgtgtccttcaaagaagaattgggctattttcacccaagtgatggcactgaacagtgcctcaggcggagtgccaatcatttgttgtaaaagtgggaaggatcgtacatcgatgggagttacacttgacgaaggccgaattctgaaggagagttgcggggtatcgaaccaacaggtgaggggagaacgaagccgcatttggcgcaatgcaaccgaatccctatttttcagatttccgaaatgattaaatgtcttcggaagaacggagtccgtcgcgaaaactgcagaaagaacatcggcaaacccttctattcgttcagtcccttccaattaggctttttgccccctccatttcgtccgccatcaggaacattctcaaacgtagtctcctcc

SEQ ID NO: 60711 - DNA, 388 bp, Heterodera glycines; identical to SEQ ID NO: 51536
  Genomic contig location: Contig_ID=SeqID_30295; Location=404..791; Strand=-
  SCN-specific regions: Sequence locations=1-20,42-275,297-388

SEQ ID NO: 60712 - DNA, 420 bp, Heterodera glycines
  Genomic contig location: Contig_ID=SeqID_30300; Location=1030..1449; Strand=+
  SCN-specific regions: Sequence locations=1-420
tgagataggctcttcacttcactcttcttcaatttccaattccgatttttcgacccccttttttctccctcttttttacatcactttttcgccatccttcccctcgtttgcgtcaaataatcccatcacgcaataaattgttgagaagaccctccttttggtcacaggaaaggatttgagggacggcaaggtgggaaacggcgggaactccgacccctctccaatccgatccatcgttcggcgtcatccgcccttctcggcgcgcttcgaccactcctcctcccttttctcgtcgtctcggcttttcggcgtctccgctttttgagcgtgtctcgttcggtttcctccccccccccccccagtttgtcccctccctttttccgacaaactttttggtgcgacgacccgggaacacaaacc

SEQ ID NO: 60713 - DNA, 2732 bp, Heterodera glycines
  Genomic contig location: Contig_ID=SeqID_6207; Location=863..3594; Strand=+
  SCN-specific regions: Sequence locations=1-188,210-360,400-773,795 -823,871-1530,1552-1700,1742-1853,1875-1908,1940-2530,2566-2732
atgtgcgaacacatgcagcacactgtgcgcaaggaggtgctgtccgactgcgacattgcccagggcaacaaactgttgctgtacctcagctgctgtttggcgggccgtgcctatccctacggcgaactgccggacgaacatttggccaaaactgtgccgttggagacgtacaaagtgagagggcacccttttaaaaaaaaatttaatttccattcagtttcttgtccaactgcgtcccaaatttgtcaccggaccgccctcctctgcgacgaccactccttcgcccaccaccgcctcaaaggaggacgatcaaggtggttatggcattgctctcgatgctgctgctgttgtacaacccatcaacaacaaccacgtcgacaacaacaacagcagcaacaaaccgtcggtggccgaccttcgcttcccgcacctgcaactgttgttgaagttggatccgcagcagttcctgaacgtgatcaacacctgcgcggacgcgcccgtgttcgcctccgtcgacggtggggccacaataactttttgggcccataatttcggattttccaaatatttttaagctattggatggattttcttatttgccctttcccaattgaacttcgatcggggcttcttcaggtcgtttgaagcgcctcgtggacgtgttgatcgcaatgtgtgtggagaaaaacggggaggacgaacgcaacgaactcgggcccctgctcatcgcatttgtggtcggactgttgcagaagggggccataccaaaggatgtgttcctcttcagtcaggtccttttcgcttttccaaactatttataagctaaaatttttaaaaattaaaaaaactataaaatatttaataatatttgttttgcagttgatcaaacgggtgttgcaacgtcagtttctgaatgtgcgtgcccagaaacaggccgaacagcacattgtggacctgttgaaagtggtgcccgaaatcgacttggacaatgtgttagacattgcgcaacgccggccctagtaaaaaatgttttactcataataattagggtcattaattacatttttgtccctgctcaaagtgttcacatttgtgcgtacattttcaccattcgcaagcagtacgttcagctgttggagtgctgtttaggcgacctttttgaaccggtcagaggatttctgcccattttttgccaaattattttgaaaaatttcagcaaaatgttttccatattttggccgatttgttgaccaatttgcgcgaccatggccaactgtgtgaacttcgtcagtttgtctgcgctcagcttggcaaattgtccaatttggaccctcaggcaaaacgaactgccaaaaataatgaaaattaaaaaaattccatcatttcagcttgcagcccacctggtgttgtcccacctgcccgggctgttggccgatgcccagtccaacccgcgcaaattgcccttccaattcatacgacaatgctttgcgctgcggtacgcttttaatttttaatggacacaaaagcatggctaggtttaagtcgtcagcaaggccatcggacgctgtgcggtgcggacgatgaccacgagcaggacgaacagttttttgactatctgttcgagggcatcatcgacgaggccgatgtcgccgccatgtcgtcgaacggtgtcgaagaaaactgcgagggttggaagccggaattattatttatttgttaattgttttttaattttattttagccaccactatcacttcgttggacaacgagttggcggacttgttgcgctattggcttccgcttggtgcagcgacggaccattgtctgaacgtggccatgcaatggcagcagcagaaacggcccaatggtcagtgactcaagaagacattttaaacgcaatttttagcttaaattttaattaaattaatttgttttaatcccttacattttcagctgtcctttacttttgttacaatgtttcagctgtccttatgtcgaccatttcgcttctgctggtcgcccgggggcacatccaacgcgcatttgagcacattttcaacgagggcgttgaacgacggttggacagcaccattagccaagttagtattgcgacatttggcatttacaagggcttattacatgataaaaaccatgacaatgatattccgatgccgttggaaatttaccccggggcggtaaaagcagggtttttggtatcccgaaattcggcacatgtgctttccccattttttgttgaagcctcccgccgccgacgaccgttgtgtcgcctctctgttggaattggcctccgcccatccgtcggatgcgcgacgtggcgattggttggccaaactgttccggcaccttttgaaggcattgcccgaggaaacggaagccaaaagtgatggtgatcagtcggggtgggagattatctgacgagactcccgacaaaatcattggattttggtcccaactcccgatttttttaaacggtcgttcattgaaagtcggagccattgattccttttcaaaaaattttttaattaattaatttttaaaaattagataatgcagcggaattcactgcctccgtcgttcatgaacaaatgacgcgtccaaattcgcaactttttcgtctgctctgtgctatcattgaacagcagcaccaccacgacgacgaacaggagcaggacggactgagggacatccaaattggagcggaaaaaggtga

SEQ ID NO: 60714 - DNA, 816 bp, Heterodera glycines
  misc_feature (85)..(85): n is a, c, g, or t
  Genomic contig location: Contig_ID=SeqID_6208; Location=32..847; Strand=+
  SCN-specific regions: Sequence locations=1-405,443-476,499-548,591 -714,777-816
atgccagtgtcgaatgccaacgagacgaagaacccttctgccggcaaaaatgacagggaaatggacgaaaggtgggcaaaaaagngagaggattcagaggatagtctgacccgtcgagaattgacgccggcggtgggtcgggaccgaccagcagcacttcaaaccggacttacaattagcaaacaattagtcccctaattgcttttcaatgtgcaaatttggtcccttccaaatgatgggctctgttttcaatgtgatttcgcacattttattgtttcaattgcctcaggcgagctgcaagtgccgtcttccgtcgcctggagcacgacttcccaattcgtacgggccccccgccgccggcaaagacggcgaacaacgctttccaccgaacgtcttcgttgatttagacaaacttttcatttttattgagaaattacattttaatgtagagctattttcttctgactgttttgcccgaatgaatgaatgaatattaattaattagcataattcaaatggcctgctgaactttgttattattatttgccattttttaatttaaaaagaattttaaataatttatttattttcaaccctttttatgtcccgattttcactcatttaactgtgattgtgccagtcaaccaaaatcaaagaattgtttatttatgcgttctacttaattgaaaataaatgtgtgccttccaaactgacaattttaaattaaaaaatcaagttatattttattcaattaaaaaaagcatatataatttttagggctaggatttttatgtgctaaaaatcctgaaatatgta

SEQ ID NO: 60715 - DNA, 765 bp, Heterodera glycines
  Genomic contig location: Contig_ID=SeqID_6208; Location=1687..2451; Strand=+
  SCN-specific regions: Sequence locations=1-427,451-621,665-668,690-765
atgagcatgcatttccataaaaatgggttcgaaaaatacattaaaaaattggtaagttacctaaacagcaggggtttctgtaacaatatggtcgagattacggtaatggaagaaattatatttttcattatacatagttcccgaaaaaaatcacttttaataagttgaaaaaaaagatggccaaaaattttggaagaaatattttggtaataacctttttgaaattaacaaaaattttcaaaatttggaagctataccaaacacttgtaaagctatcggatgatatcataaaataaatgactcccattaaaatggcacaacattcctcaattggttttcaagtgtaccatcagcatcatgaacatttttggttgcagttatttgttgtacagttttcatacaattagctgcgcaatgatcaaaaaggtattttataatttattaataattgatcaattatcatttttgtacggattaccctcttttatgctaattagtaattacctacaattaatttgaaatattaagaaaaattgctatgtcgttgtcacattatgcttcgcactaacccttgactttttaccagcgcttgtcaacatcatttttgacctcgtatggcacatttttaaaatttaaaatataattaaaatcttttttaataattggaaaatccaaaataattttcagttcgacttgggcttcatcggaaattttgggtctacctgcactgttttggactcgctttgttgtgccgtttatttctaa

SEQ ID NO: 60716 - DNA, 962 bp, Heterodera glycines
  misc_feature (89)..(89): n is a, c, g, or t
  Genomic contig location: Contig_ID=SeqID_30302; Location=1..962; Strand=-
  SCN-specific regions: Sequence locations=1-382,405-689,712-962
  Gene Ontology: Mol. function=calcium-release channel activity; Cellular component=integral to plasma membrane; Biological process =calcium ion transport
tccttttcgcccattttcgaggctttgaactgtccgctgaccgttcaggtgaccaatgctgtttgctattttgttcccatttgaccacncctttctcttgctaaaggagtgtttgtcctttggcgacacatccaaaaatgtttttgccggcccttccgcccttttccatgctatcgaaccgtttgtgccgtgtcccgtggacaccgctcacatcgctttgccaaactttgctctcgaggcgcacttgcgattcgcagaaaatttgcacgaattgtgggcgatgcgcaaagttgacctgggctggacttacggggaggtgagtgaacggcacgcgagcagcagacggagggtattattaaggtgcgcaacgaacaaacgaagcggcacccgtgccttaccaacttcgagcggttgcccgacacggaaaaggcgtacaacgtcagtttggcattggacacaatgcgaaccatcgaagcgttgggctggcacatggtaccgagtgccgaccagcaggccaatgctcgttccaatttggcagatcctcgaccagccaccgacgcgacttcggcccgtccgactgccccaaaattatgcgcaagcgaacggatataagccgcaaccgttggacacgcacgaaatcgaactgagcgaggcaatggaaccgctaattgaagcattggcagggaacacacacaacgtttgggccaaagagaagatcaggcggggctggacattcggaatcagcgaggtgatcagcagaacaatggaaaatgggagtgatcggaggcaacggcattataggggaacatttgccaatagatcatcccccgagggaagctgccccctccattcctcgcatcgcttacgccttgccttcccttctttaatttcgaatttctcagtttgtcgatgcctcgcaaaaacggaccccccatttggtgccttatgatcaggtggacgaa

SEQ ID NO: 60717 - DNA, 242 bp, Heterodera glycines
  misc_feature (234)..(234): n is a, c, g, or t
  Genomic contig location: Contig_ID=SeqID_30303; Location=72..313; Strand=-
  SCN-specific regions: Sequence locations=1-242
atgtctactaatatgtcgagccatggtcgacgacaacgtcttgagaggagcagcagcagtattagggaactgcaacaactgcaagaaattgctttggccattgaaaatttggcggcaccaaatccgcgacgacggcatgactcttctgccggtgagagtgagcatggagaaattttgatggccattaaccaactgcaacaggtggatgagtgaattaagaaatacattttttanaaaataaa

SEQ ID NO: 60718 - DNA, 202 bp, Heterodera glycines
  Genomic contig location: Contig_ID=SeqID_30305; Location=1233..1434; Strand=+
  SCN-specific regions: Sequence locations=1-202
atggatcttctcgtcagtctggagctgctcgacttgcactacaacatgatcgcccggttgccggacgaactgtttcggtgcctcgtgctgcgcacgttggacatcagtggcaatcaatcgctgaacattggcaacctgcaaacctggccgagctggtgctgtgcgagaaccaaatccggcacttgcccagctcagtcgggcg

SEQ ID NO: 60719 - DNA, 1135 bp, Heterodera glycines
  Genomic contig location: Contig_ID=SeqID_30307; Location=14..1148; Strand=-
  SCN-specific regions: Sequence locations=1-23,45-158,180-309,336 -418,461-1135
ttcagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaatattaaaatgaactgactagataatattaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattaaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatagggtcggggggactgccccgaaaac

SEQ ID NO: 60720 - DNA, 465 bp, Heterodera glycines
  Genomic contig location: Contig_ID=SeqID_30309; Location=1..465; Strand=-
  SCN-specific regions: Sequence locations=1-465
aaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcccaaaaatctgggcgcatcggttcggggggactgcccccgaaacaaaataaatcgatttt

SEQ ID NO: 60721 - DNA, 264 bp, Heterodera glycines
  misc_feature (194)..(194): n is a, c, g, or t
  Genomic contig location: Contig_ID=SeqID_30309; Location=1053..1316; Strand=+
  SCN-specific regions: Sequence locations=1-79,113-264
atttataagcatttgaagggttctcagcagtttccctgcaaaatttggtgagcttctgataagtctagaacgttgggtgataaaatgaaaaaaataattaaaaaaaaataatgctggtgtggtaagtgtgaagaactgtgttcctccaggcaaaaaattctaagaaaatttataagcatttgaagggttctcangcagtttccctgcaaaatttggtgagcttcagagcagtctagaacgttgggtgatcaaatgcaaaaaata

SEQ ID NO: 60722 - DNA, 457 bp, Heterodera glycines
  Genomic contig location: Contig_ID=SeqID_30310; Location=567..1023; Strand=-
  SCN-specific regions: Sequence locations=1-187,209-267,291-457
tttgaactcgcatctccaaaattttgtcatcccatcagaactcattttagcgaaggtgtaaaggtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacttttcgatttttgggttggggcccaaacgaccccggggcccaaaaacgggggcccaaacgaccccggggcccaaaaacgggggcccaaacgaccccggggcccaaaaacgggggcccaaacgcgggggcccaaaaacgggggcccaaacgctctggtccc

SEQ ID NO: 60723 - DNA, 763 bp, Heterodera glycines
  Genomic contig location: Contig_ID=SeqID_6209; Location=692..1454; Strand=+
  SCN-specific regions: Sequence locations=1-128,177-213,235-507,553 -656,688-725,754-763
atgaccaatcgcataaattttgtgtgcatattcgaagaggcgatttcattcgacttggcatagaatcaaaaaaagattttactgagcagggaattgaatttggatttcaatcattgaaagttatgccgaaataaatatatattttttattttattaaaaatttagaaaaaatttaacaacactcccatttctttcgttttaatgggaaaagagaaagacttttttaaaaatttggcaatcaatcaaacggtaaaaaattcacaaaattcttaaaatatttgttgcaattgttttttacagcaattttccaacgtttatttgcccaaatcaatgccacgggcaaatgatttggcatttgccacaacggcatgcgactcgctgctgatcacggcacaatcttcaaccttttcgtggtggattgcttatttgatgccggacaatgcgaccattttttacaactcaaaaataaccaaaagtagcgcaaattgtctcttaattaattccaggatttttttaaaaattaaatttatttgaattttaaatacatatttagacatttacacaacaaatgaaaattttttggccgaatgggtgccaatcgaattggtcaacggaaatattatgttgtcaaatgggtaaaacatttaattgatcagaaatttaaaaaaattaatttaaagtatttttgatatcctatgtgtaaaaaaaaagttattatcccaattaaatggaaaaaatattttcaaatgtaaaaaataattaa

SEQ ID NO: 60724 - DNA, 1592 bp, Heterodera glycines
  misc_feature (1582)..(1583): n is a, c, g, or t
  Genomic contig location: Contig_ID=SeqID_6210; Location=92..1683; Strand=-
  SCN-specific regions: Sequence locations=1-651,673-965,987-1257,1280 -1426,1463-1525,1547-1592
atggctggacccgactctcgttttattctcgaattcttcaaccgtgaggctaaagagattggagtaacgcaggaattgcttgacaattcacaggtttttgactttatgatcgtttgaattttatttttttttattcagccgtccgatcagttgatccaggcctactactttctgtgtgatttgatttttgaaaatgtcggcaccaccaaagagaacgagtatgaaatggccactgaactgacgagggctcgtgccaagatgatcatccgaacgcaacagcattggtacgttggtttttgttattttgatcttacaattagtattttcgtatagttttatatacattgcatccacaatttgttcagcaatttggtgtacaacaagttgttcgatggttctaacgaatttctctactccgatctatttcaaccggacccccgcagaacgaagatgcacattgctcaactgattcgcttgtacaccacaaagtgtgacattgccaaagagctttcggcggtggacaatcacattgtgagtgtataatttggcggagtttactagttttagtttatcaattgggctaatttagtcggaatttacaaatttaaggatgaacaaatgaaagcgcatgactttgagaagaactgtgaacgttccacacatgctgtatgagatgatgtgtaattaattatacgcggaagagtttttcccttttagcaactgaaagatcgcgaagaagcgcttaaccgcatggagacgcgaaatgacgaaatgggcagcaaagtgcgacgattcaaggacaaattgaacgatcgacaagcgctagtggaggatgagaaaagtagagttgagcggtaatcggtaattgcaaaaaaaccggtaccggtactgaccggtactgcaaaaaccggtaccaactttttccaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagtttttttttcaaattcaggacatagaacactaaaattcagatgtagacctcaaaattcagattattgcaaaacaaggggtcagcagccaattttccaattttgtgaaggggtctccggccatgtaaattaatgtaaatcaatgaccttttttttgctttcaacaccgctttttacgcggcacgttttttccaagacttttgggggacaggaggggccggcggtgccgataggcgccgccgggaaaaaatttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaagatagaaagtttaaccactacaccacatgtgcatgtgtgtactcccatgactannatgaataaa

SEQ ID NO: 60725 - DNA, 409 bp, Heterodera glycines
  Genomic contig location: Contig_ID=SeqID_6211; Location=80..488; Strand=-
  SCN-specific regions: Sequence locations=1-127,156-240,263-409
atgccattctcagatttcgatgggcgtgccatgcaaaatgatttcctccgttcaaatggtccgtcttttttgtcggattatgccgacctttggcttcttgcgttggacatgctgccgatggcacaccaaacagcagaagagcaaagagaacagctgaagatggagctgttcatcagccgcagctccaattgctccatggaagcatgggtagaaagaaaggcaaacccgatctgaagagatccaattttttactgagttaaccatttttctttatctgggttatgtggatatataacatttagtaacaattttcccagcctaactatttgatcaatttaattcccttaagtttgtccaaccgtcggattccgttggaccatccgatccgaaaatgccattcgacgattcg

SEQ ID NO: 60726 - DNA, 300 bp, Heterodera glycines
  Genomic contig location: Contig_ID=SeqID_6211; Location=590..889; Strand=-
  SCN-specific regions: Sequence locations=1-132,158-182,248-300
atggcaacaaaaatggcacaatcatttggcgcgccattaaaatgcgcacagtgccaatgcaaacgaataacaatgacaaagaaagatcaatcattttggagtcatcaattgcctttaagaaattgttagtacatattttatttattaaaatattaatcaaaaatgcgtaagtgaactctttgaatttttgtaattttaaaatttttaataaaaaaaaaattatagtaaaaagattataaattattaagctatacattgggagcaggaaaacggctttctctgcttttcgaatggaataaa

SEQ ID NO: 60727 - DNA, 576 bp, Heterodera glycines
  Genomic contig location: Contig_ID=SeqID_30312; Location=919..1494; Strand=+
  SCN-specific regions: Sequence locations=1-5,28-92,114-193,268-576
atgaatgaaaatgagaaacaaaaggaatttgttaaattgtttaagaaatataaaaagcaaaataaagaaatcatgaacctcgaaattgctaaaaaattgggaattcatcaaaataaactgttggaattcagaaaaagatttgacccaacctataaaagtaaataatttcgagtaaaataagggaaattatgggtaaataaataataaataatttttaaaatgtaaaaaattaattaaataaatattaaatttaatttaaaaaatattcccaaaaaacagaaaagcttcttgcgaactcagaaaaaattgcattagtgagaaaatattacaaattgaaaagaaaattcccagaactaagccaaaacaaaatagccaaaattttgaagattagtaaaaattcattaattaaatggaagcaacaatttggcaatcaatttgaaggacaaggtgaccaaatttaaaagattacgatgaatacagtaacataaaattacagtaaatgcccgggaaaatgacgatgaagcgaattccgaagaagacaggcattttttttatttgacagcaaaaattatgtaa

SEQ ID NO: 60728 - DNA, 59 bp, Heterodera glycines; identical to SEQ ID NO: 52421
  Genomic contig location: Contig_ID=SeqID_30313; Location=223..281; Strand=+
  SCN-specific regions: Sequence locations=1-59

SEQ ID NO: 60729 - DNA, 59 bp, Heterodera glycines; identical to SEQ ID NO: 52422
  Genomic contig location: Contig_ID=SeqID_30313; Location=353..411; Strand=+
  SCN-specific regions: Sequence locations=1-59

SEQ ID NO: 60730 - DNA, 59 bp, Heterodera glycines; identical to SEQ ID NO: 52421
  Genomic contig location: Contig_ID=SeqID_30313; Location=483..541; Strand=+
  SCN-specific regions: Sequence locations=1-59

SEQ ID NO: 60731 - DNA, 59 bp, Heterodera glycines; identical to SEQ ID NO: 52421
  Genomic contig location: Contig_ID=SeqID_30313; Location=613..671; Strand=+
  SCN-specific regions: Sequence locations=1-59

SEQ ID NO: 60732 - DNA, 59 bp, Heterodera glycines; identical to SEQ ID NO: 52422
  Genomic contig location: Contig_ID=SeqID_30313; Location=743..801; Strand=+
  SCN-specific regions: Sequence locations=1-59

SEQ ID NO: 60733 - DNA, 59 bp, Heterodera glycines; identical to SEQ ID NO: 52421
  Genomic contig location: Contig_ID=SeqID_30313; Location=873..931; Strand=+
  SCN-specific regions: Sequence locations=1-59

SEQ ID NO: 60734 - DNA, 59 bp, Heterodera glycines; identical to SEQ ID NO: 52421
  Genomic contig location: Contig_ID=SeqID_30313; Location=1002..1060; Strand=+
  SCN-specific regions: Sequence locations=1-59

SEQ ID NO: 60735 - DNA, 860 bp, Heterodera glycines
  misc_feature (812)..(812): n is a, c, g, or t
  Genomic contig location: Contig_ID=SeqID_30317; Location=17..876; Strand=-
  SCN-specific regions: Sequence locations=1-37,59-568,590-812,835-860
atgccacaggtacataaatagtacaagcaaaaacatacaacaagtatatttatttctttctttacaaaaaaccaatcataaggggtgtaaaaaagtctcggtctcgagtctcgaaagtctcgaagaccgagaccgagaccaaaaaaacccgagacttttctcgagtcgagaccgagactctcgaacatcactagtatgaacacatctatttctgacacattttcttccgggagccttattaacaatagaaaataatgagagcaaatatttgagaaatattgctgttacatcgcttaaacctaatttttccgattaatcacacattaaattttattatgcctgttatagggtttaatataaaattttaaaactcatattttacaggtttaaatatgaatatatacaatatttaattttcaggaagttggaagaactactgtagcagaattaacctattttgatccgaataatcctaatcgagttatgatgatgaaaaagaaaatttatttctcgtgggatgtacgtcagatcacaatctctgcttatcttggtactggtcacatctgtactgagcaaacggactttgatcagtggaccaataaatcgtacttggaattttttcctgatcaatgggtcgaattacaaaacaacactgggtgtgatgacaatgctttggttactttcaagataaatttagaggaggtaaattatttcttctatttttatagaatttaccaccgatttgtaaaatatgtaaacgcttattgcttggtttatattattgatttataggcgacccaaactttttattngtttaaaatttttaaaatccagttcactatgataaccaaaattctttg

SEQ ID NO: 60736 - DNA, 656 bp, Heterodera glycines
  Genomic contig location: Contig_ID=SeqID_30318; Location=132..787; Strand=-
  SCN-specific regions: Sequence locations=1-361,383-399,421-427,450-656
atggaggagtttattaatgtacgagtttgaatacaatagaaggccttttcatatgccagggctccaactcctggggcaataaacggcgaagcgggggcagaggtctgatggaccccgtggattttgtgtcacaactgaaacaattcttagcctttttctaaaaaaggactgataaaaatcagataaagccatattaagaatgatacagaattcataataactttgggtggggttcaaagccgcttggaggagaactgctttaaaggcgaattgcgggaaagcgagttttttacataagaaataattaaaaaggttattgtttaactcgtttaaaaagccaataaaagaagaaaattaattcgaagccaaatgcatttgaacaccagaaaataagaggtcaataaattatttttaaaaaatggaaacctaaaaatttgatttattctcttacatttaatagcttattccagagctgcatgccaattctagaacctggagatccatcgtgacaatggacgagttttcgcagtttcagtcaacaccaacagtgccaatggacatcggagacacgaccccaccaccgcatgccaccaacgaccgatcaaacacatcgaacaagtcgacaatcacataaacgaccggatgacaccattaaa

SEQ ID NO: 60737 - DNA, 1326 bp, Heterodera glycines
  Genomic contig location: Contig_ID=SeqID_30320; Location=29..1354; Strand=+
  SCN-specific regions: Sequence locations=1-134,165-1020,1042 -1068,1100-1249,1279-1326
atggccgccaaacccatctttttctgtggatcgcatgaaactgttgctgagttcgggggatggggcggacgttcacttctttggtgggccaaagggaccctaaaagaggcgagatgccgtggaaattcaaagcattacaaaattgttttggtttttagcttttgtcggctcacaaactcatttctgatggccgcttccgacgtgttcgaggcaatgttccgttttgactccgcaaatgcgacgacttccacttcaaaacgtaataaaactgttggcctaaaaacattccctcaagattttggggaaaagtaaaatttagagatttttttgaaataaaaaaaaactctatttactagaaaaacctctactaaaaattagaaaactaacaaatttcgtttttttcgcaaaaaatgatgcggtgtaaaggcgggggaaggaaacgtagtgcaccccctaagaatgtcctaaaaattgaaatttcccgattttcagcgccttcggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctggtaaaactttaaaattcattattttcttcgtttattttaatcacttttagccaaaaagtacaacatcgccggactggtcaaagcatgcgccgaatttcccatttctgagttgggcaatgtcttccacactttggccgaggcgcgacttttcggagagaaagtaacattttcaaggaatacgaattaaatgggactgaactgctcgagagtgaatctcggcttcaaatcccggcacaatcctctacatatggaaaaacgcatttttaaaggcattcgccgaacactgcttggaatacattgaccaaaatgcggacactttgctcaaatcggaggaatttctgcgcattgatcagcaaatgttgtgcgacattttgaagagtgatcagctggtgatcagcagagaatttacgctttggaaaactgtaaaattggattttaaaaattgtttaattaattaaaatttgttttttcggcactccgttgggccgattggcaatgtgagcaaaaaggcatcgaatgttcgggagagaatcggcgggaaatgctcggcttggcactgttcgaaattcgcttcccgcacatcacaaaggaggacttttcgaagagcattggtaatgccaattttatttattaaattttgtctaagttgggtcaaattaaaaaacaattaattttggcgtcacgcggaaa

SEQ ID NO: 60738 - DNA, 440 bp, Heterodera glycines
  Genomic contig location: Contig_ID=SeqID_30321; Location=244..683; Strand=-
  SCN-specific regions: Sequence locations=1-440
atggcagatgatagccaaagctgctatttggaattggcacggaatgacgaggacgggacgctgatgcttttcaatgggatcagtgccaaaacacttggccaactgttacagcagcgcatcgacgaattggacacggaaacgaacttttggatgatgggacttgacgtattggtgaaccgttttgacgaggagagggaatattttcgacaacttttggccaatttcaacacggcaattggcgcaatgaatgcggaggaccaacgaaagcgcctggggggacgaaaatgcgggggacaaacggcgggggaagagaacgaaatttaggggaataattcaaagactgttagaaatatgtgacctagtggctaagctttctgcctttcattatttatcgcttgggtgcaattccccgacctaatatttgtcatttttcgaataaa

SEQ ID NO: 60739 - DNA, 412 bp, Heterodera glycines
  Genomic contig location: Contig_ID=SeqID_30321; Location=1027..1438; Strand=-
  SCN-specific regions: Sequence locations=1-136,159-357,388-412
atgtccacaaaatccgacatttggtcgcttggagtcaccatttatgaattgctgctgatccaaccccattttgggctctacaaaaagccaaatcagcgatccaataaagtgtgaagttttggccaattaaattggcaaaaattgttgaaaattttaaataacaaaaatatttagcacaacaaatttttgagcgaattttccaacatttacaagggattcgcatttgataagaaggataaggaatttgaatattgtacaaatgatttggattggttggacggacacttggaccaaattgatcagatgattcgaatttggaatgaacaacatccgcgcatcgctttgcttttaacggtctaaaaaaatcaaatttatttttaaaattttgttacttcaaattcaacaaaataaa

SEQ ID NO: 60740 - DNA, 2068 bp, Heterodera glycines
  Genomic contig location: Contig_ID=SeqID_764; Location=1881..3948; Strand=+
  SCN-specific regions: Sequence locations=1-677,702-1002,1025 -1268,1303-1314,1336-1567,1597-1686,1708-1917,1943-1969,2001-2068
cattctcggtccgccaacagttgtgacacgtgatgggcaccagcagcgtggacgtgtgaatggtaaccacgtgcttggcttttaatactgtacatttttaattttcattggcaagaagagccaataaatccgcaaaattcctgactcgaaaaattacattttgaattgaaccaaaaaagtaggcgtgactacaaaaaatcgaaaattttttcggctcgagaaactgaaactttcgcacagccctatggcttgacaaaacgcacaaaatgctttgccctcaggtgctgtgcgtggttttggtcctgcccgcgtttctgattctgttcgactccgttggccaacacacaccgaaaagcacggcgtggcgctgaagagacttcaaagacacactagcggacgtcacggacaggtggaagatgatgggcttggtgtccagcaggggactttcagatttacaagtgtcaaattgactaacaaataccaattttgtcttatgacaaaagcctcaatatttaagggtctcgggactcaaatgagactgattttgaatgtcaagtcaagttctgaacggtaaaaaattttcctgttttaaactacataaacattccaatttgaatccagggtaggaggcgaatattgcctaattgtaagccaaaaaatgcaaaaggtgattattcaattcattcactcattcattcatggcaatttgctcgaggcgccaattgaaaaattttcacacaaatttacattcattgttgtataaataaagcccaaataatgccgtagggaaggggcggcaatttgatgaaaagtgccaaatttgatgaagcggaagttacccgagagagagaaaaagtttttttgtcaagattcggcatgccatttaaggggggagcacagcctcgtaaaatcgcaaatttttaattcctaggcctcaaattttgaaagtgttggattccgttaaacccattttatatgtaaggctcgagaatcttgagtttttgaattttccgagactctcaaatttaagattttcatctaaccattggtcgagactctcgattaacagtttaatcatcaaataaactaaaatttcgcatttttacgcaaaaaagtattactgtaattctttagttagttctttgtatactgtaatctcgagactcttgaaccacccattttgtgctaaaatttatttggccttttttcagcaaagcaataatatgggcaaactcgcggcagctactgccggcgcaacagcacataatcaccatcaccaccatcaccataaccaccaccaccgtaatcatcattatcacaacaataatcaccattcctcatcgtctgcgcgtaacggtagttcgtccgccgccgcaacaactacggtagcccaccatgtggctactggtgaacaagcaacaggcggaatgccaacattgccattggtggtggcatcattaagcaacggcggcaatgccatggacaatgccactgtgccacgaactccagcaagtggtggcagcacatttgacgagctgttcaaaccttccaccaatggctactgtagcaccaacaacaataacaacaacaccaatagtgttatgaatacggtaggtttggacagggaaagggaaatatttcaattctctcccgggtactgtagttacagtacaagtttgtgtcaacgtttccaaaattccttttgccatattataagtctcttccacagaagggcaaatacatactgtatactgatttgtgatcgcctcctttatccctttaactgatgattgatcatttttccttcatccatttaacatcgtagtttttcttcgtcatactgtatacttttttttgttacagcagcaacagcagctgatggccacccaaatgatggcgcatatgttcgccgctgcgcaacaacagcaacaacagcaacaactgatcagtgctggcggcactgatcagcaggttgccgccgccgctgccgctgcggccgctaccacactgatggccaccgcgcagatggccgcgcatatggccgcggcatccgccgctggcggatttg

SEQ ID NO: 60741 - DNA, 1470 bp, Heterodera glycines
  Genomic contig location: Contig_ID=SeqID_765; Location=1456..2925; Strand=+
  SCN-specific regions: Sequence locations=1-99,121-569,608-674,698 -766,788-822,844-854,902-1046,1071-1247,1276-1470
  Gene Ontology: Mol. function=RNA polymerase II transcription factor activity, enhancer binding; Cellular component=nucleus; Biological process=neurogenesis
atggccgccgcgggtggtgccaatgcgtgcggtggcggtggagtgccaccgcctacgacgacgtctggcgcggcaacaacgccgcttttgtcccaacttacgctgccgctaacaccgtcggcaatgccatcgacaggcacaggcaataatagtaacggcggcggtagcaacggttgtggcggtgccggtgccaccaacggtagcagcaacgcgccgtcgccttcaccgcagaagcgagcacgcacccggatcgcggatgagcaagtgaaaatccttagacaggtgcggtgttgataggataaggagtgtacggatcagttttcggcgccgaccgtttcggcacggcaccgcccaatttgaaatagttttggccataacttttttttgtagccttacgaaatttttgggtttttcagtcaaacagaaaacccttaagggctctatcgcaagttaccaaatttggagttataataactgatgatggtattaatggtacggtatcttccttcccttacagtactttgacatcaacaactcgcccagcgaggagcaaatcaaggagatggcgcacaaagctcagttgcctgagaaggttatcaaggtaaaatgggttcattgaccccaaatactgatcagtgatcaattaccattattcgaatcaattaaattgccgctaattaattaattattattataagttacaaattccgtaaataattaattacatcactagcacccacacggcgattcaattttgggctccaagtacaattaagttggttttttcgtcttagtggtctgtgagttagtcatcaaaaagggggtctcaggttcaaatcctccttgtgtttgtgtataaatttcaattttttaaagcaaataaataaaatattaataaaaacagaacgccaaaagaacaaatacaaatagtggaaggtagacattatattttacccttgattttattaaatttttttagcttataactttgtcaataatagaccaaataaaaccattttatgctcattttggagggaaaattctgaagaatatttcttaattagtcaaaagtttaaaaaaattgtttattgacaaaaaaatgaaccatgtgttattttatatgttagagacatggaaatagtgcgtcaagatgagagaaaaagaaaaaactttgtccttgaaaaaaattttttcctattgaccaattttcttgaaattttgcataaacacatattttaacccaacctactggatgatgctttgttttttatcaaaatgctttttaactcgagatcggctcttccgtttttacaagggaaaatccccataaaatttttaagttttgcaaagttttggcgttctgattactaaataatatcgtgagacgcattcgcaaaaattagatgttttactgccgataaaataaggaatttttggtcaatccttgattttgcatgtttactgattgaa

SEQ ID NO: 60742 - DNA, 1130 bp, Heterodera glycines
  Genomic contig location: Contig_ID=SeqID_766; Location=121..1250; Strand=+
  SCN-specific regions: Sequence locations=1-35,160-325,347-628,650 -984,1014-1046,1071-1130
  Gene Ontology: Mol. function=protein binding; Cellular component =axoneme; Biological process=N-linked glycosylation
atggaagaggatgaacagcagcaggaaaagaacagggaggaagaggaggaaaagagagagagggaagaggaggcggaaaagggaaaggaagaagaagaagcagagaggatgatggacaataaggaagaggaggaggaagagcaggcggaagaggaagagcaaaaactaaaggatgagggaagaatggaagaggaagaggaagaccgacggcatcggcatggggatgaagcattggtggaaaggcacggagataaagcgtcgtcgtcgccgccctcccattccgcggcggcatttgtcgaccccggcactttcttggccagccttggcaacccaacggcacagcaatcggcggcaatgatgcccccgctgttcccgttcttcggcactggcgccgctaacagtgcggcggcaacgccgggtgcaagcggtggtggcatggagtcatttgcctcaatgttctcgggtgagccgggggtaattttgccatcgcatttcggcacttttttcttgacttttttctggcatacttagaaatttattagctggatttttatcactatgattgaaatttccggtttttgttttacattttggcactttaaagcttcatcattgatagaaaaatctattctattttggcatttttatagagggtattttgtatcctgcataattggaattttggcttaattgatcatagttggacttctcctgttgcttttgccattctggatgaattttcttttcacttaaacattggtatctttggcctaatcattggtcggattttgtttttatttttagcatttttccttggcttaatcatagatgggctcttctcttcccatttcggcactttttggtttaattacacctatcaaatgcatttcctgttccagcttttccgttccattcttttggccaattggcgacagccgcttcttcctccacacccacttccaatggcttttcctctccatccgcggcacaacagcagcagcaacaaccatctccgtttctccagccgtcgcccgccggcctcatggcagccgctgctgcggcagcggctggcaccaacaacggcggcacatttggccacctgttttcgggccagaatatgttgctgaaca

SEQ ID NO: 60743 - DNA, 1665 bp, Heterodera glycines
  Genomic contig location: Contig_ID=SeqID_767; Location=510..2174; Strand=+
  SCN-specific regions: Sequence locations=1-537,559-683,705-1283,1305 -1422,1446-1511,1541-1665
atgagtaccgcatccgaaagtggaagtgacaaaattgtgttccaaaaggtttgtgctcaatggtcatgggttttctgcaaaagtcgattgctttaagaatgttactgggcgaggtagccaggttttggatgacgccgagtttgttaaaatgtatgatcggtcgacttcgaaaaccttggtacttttccctattaaactgctaattttggtggccctattcagaacacttcctcagccaatgacaacgcacagtcaaaccaacagaaagaacaggttcagaaggttggtagctcatttccttctgtctgactttttttcattaatttatttttaagtggaaagtcggtgatcaatgcatggcactctacgaagtggacggaaagtggtacccggccaaaatcgagcagatttcgcctgtaaaaaacacatgcactgtctcttacattggttacgaccaaaaggccattctgaagttggaggacattttggggtatgttttttttaatatagcgaaatcccttcaaatataatcaaatgttggctgttttttgaactataaagagtttttacttgtttggtcataacttctattttgatccagtagtgccgaatttgccgcaaattcgcactttcaacaccattcggttgatctcaattggtacttcaacacttctcactccctttcattttttgaacaaactccgcccataaagcgtagaagactgtccatcgaacagccaattgtgagtttaaccagcggaaatagttgcaatgaatagtagctgtttcgatggaatttggcggattcttcaaagtgccggacattccgcagcatatcctcgagggcaaaagcgggccaaagtggcgggaaagagagggacgacctggcggtcagaaggaatggcatgagaccactgataggaagcggccaaaaacttccgattattttgcataccttcgcttcctcttccggatggccccgcgccaaccttcgattggacagcataaaataaatgaactgtataaatgttcgacttcggttgcagagcgtttcttttccacttatggtctgttctcgaccaatttgtctcattgtcaggcattgaccaaatttttgcccgagtccaattgttgcattggaaatgagaaaagcggcaccacatcggacaacttaaaaaccccagatttcgttagtgaaaacagcacaactgtccgtttatatttggagggaattcgtgacaagctcagaccaaatatgtcaggaattgtcgttagcaacgtattcaatttttatttaagtgaatccgatgttgaggctgccgatgaccatggcgatgagcgtgaagcggaagggacaagcggaacgactaaggcaaaagacaaattggagaaagcaattttccctttcctcagattgcggacaatgatgtgaaaaaagatgcatttccggtatctttttagtatatatacaaggggtgtctcgggacaaaatttttattaatgaggttttcaaaaaaaattgtttaaatttaaattttaagttttcctcttcccccccccccctcccttacgcctaacgaggtggtgcaggccccttacgataaggggggggggttgtctcgagacagaccttgttctttcacaaattaaagcgagtccgtccta

SEQ ID NO: 60744 - DNA, 264 bp, Heterodera glycines
  Genomic contig location: Contig_ID=SeqID_767; Location=52..315; Strand=+
  SCN-specific regions: Sequence locations=1-162,185-264
atgctcaagaagcaggatactaaggcggtaggcaacctacaagttcatcttcccatctccaattccaaccctttaagctgactgccaacgctgttgtccttgccggactttccgtcgccacttctgtggctttctacaacatcgacaagatttccgcttattggacgtgagttatttgggagttgtgtcaattgtatttgccaattcagcatgcccttcactctttgggccattttctgcgctggacttacggtgaaggcttga

SEQ ID NO: 60745 - DNA, 1154 bp, Heterodera glycines
  Genomic contig location: Contig_ID=SeqID_6213; Location=96..1249; Strand=+
  SCN-specific regions: Sequence locations=1-202,235-313,357-521,584 -608,638-674,696-866,888-908,930-941,963-1154
atggcattcaaaatggaagttgccgcggaagagccgaagctaatgccgtaagtgatcactgatcagtgaacaccacacagaaagaatgatggtgatcagtttttggatgtgtttacagtattttaacaccgtaaagcatgtccatttttggcaattaaaaattgcaaaacgctgtttgttgggccaacaaaaacccaatggcttatttaaattaaataatttattcattttttagcggacttcgcaatgagcacgcattggtggtcaatggcaaagtgcttttcgtgaacaaatatgtaagccaaactgattgtatttaatttttaattattcaatttttatttcttttaaatttagcttttggccgctcattcgaaatttttcgaagaattattttttggcgcaaatgcgaaagaaacgccagagattgagatcaaagaagttgagaatgcggcggaacactttgaacgtgtgctttccgtaatgtatccgcagaacatcgaattagacggtgaaaatcgaaattaaattaaattttaattttaataatgaataaaaaaacattttatttaatatatattttcctgaattccgcattctctaattagtaaaaaaaaagatttttttaattatttaacataaatcgctatttgtgatttttacataaaaatcatattcaattttttattcaaatattatcattttcttcatttcgcagatgaatgcgtcgagaatgtccttctgttggcccatcattttctgttgggttccgttggaaatctctgcgtcaaatttttgctggagaaaagcaaaaagtcggccattagcaaattccgattggcacaccaatgcggcatcgttggcatgaaagtgaaaaagaattgaaaaataaaccaatttaaatcacaaatttatcttttagaagaaaattctgcaggggatgagcaaggaggactttgtggtgacggcgaccaattacatggacaatctgtggaacagcaagaagttggaggcggacgcagtggcggaactgacggaacgccacaacgaattgttcaaaaatgaatgaacgagaaaggacgggcagagagaagggaccattctgctgattatgttgtatcacaagttcatcatttcttacagtacacttatca

SEQ ID NO: 60746 - DNA, 1438 bp, Heterodera glycines
  Genomic contig location: Contig_ID=SeqID_6213; Location=3620..5057; Strand=-
  SCN-specific regions: Sequence locations=1-269,291-595,618-676,698 -1045,1068-1438
atgggccaaggaaatggagcctcgacatattctgcaccaccgccttcagcagttgtgagccacggaagggcccgacactcattggacaactcgcaacggacaatgccaagaaatgcgggaccaagagaaatcggaggactagaaggagggacaacaacggcacgggaatggtgccgaaagagagggaggaacagtgcagttggtgccgcaactcgtgcaacaaactcatgacgaacaaacgcaggaccatttggtgccgacgctgtcgctgcacaggcaccaacagcaggaccaagtcgtaccaggaaggcggcaattcacagctgaggaacaacaccagcagcaggacgaccaaattgtgccatagaagtgaaatggccggaggaagaaaagttagcaggcaaagaaagtgccattagcacgaaaaagaaataaaattcgaaattccaaaattaattataattattctttatcaatacaaactgaaatttgaaaatttatgtccctttctgatgatgataagaaggataatagaagaaaaagagcaatttatattaaaatgaatggatggaccaaatcgattcgccgaattttgtaaaataaataattattattaagcattcattttgttgtcctctgctcaattgctgaatttgctgcttgtttgtcttgccatcactttctttttcttttggtcgggtgattaattaattaatgattctttgctgtgctttgataaagacactgatagtaattagggtttatcagttgggttggacttccacgtttgatcattttgcacgttttgtgtactcaccaaaagcaagcaaaaccatggcaaatgtggacagtaaatatcacaggacaaactcaaaatatttgcaaattctctccctaaaaatccaaacaacggtaaaaatgaattggcaacaaatgaaatcacttttatttttggattgaggaatttaacacaaatcagcagaagggaagggcattctcgctccaccatttaaggcatttgttcgtctcgactaactcatttgaagttttacccaaaacaaatttgtcaaaactgggcattcaccaaatgggtgcataattaggggtacaattaattaatgatgatgacaaaatattaccacagatccttttgcactcaaatccttatagtaattactcaccatggacatatctctgtctctgaacggacttggaggtcggatttgtgaaaaatggcacttttatcattggcataatttgccattcgtttttagcaaagcctttggtgccgattgctgacctgggcgacagcaacaagtactcggcggaagagacggactgccgcaataaattggcctcattgtaccggctggtcgacctgttccattggagtcaggccatctacaaccacatcacagtcagtcagaaacagggatga

SEQ ID NO: 60747 - DNA, 561 bp, Heterodera glycines
  Genomic contig location: Contig_ID=SeqID_30322; Location=836..1396; Strand=+
  SCN-specific regions: Sequence locations=1-160,182-214,419-420,442 -469,556-561
atgccacaaggaactgagtgtggaagaaagtgggataaaggacataggagaaccgctaaaaggagcgcccgtagctcagttggttagatcacggcacggattgcttgggtcgggggtttgagtctcaccgggcgagttaccttttatgttctacaaaatgatatttttgtctaataaatattaatgtaaaagaagccgattcttgtcattatccaaaattataattttatgttttgtattagaaattttatatttgacaatttttgtagaaaaaaaataattattttctttaataaaaaaaattaaaatttcattttttctctgtttttaattttaaaaaacttttaaaattttataagttagtaatttatttgaaaactcttttcacaattttttaaatatatttatgaaataaattctcttttgtttgttttaaaatttctgttccgcttatctttgaggcttagccatttattaaatttattaaaattatttttcagttaatttttatttatttgtcaatattttatcaattttattatgatatatttaaatgaggga

SEQ ID NO: 60748 - DNA, 832 bp, Heterodera glycines
  misc_feature (452)..(452): n is a, c, g, or t
  misc_feature (469)..(469): n is a, c, g, or t
  Genomic contig location: Contig_ID=SeqID_30326; Location=534..1365; Strand=-
  SCN-specific regions: Sequence locations=1-209,232-752,794-832
  Gene Ontology: Mol. function=drug binding; Cellular component =mitochondrion; Biological process=positive regulation of growth rate
atgcgttccgtcgtgccacatttcccaccgttgcctgctcttcgtgactttatctacatgtaccggatggacgcggacaaaacgctgagccaaaattacttgatggatatgaacttgactcggaaggtatgtcggattggaatgtttatttttgtaaaaatcgactcggatccaaacctaaattgtcagaaataaagaaaagtctttggttccctctcccaccctcctaattttttattttctggctacggacctgtaagaccgggattttcttcatcgtttttcccagacgaaacccgatttataataagcggaccataagaaacagtactgggttttcaaaaagcaaaatcaaaaattcaggaacaacgacttcgccagcgcggaagcgaaactgaagagacaattgcgaagcggctgaagcacgccaaggaggacatggaagccggtgngacagtccaatgcttanataaatcgcccaacgaaatttcgaaatccgtggaaatttcattgaaaatttccttcccatggcccccctcattttgcccattccagtggagaagcagccgagcctgttcgactatgtggtgatcaacgacatcttggacaaggcgtacaacgactttttggacgtgatcaaccccgagttggacgcattgcaaaagcagaaacagcaccaacaacagcaatagggacggaatgccaagcgatggcgccaaaacggatgtttgaattacatgaagctttagtgtgcgtcctcctcctccacatcccttttttctttcaaaaatgtacatcaccacctcaaaaacagccaaaacgtcgcaataaa

SEQ ID NO: 60749 - DNA, 629 bp, Heterodera glycines
  Genomic contig location: Contig_ID=SeqID_30329; Location=33..661; Strand=-
  SCN-specific regions: Sequence locations=1-293,326-326,350-362,384 -450,482-509,531-629
atggcttttgtccttcaagagtcagttttggcgtttaaaaaggtgcgatttgtttgttgtccccccccccccgggggctaaacagtccgcacaattcaccaaacaaaaagcgacgacacgacgacaattagcagaaaaattgatgatgatgatgatgtggagaaggaaattattttgtgtcgtcatcatcgcgcgcatttgtgaaatttgacaaataaatcatcggaacgacacccggccgacaaattagtccaaattacacgcgaattgcgtgtgatgtttccgcacctccgctgccaccagcagtggcagcagcagcggtagcacttttgccggacatttggcaaaaaattgagcatcaaaaattggttataaatattttttggagtgttatataaatgggaattttgttcacaattttcaaaattgtctcccattacctcaccaaatttcaaaagtttttcatttaaaaaatcaaattcatgttgcccttgactttttcgggcacactttttgaatttttagaaatcagatgctcattcaacccaagaagtaaatgtattttaatgaaaattcagactagacagcgccgaaaccctgcaaagggccgggacccggataaaagctaa

SEQ ID NO: 60750 - DNA, 1114 bp, Heterodera glycines
  misc_feature (1087)..(1088): n is a, c, g, or t
  Genomic contig location: Contig_ID=SeqID_30331; Location=36..1149; Strand=-
  SCN-specific regions: Sequence locations=1-72,94-305,330-643,666-1114
  Gene Ontology: Mol. function=AMP deaminase activity; Biological process=purine nucleotide metabolism
cagctttcgccttttctcaagtttctgatgaaggggctgaacatcagtttgtcaacggacgacccacttaggttgcacattacaaaagtaaaaattgcttcaacgagattttgaataatgaacttgttcttttaataaattttcaggaacctctgttggaggagtacagcaatgcccgtattctatggaagttgagttcgtgtgacatgtgcgagttggccaggaacaggtgggcgagttcacatggcaaaccgggggtcatggcagttcgtacaatgggactttcgtacaatgttccaattgcggatttcgtacaaaatatatatataaagtcgattttttctttaaaaactcatttaacgacttgtttttattgccacttttgtgcatgtttgaaaaattaacacaataaattgtatttcctttcctaaaagcaagtatttaagttatgaaataattgtcgaaaactttcgttgaccaagttcagttgagtgagcaaatcctccgaaaaagcccccgaatgaattattattgtttgcgctattaatattgttattttggatactcatttagctcattacttatttataatttgcttatttttgtcattttgatgaaaagtatgtgtcgctgtcactatcacttatttttttaaatttaatattgtacgaaacgtcaaattaaaacgttgtacgaaacccgattgtacgaaacgcatttgtacgaactgccattgtacgaactgctattgacccggcaaaccgctttcgattgtactgattccccgttaaatttcagcgttctccagtcgggatttgaggtggggatgaccattctctccttttgtacaatttgtttttctcatttgtcaggaccggaccaaaatgtactggttgggctccaactacaaggaggagggcgtattcggcaacgacatgacgcggtaatttactccgaattattttgaattaattatctcgatgggaccgattttagcaaacatatttgatcaattttcagcactaatgtgcccgacattcgcgtctcattccgtcacgaggcgttggtcagcgaactgtacaatttnngtcaggcgctgatgctgtgaatgaaa

SEQ ID NO: 60751 - DNA, 710 bp, Heterodera glycines
  Genomic contig location: Contig_ID=SeqID_6214; Location=1741..2450; Strand=+
  SCN-specific regions: Sequence locations=1-161,183-684,706-710
atgttatccgaggacggaagcagggacaatcaaatggtaagcgagcagagaaatcaaaattcctagataaaaaaacatttttaatttaggagcgaagtcttgtacgtggagttgaaggacatgatgatttgtcggggcgaatcggctcgctgtcgctgcgcacaatccatcaacaacaacctgtcacactaccagctgatcgtggacgagctggaccgttggatgatggacaaccaccaactcaatcggcgggacgtcgtcgaacaagaagaagaggaaaacgtcgaccactcaacctggtgaaggcactgtgtcgtttcaacggcggctgcatgccatcagttttgccgcagatgattcagaggagacgaatagaaaatttgtgttttcttcgtgatctcaggctgcaaacagtgcatctgaagagtaacattatgatttccgccaactcattgtcatttcacagtgcaggcagtttgcttgcctaccgtggctatttgtccataacggtagagcagcacttgtacgttcgccatcgtgttcgtcttaggttccccttcctgccctgcgttgtgcaatatgggggaaatcaccatcactattattttccattagaactgcttgaaatatgttctcgtccaactgacgaatcctcctaatctacacaccttccgaatactgttttattgttgctgttgctattgtgaaaa

SEQ ID NO: 60752 - DNA, 884 bp, Heterodera glycines
  Genomic contig location: Contig_ID=SeqID_6214; Location=2804..3687; Strand=-
  SCN-specific regions: Sequence locations=1-447,469-884
atggttgatgagcgaactggcgaaatccgatatgtgcaaaaaattagaggaataacttttgacgtgcaaaacagtcagaccctacagtttgagcattttcgtcagaaagtgttgaactatggacgtcaaggagaggagccagccgtgttccattatgataaaattcaaccgactcgtgcgagtcagattgtgacacgtgagcagcgcaagcgatatctgcccgtctgccagaagggaattatcactgatgagcttgatgttcttccttttggttatcaatgaataagcgataatgaacctatcacatacctatttaatcgccgtagataaaattttaagaatttcataattccgttttcaattggtttttttggcaatgtttatttcattaatgactaatcaacaacctttaaagagcaattgtaggacaagaaattagcagtgacaacatggacaacagtgaatgcaaaactgaaaaggaaatggatctgaaaccggaggaaaaaggacatggagaggaaaagggcgaagaagaaattgtttttctcggcatgacgataaacgaaacgcccaaggatgaaaagaaggagctaccgccttccacgagcagtggtgatagccgaaaacgacgtcattcatttgatgggtccgctacctcaatgttgggcgcaatgatcaaggcacagggcgaagcacgtgccgaatggtaaattgtgaaagtggcataacatagatgcctcctattaaaaacaggctggatgcgttggaaaaaaaatactccaaactggaggaagaaatgggtgtggacgacaatgcctcggacgtggtcgattttggggaagactctttggacaccatactaaaaaagtattagcaaaaataaa

SEQ ID NO: 60753 - DNA, 181 bp, Heterodera glycines; identical to SEQ ID NO: 52969
  Genomic contig location: Contig_ID=SeqID_30332; Location=710..890; Strand=-
  SCN-specific regions: Sequence locations=1-3,27-181

SEQ ID NO: 60754 - DNA, 258 bp, Heterodera glycines
  Genomic contig location: Contig_ID=SeqID_30333; Location=353..610; Strand=+
  SCN-specific regions: Sequence locations=1-258
atgacatacaaattgatcggcagccctaaaatcaaagcctgtaaagaacaagcagtgctttacgatggaagcacaagaagcttcatcggaaaagggaccggcacattcgaattcaacggagtgaatgttgaacaagaattttatgtggccggcaaagattccctaaatttgctgtctattcaaacaatggacgcatttgggctgctcgacgaattgaaggaaaagatttcctcaaaaatggtgatatgtgcaaaggcg

SEQ ID NO: 60755 - DNA, 913 bp, Heterodera glycines
  Genomic contig location: Contig_ID=SeqID_30334; Location=287..1199; Strand=-
  SCN-specific regions: Sequence locations=1-139,231-371,433-545,567 -731,754-786,817-834,856-913
atggtatttaacgcgttatttcgtcatttacttggccatgtgctcatcattgaacggtttctggcaacaatctcaacaaattcatatgaaaatttctcaaagatgcagttcaccttcatttggctcatcattacggtagtttttattttttaaaattagtatatagtaaaaaaataaataagcttgaattaaaacaactaaaaaatcaaaaataaaattattaaaaaaatgaaaccagtggcattttattacagttcatcatcgcatttgtgaatacggtaaccaatggacagtcatggacatttactacattaaatttaatcacccaaacaatgtcaacagtgataagtctctttgaatatttggtcagcaattaaaattaaatatttaatatatttattttaaattaatttttatttttaagttaattatcgtaattcggaattacaactgtagaagatatattagtcaatttgaagaagcatcgccaaaaaattatcatatcggacagcgatatcaagtaaagtgtaaacatttattgtaaattaaaaatgtttgtgccttaataaatatgaattaatgaaggtttctgaaaatgtgaaaacagcaacgcaactctcaccaacatttttatgcctatttttgacaaatttatcatcaaatttttttgtatttgtcacaacatttggaattgtcactgaatcaaataatatctgtttgacatttgcttttggcatatggactgatgtatttttaagtgccgcaacagaactcacaattatgacgtaatttttaaattttatatttagaaaattagttttgcgatgtttttttgaaaaccaaaatttctcagtcgaatagttttatccttttagtgaaaaaagctttttcataattcctgaaaactattaaa

SEQ ID NO: 60756 - DNA, 91 bp, Heterodera glycines
  Genomic contig location: Contig_ID=SeqID_30337; Location=814..904; Strand=+
  SCN-specific regions: Sequence locations=1-91
atgttaaatattttttctacaaataaaattaatttcaatctattagtacctggatccaggcctgtagttttcctggcttcaggtcaggcag

SEQ ID NO: 60757 - DNA, 316 bp, Heterodera glycines
  Genomic contig location: Contig_ID=SeqID_30339; Location=313..628; Strand=+
  SCN-specific regions: Sequence locations=1-32,150-157,179-184,214-316
atgaatgggccaaaaagtggcgaaaacagcggaaaaaagaaacaaataaaaaaaggtgagcaaacggaggaccaaaagagaaaaggcaaaagagaaaaggcaaaagagaaaaggcaaaagagaaaaggcaaaagagaaaaggcaaaagagtgtcataatttgtattattatttggtaatgtttgttttattaatttttgtattattattaaatgaaagtgtttatttgttttgtatttggtcgaaagaaaaaaagggaaaaacccgagaaaacaaacaaaaaatcccgcaaatattttgttgtttttgcagtataa

SEQ ID NO: 60758 - DNA, 1018 bp, Heterodera glycines
  Genomic contig location: Contig_ID=SeqID_30340; Location=207..1224; Strand=+
  SCN-specific regions: Sequence locations=1-32,91-164,186-219,514 -566,588-616,638-704,726-1018
atggttctcacaaccgtaagtcattaaactccatttgttttattatttataaatttatttattttttatactattattttattttctattctttgttaggtcctttcaatgatgcgttatgtgtccgaaattgatgatcgcgattttgttgatcgtttgcatagcttttttacaacaaatttactcattgggctgtcagttttagtcagctttaaggtcattttttaaatttgcttttaatattattttataaattaatatttaattccaatattttaatatgattaatattaataaaattttaaaaattataaattaattaaaaatattaatcaatatactcaaaaaataatcgtaattttgagaaaaaaacattgtttaggataaagaaatattctgtataatttttttcaaaatttacattaataatttaaagttcattttaaataattgaaaaaattgaattatttatttaatttccatattcattaattaaatgttttttttattaaactaaagacaaaatttcagcaattcggtggcaaaccaattgaatgtttaactccggacatattttccagctcttgggaagaagtaaatgagagaattcaggatttctcaattaattaattaattacagtacgccgagaattactgttgggcccaagacacttattttgttgcaccgtcaacaaacgttgagagtttggaaaaaattgaaagaaaacagcgtcggatcagctattatcaatgggtgggcgttaacatgcatcgctaaacataatgccaatgattggccactcccatccccgaaaaataatttaaaagaaaaacgagagtaaaaattataaattctaccgataaatcatttcccggtggcatcgcccaacggcaccatcgtacaatgatttttcctgttttgcgccaacgagtgaaaaattcggaggggcgtgggaggggtgaggtagttcaggcctgtagccagaaaaaaaaattcagatcggggaacccgaagaca

SEQ ID NO: 60759 - DNA, 1112 bp, Heterodera glycines
  Genomic contig location: Contig_ID=SeqID_30341; Location=625..1736; Strand=+
  SCN-specific regions: Sequence locations=1-157,357-398,436-555,577 -810,900-1112
  Gene Ontology: Mol. function=transporter activity; Cellular component= integral to membrane; Biological process=transport
atgcgaacatcaaattcagcttcttcagcagctgttgctgatgatgctaatggtggtcgaaattcgtcggacgattcaccgccggttgagccggaagaagaagcattggattacatggtcaccattcccgagacggacggggaggtgcaaattttggaattaaatacattaaaaaattaaaactatgaaaaaatgcaaaaatttaattaaaatattttaattaaaaaaattatcattttttttattttgttaaaataataaaattttttaacactaaaaaaaatcattttaatttcttatattttttaaataagaatttttttaatgaaaatattgttttttaatatacattttttcagtcggcgttcagttttcgcaagctatgggccttgtaagttaattttctttttcaattatttaaatgaattttttgttcagtaccgggcccggctttctgatgagcattgcctatttggacccgggcaacatcgaatccgaccttcagtccggcactgttgccaggtacagggtaagcggaccttttgcggaagaaagctaatttcaccatttttcaagttaataaatttagatttttttgaatttgtgctaaattttaaaccatttaattttcttcgttttcttagtccttcgatatgaaaattcttaaaaacataaaaaaattctcaattaaaaatatttcctcattaatggcttttcgttttttcaaatattttcttgaatgtttatcctccctgcttttttttattgcattttttgaaattttatttctttcataaacaaactttacaaattttaatattttttagtaaattttaaattttcctatttttaatttatcattaatttaatttattttcaattttccttttttatatttttcccattttcagctcctttgggtgcttttgttggcccattgcgtcggctttttcctccagcgtttgtccgctcggctcggcgtcgtcgccggccgaagcatggccgaattggcatttgagtattacccgcgggtgccgcgcctttgtctgtgggcaatggtcgaaattgccatcatttgtcagtttaatacactaataagccattacaaatag

SEQ ID NO: 60760 - DNA, 271 bp, Heterodera glycines
  Genomic contig location: Contig_ID=SeqID_6215; Location=374..644; Strand=+
  SCN-specific regions: Sequence locations=1-271
atgacctacccatttttgcgttacagtatattaattgtcattttgtgccttgtgtacggtaatgatgacgaaaacaggcaagaagcaattcataaaaatgacgattatatcattggtgatgtttatcttggtgacgaattttgggaccaattttcaccgatcactgatttgcccacaattgatggagtcgaatttattggaaatcatttaaaatatactgatcaaacggagaatgataaaactcatgaaagtgtgattgaaaaataactaa

SEQ ID NO: 60761 - DNA, 624 bp, Heterodera glycines
  Genomic contig location: Contig_ID=SeqID_6215; Location=740..1363; Strand=-
  SCN-specific regions: Sequence locations=1-552,574-624
atggcactgctgttccaacagctaacagacactctcaaaaacattgcaaatcaaaatgcaaatcccaataaacaaaactccgatttattcgctacaattaattcccaattgtccgaattcatctacaacccggaggcggatttggtttttgaaatttggcacgaacgttatgggccatttcttgagacagatggacaatcattgccagatgaaatgaagacacgtctgttggtcggtaagcttggtgcgcaagaatacgcgcggttcacggagagcattctcccgcaaaaaccaacagacctatcatacaatgtcacagtaagcaagttaaagagtctattttgcggcatcaaatcaatttttgttaaacgatttgagtgttttcagttgcagaaagcaccttcacagagtccaatcgatttcgcggcacaagtcagcgcacaatgtgaacgggcacaaatgacactgaccaaggaggagatcaaagctctcgtgttcatcagcggtctgagctcagctgaccgcgatttgagggagcgctgtctcaaaatgatggaagaggaccgagccaagaacacggacatcaagtttgagcggctcgtcgaggaatgccgctccatttaa

SEQ ID NO: 60762 - DNA, 775 bp, Heterodera glycines
  Genomic contig location: Contig_ID=SeqID_6215; Location=1572..2346; Strand=+
  SCN-specific regions: Sequence locations=1-303,326-351,373-628,650 -731,753-775
atggaatacacatatgttggcttcactgtccacctcaatgtgttctcattcactttcaactgtgcgggtgttcacagagctcgcaatgagttggaattccacacagagtgttacgtggaggtggcctcgggttttgccaaagatgaatgaatgaggagagaaatgaaagatgcctgggactgccaaaatttaaatgaaatggatgaaaaatgccttatgctgactgcgccaaaaatgttgtgtcttttgcttgaccacaacacttagaaggaataaactttaataaacaaaataagtccacaaatagataaataaaatagaacaataaattgatgacagaaaataatgcgaaatgaatgagagatggcaaatgacatggactgaccaagactcactgtgtgttcggctatttatgaggacgaacacagggaagagacgcatgaatagtgaaggagagagacatgacaaaataagagagtgcagcgggagagaaatagagaaatgactgaaagggaaatgagcgaagagcaaatattgattgactacccaacacttttgctttttattgttgaaatgcgctcgacctttctgcggctgatcactgctcttttcaggcgattacgtcaacggcacaatgctcaccggactgtgccggcaaattctgctcgaagaccttaaggagtcgcgaaagcacgacattctcgagtggacagaagtgccgcaaaagctgaaagaacagctggaaaagcaggaatttgatcagaaatgcaactga

SEQ ID NO: 60763 - DNA, 362 bp, Heterodera glycines
  Genomic contig location: Contig_ID=SeqID_6216; Location=405..766; Strand=+
  SCN-specific regions: Sequence locations=1-213,237-284,307-362
atgccctcaagctatggaacaagcggcgcaatgagtcagagttacggtatgggaggaggaggaccacccgcggcatacgataccggtgcacgaggatcatacggtagtgcaggagcagcctcatacggtaccggcagtatgggttcgggagcatcttatggacaggcagaaccgaaaatgtccgtggcaatgccatcggcaatgccgccaccgccggcaatgccaatggctgcgccatacggtggggacggaagtggccgctatggaaatgacggtcgtcgatgaacgaaaagaaacgaaacgatagattaattaccgtatcattaattcccactaattacaaaacatttactattttttaa

SEQ ID NO: 60764 - DNA, 398 bp, Heterodera glycines
  Genomic contig location: Contig_ID=SeqID_6217; Location=1..398; Strand=+
  SCN-specific regions: Sequence locations=1-72,94-238,262-398
aatccgccgccaactcctctcccgtcgcctcagccctgcgggcagtacaatcagtacggaagcggcggcgcctttggaggcggcggaggaggcagctacagtcagccgaactgcaacacatacgggcagcagaacaactacggccagtccaattacggtggtcagagtaattacggtcagcaggaaagtgcgggtggatttggcggaattggcggcagcccatctcagttcggagtgggggcgccaggctgtggcggggcgagttgctaatcgactgaccgatcggaccgatgcgaaaagccaaccgatcagcgaccaggcgattgaatccgtcatttcctgttaatcaattcatcttagcgttctttttacaaccaaaaaaacaaaacaaaaaaagg

SEQ ID NO: 60765 - DNA, 1238 bp, Heterodera glycines
  Genomic contig location: Contig_ID=SeqID_6218; Location=514..1751; Strand=-
  SCN-specific regions: Sequence locations=1-131,153-714,773-968,1117 -1238
cgaagtcggcatcaccattttgaactcgatgttggtcagtgtgccgtttccgtccacgcgccttttttggtccgtcccttaggaaaacggcgaatggggcgaggaggagtttcattcgaatcccttcttccatgggaaaccatttgatgtgcgaattcgagtccacgagaaaagattcgacttttttgtcaaccaagtgccgtgggctgtgttcgaacaccgcacggatttccgaaaaatcgaccacatccaagtaaaaacacatttggtggtcctatgatttgtgccgtgcattcgccaatatttgccaattcaaaggcgtcgggcgacgtttcgctgtccgccgtccattggggcggccgatacttcgaaatgccgtacgaaatgactttccacgaccacgcgctcgaaagtgggcagcgactgttcgtttatggcattccccgcggcgatttcgccgtttcactgatcagcgacagtttggaggagctgttcagaatgagtgcactgttcgacaagcaaattgtcattcccataatccatggacatttaaatgattctcatcaatttgcaggtggtccgaaatgcccaaacggacaaagaatggggcgccgaagaaagtgaaggaggccctttcccgttcagaaagggcgaggggttcgacttggtcattctgaacgagccattggcactccaagtcagtccttttcggcatttcttttctgtcctttgtttctcttctttctctctctctgttcccttccgttctttttccccgcctcaatgaatcttttatatcatttcgaagctctactttttaagacaattgttaagctgttgtcaagcgattaaacttaaaaaagctgcaatgaaaaccgcaaattaagaattttaaacttgcctggggccaattgacgggacatcgttggccttttccgctttctcatcttccttactcacactgtcttcccccgccctttctcacattatcactctccactatccatccctccctcgtccccctctttttctcctcaccacctctctcctctatccctcccccccccttatctccctcccgtttcttatatcccttttcccctctaattttccctcagatttccatcaatggcactcccttctgttcatttttccaccgcaccatcgatgcccacaaagactacaaacaggtacgcattagcggtgaggtggaattgaccgggatggaagtgagtctg

SEQ ID NO: 60766 - DNA, 736 bp, Heterodera glycines
  misc_feature (705)..(705): n is a, c, g, or t
  Genomic contig location: Contig_ID=SeqID_30342; Location=856..1591; Strand=+
  SCN-specific regions: Sequence locations=1-318,342-674,697-736
atgccacaggcacaaagtgtcattcttctcgcgcacgacgggcacaacaccgacttggcctcggaaacgctcacagcgaggtgaaaaatgccaaaattactataaatgcgtttcaacacttatttgattaattaagtgctcgcctgtcaaagaaagtgccaatttttgcaattgccggtggaaaaacgccgccggcgctggccaaattggacgaatacacgggaggacagcgccggagagtgttcgcctttgagcaggacggacaacagtttttggacgcgttggacgaggtaaattgaaaaaatgttgagcgatttgattttaataataataattatttaggaaattgagttttgcccctcgccttcatcggtgccggcggagaaaaatgaagcggaaccatcgccatcggttgctttggcggcggaagcggaaaagccaattcagaagagcgaagtgaagaagccgatggaaattattcggaaacaagtccgaaactcaaaggacctggtcaaactggagtgtgggacgaactcgggagaagtacggaacaattgcaaatttaataatccattagggcaaaaaattaaaaataaatgtttaggatttatgacctaaaaagtacgaaaatttcgatttaggtgttgttgataatcttaagacaattttttaggattttttaaatatttaatatttcgattttgngattttaaaatttcaaaaaatgtccattaaa

SEQ ID NO: 60767 - DNA, 274 bp, Heterodera glycines
  Genomic contig location: Contig_ID=SeqID_30343; Location=14..287; Strand=+
  SCN-specific regions: Sequence locations=1-274
gggaaagatgactttttgctgctgccacctgttttgtggaaatcgcgacaagaaggccgcctttgtgcgtctcggaagcgcaatgaaacattttgacagggacattgtgccaacatcggatggggcaagaaggaggaggaaaagcgaacagaaactcagactggagacggacgaacagagaatgaggctggagatggagaggcggacgaagacgcgcaagcaaataggggagaggaaacgcagaagattgagcaccgatgataattgggaatag

SEQ ID NO: 60768 - DNA, 169 bp, Heterodera glycines
  Genomic contig location: Contig_ID=SeqID_30343; Location=1022..1190; Strand=-
  SCN-specific regions: Sequence locations=1-48,70-169
atgttgttccaaaatggtgcgtaagaagaaacgtgatcaaaaacgaaggaaggaagaggacgatgacgaagaccaggaagtagaggaaaagcgacagaaactgaacttttctgagaaggacacggaattattcgttggaggaattaaacttggacagcggagctcctga

SEQ ID NO: 60769 - DNA, 438 bp, Heterodera glycines
  Genomic contig location: Contig_ID=SeqID_30347; Location=333..770; Strand=+
  SCN-specific regions: Sequence locations=1-362,384-438
gacccaacatttatacaaccattcgctttgctttacgtggcctcaattttcgcgcagttccctcttttctttacgccgtttgaatgctttttgaaatgggcgttcacactttggcattttgctctttgccaattcttggccaattttgtgtggcgcattcgattggccgaatttgcgcagtttaccgtcgttaaattggcactttttcaaatgattttggctcaattttatgccgatttttgtcatcgggtaatcgtttttttaatagaattcctttttttgtgtcttttcagctgatttttggctcaaattttgcgtttttgccgatgatggtcccttctgttgcctgtgctcttctcgtcttttttgcttattgccatttcattctcattgtttttgcggaatctgttcaaatccattttttcaaatttcgttgtc

SEQ ID NO: 60770 - DNA, 530 bp, Heterodera glycines
  Genomic contig location: Contig_ID=SeqID_30348; Location=156..685; Strand=-
  SCN-specific regions: Sequence locations=1-120,178-530
atgaatgcattaatgctctccgcgttgtcaacgttttttgttcttttttgtgccatcgttgggggtggagtgataagaaaggcgcaggacactgaacaaccgccgatggcgacaggtaacaaaataaaaataaattaaaaaaaaaaactcaaatttgtattcaaaattaaattatttgcttgtgtgtagggtgctgagccgttataaaaaaaaagccatcaaaaagggcgtcataaaaaaccattaaataagaattttcaacaaaaaactgtccataacttttgtcaaagtcaactaaaatagacatacttggtatcattcgatatccctaagaattctcaattagctcggctaaatttcaaaaaatttggtcaaggttgagcaaagctatggccaaaagtacacatgtggccaggttttcgaatatttttggccataagttttttgaaacctatcgaaattttttgatatttttcaggctaatagagaggacacatagggcaatcgaataatcaaaaaaaagaaataaa

SEQ ID NO: 60771 - DNA, 63 bp, Heterodera glycines
  Genomic contig location: Contig_ID=SeqID_30349; Location=23..85; Strand=-
  SCN-specific regions: Sequence locations=1-63
gagacccccggcggtgttcgacagacgccgcgtgagaaattggcaactgatcagacgacctaa

SEQ ID NO: 60772 - DNA, 3474 bp, Heterodera glycines
  misc_feature (10)..(10): n is a, c, g, or t
  misc_feature (151)..(151): n is a, c, g, or t
  Genomic contig location: Contig_ID=SeqID_6219; Location=1..3474; Strand=+
  SCN-specific regions: Sequence locations=1-163,186-254,304-599,621 -817,841-903,929-1139,1183-2268,2295-2451,2487-2507,2529-2996,3026 -3082,3104-3284,3322-3474
  Gene Ontology: Mol. function=Rho guanyl-nucleotide exchange factor activity; Cellular component=plasma membrane; Biological process=Rho protein signal transduction
aatcagcacnacgcgtggacgcgctaggcacagtaaaacggggaacaataaatcactaatggttaaatattttttacttttacttcaggtacaatcgcgcaaaggacgacccgttctcactgtttttggccgaggccgagaacaacccgtntgtgcaggaagttgcagttgaaggacatgattccggcggaaatgcagcgactcgtcaaataccctttggtgggggggggggggggaatattggccaaatgagcattattttcaaataatttacaaaaaaaaattaaaataaatttattatatgtacacgatttcagttgctggaaaccgtggccaaatacaccccggagccaagcgacgaattgcaaagggtaaagcaatttttgacaatgattgtgcatttgtattaattaaataatcgattcatcagttaactgattaatcggaattatttcccaattgtttaagctgctgagcggaatccaaggcgcaaaaaacattgtgtcggaagtgaacaggtgggtgaacaaaggaattacaaaaaaatttctgaaagattatgatcatctccggcgggggcggtgatatagctaatgggacactttaaaaatgcaattaaatttattgaaaaattacgtgatttttttaatatttccacaatcttcaacattgttctgtctctttacaaattagcccaacttctttacggatgctcaaatcattttacacataatccattcattgatttattaatgagaatgattagtccgctaataatcgcattcagtgcaaaacgaaatgcggagaatgtgcggcggatggaggagctgcagaagaaattggacttttctggggctgaaaagagcttcttccagaagttcgactttcgaatgtgcgcctttcaattatatataattaataaatttatccaagatcaatacaaattaaggcacaaattggtcttcgagggtccgctggtgtggcggcaagcacgcggcaagaacattgaccttcacgttgtgctgctcgaacatctgttggtgttcctcaccaaaacggagacgggcggcggcggacagcagcccaattttcagctcaaaattcacgaggtggcagcagaagagcactttttttaatcgaattaataaatatttttaattactcctccgattgctccgcccttttgcgctttttacttttgcttttccttaggccgggtgcattccgatcatgcgactgacatcggttgaggtggaggagaaggcgggcgacaagcgttcattcaacctgctctacaaatgcgatctgcgcatgttcgagttggttgcacaaacggcgacggaacggaaaacgttggtttatggaaagggacggggatttattgatcagataaatggaagcccatccctagtcaatgactgaccaacattgattaatcccttccgatgatcaaatgctggaaaaattctctctaattagtccattgacttgacaacggttggagaatttacaaattcattatcactgatcaatgttttggctattcccacataactttttgctcattcccctctctaattttaccacttttttcgatttccagttggtttcggctgatcgacaaccaggcgtccgtctcgcggctgtcgcccgtaccggccgaactattcctggacggcactctgtccgcctcggctctgacgatggctcagcatggcggcggcgtgacgccgctgacgaacaaaagcagcgaagacgggtcgctgcaaaggctgaacagttccagcatggaccacgtgcacgtgctaatgcacccggcacttgtcaacgcggtatgatcttatccaatcacagtatccaattaccatatccaatcctcatttactaataattggtaaaacaacctgcggcctctttcggcattaaatcgaatttttgtttatgagtttttctctgtcttaaagtgatgataattcacattttcgattctcgggaaattgttcgagtaccgtaaattataaattaaaatcttcaataattagccgctcactccttggcatttctgacatacaaagcgcaatgcttacttgtacattttatcattttgccctttcagaatgaaattgtcatccaacagcccaccgtgatggacaatgcgcagccggtgctgagcgtatcggaacggttgcgcaaaaatgaccggatgatttttgcggcattggcggaaaagcaccaaattttggcagaacttttgaacgattacggaggagcagcagcagcggaggaggacggggaaaggaataatgaagtgagtgaggagagaaaaaagagcaaattggggggggggaataagcaccaggggaaggatggcacggcacaaagtgggaacagagggggagtcacggcgcaaaagcatggcacggcacagatcgcattaccaagcgtacaagctaattttttttttcattaatttaaattgattttttctcgcttatttcttgtaataactcttttggttttttcattctctgctaattgataatattgataagttttgcccctatcatttaactcttcagaacaatggcggtcgaaaagcagcgccaaacactgccgagctgctcgatcggatggctgatcagatgaccggcctggcggtgctcgacttaaagcaacggaacgccaaggaattggcgatgtccgccattgtgcagggcaaccgattgctggagagcatcaacaaagtgggccatcatttcgtatatatttctatgaaattaaaataattttgttagggaatggttgtgaagccgtccgacgacccaactgcgaagcccaagttggacaacgaagacgaactgatgttgccgtcagtgccctgctacaaattgacctcggtcgattgtgcccaaaactgaaatttatgtaaaaattgcaattttcaggtggcagcccccctaatgaaccatctgaaggtttattggaggaccaaacaaatttcaaataatttttaaattttttcaggcaatgctccaagtgcttcaggaccaagagcgcgaaattcagacactgaagcagcggctaaaggtgcggcacttttcatcccttagctaaacaaaatgccaaatttaccaccactattcacatataaatttttatttggcaactcgtacttttcgtatttttgaatttctacagtatacgattggatggatcagtccgaatcagttttgcccttctttatgaagcaaattttcacttaacaaaaaaggcccacagaagcgaaaattactaattattttatatatttacatttaaaaacaaatttcgctttgcttaattcgattcattccgcaggacactcagtcaaatccgtcgagaaaaacggcaagcgaagaaacgcttgtcgagagtggagagcagcgcataaaagtgacgaggacatccgtcgaggaggacacgccgccgccccct

SEQ ID NO: 60773 - DNA, 63 bp, Heterodera glycines
  Genomic contig location: Contig_ID=SeqID_30354; Location=633..695; Strand=+
  SCN-specific regions: Sequence locations=22-63
tggccctttgccttttggccctccccgtcttttccatgtcccaattggaatattttgtaccct

SEQ ID NO: 60774 - DNA, 1188 bp, Heterodera glycines; identical to SEQ ID NO: 30360
  Genomic contig location: Contig_ID=SeqID_30360; Location=1..1188; Strand=+
  SCN-specific regions: Sequence locations=1-46,73-124,146-259,281 -597,623-678,700-1188
  Gene Ontology: Mol. function=apoptosis inhibitor activity; Cellular component=cytoplasm; Biological process=chromatin modification

SEQ ID NO: 60775 - DNA, 796 bp, Heterodera glycines
  Genomic contig location: Contig_ID=SeqID_6221; Location=746..1541; Strand=-
  SCN-specific regions: Sequence locations=1-85,107-796
atggaagatggagagcctgtccaggctttgcccccacagaacccagggcaagggcccaaagagccaattaatcgagcgcctctgggaaagagaggcaggggctatgccatgggagggcatggccctagagggcaatggaagaatggaggccagaaaatccaaaagcgcgtgggctatctggtccgtcagctggagcgcgaattccatggtcatcacgatgtgccgccaagctgttcatcatggacctgtcaccgtgcacgaggatgggaccgcggaggccgtggaggaggtcgtggacgcgggggacgtggaatgcaatttggacgcgcgcactaccatgccggcccatctcacggaggacgctgattgggaatgatgatggacgggacgtctcgaaggaggagagggattgtggtgtctgcattttggtctttttatttatttttgtttttggcatttttgcattgacccattttccaccaattctcatcgtaaacattttattcatccatctctcaatccttaccaaatccctctctccaaaattctctctctccgctttgtgtaatgtggcctagactattctcacccgcttggcttcgcttggctcctcccaaaaattgtgccgtatttaagctctctttctgctttggaaaacacttcttcttactgccattctcccttcctacttactctccctttgcttactcttaaccaattttgctataaccaattttgcttattcttactcttaaacaattttgctttgctttaataactgttttgctttaataaa

SEQ ID NO: 60776 - DNA, 2100 bp, Heterodera glycines
  Genomic contig location: Contig_ID=SeqID_6222; Location=1289..3388; Strand=-
  SCN-specific regions: Sequence locations=1-369,391-512,535-578,600 -1854,1876-2100
atggccaatttgactgaattatattcaccggaaaattttaacgagacaattgaagcagcaaagattgttcaagaaattacccgtttatcaaagcccgactcgtgggacgaacagtcagaacgaactgatcaaattgcggcaacaattgttgccaacggattatttgctttcttaagaggaggtctttttacgttaaatcaattgtgggtgtttatctgttgctgctatgtcacgataactattttaatccaattattcctcccacaacgaattgcccaggcctttcagtacttaggactaatcggtcaaattacaaagatttttcggaaaaggcgaagaattccaagagagagaaatgcaagccgtccggaaataaaaaataattcaaatgaattggcaatacctcctaagcccattttaaaaaaagaaagggaagtgataaatatcatgccattaacagaaaggtggccatccccggaaaatggccaaatgtcacaaggaaaaaaggtgaattttaaagaaaatgggcaagacgaaggagtggcacaagtaaatattgttgagaaggaggcatgcggcccaaattttaaaattggtgggatggtaaatgagaaaagagttattttcttgttagacactggagctcatgtgtcattgtgcagtatgaaaactgcaatcagattgggaatcacaaaattggaaatggcccaaatttctggagtaatcggagtgggtggaaagattgttcctattttgggacagagcaaaattttgttggaattagccggatgttatgtggagacaattgtttatgtgaccgaagcggaaatcggcggaacgcagagttatgatttaattgtgggaagaaacacattccgccaaatgcctctattgttggatttgcaaacaggaaatttgattagtaaagaaaatggtcaaatttttgcttgtgaaaaagttaaaggagttaaaattgaattttgtgaggaaaatcggaaaattgaagacggagagcaaatgaaggttgaattagaacgctgtttggagagacataaacatgtgttttcaagtcatgaatatgacttaggacactgtgcctacgaggcccctccaattttaacaacaactgaaatcccagagaaaataaagccttatccagtgccggaaaaatatgaaagtgaattgaaagtgcaaattgagaaaatgttggagtcgggagtaattaaagaaagttgcactccctgggcacacagcatagtgttggtaaagaagtcgaatggtcagctacgcccatgtgtagattttagaccgctgaataaaattacgatcccggatccgtacccaattccgagaatggataaaacgattatcagagctgcgggaaaaaggtggtatacaaccttagatttggcttcggggttttggcaaattccgctggataaaaagagctcatataaatgcggaattgtaacaccatggggactttatcaaatgcttaagttgccttttggtctaaaaaatgccccaagcatatttcaaagagtcatggataaaattttggatggaattccaaacgttactgtgtacatagacgatattctcgtccacacaaatacagttgaacagcacttggacactttgaacaatatttttgaaaaattgggaaaaaacggattaaaagtaaaaaaggaaaaatgcagtttccttaaaacacagtgcacttatttggggcatgttttgacaaaagatgggtacagtccatccctgaacaatcgagaagtaatcgaagcctttcctgtgccgaaaaatgccaaagaagtgaagagatttttgggaatgatgtcattttttagaaaattcatccctgattttgcaaaattagcctatcccttaaatcaattgacaaaacaggaaaacatagagtttaaatgggaagatcaggagacagaagcttttgaaaacttgaaaaggcaattacttaaagcgccctgtcttagagcgccggactataagctgccattttatttgtttaccgacgcatccgcaactgcatatgccggagcattgatgcagtctgagaaaagtgatgaaatgcatgcg

SEQ ID NO: 60777 - DNA, 184 bp, Heterodera glycines
  Genomic contig location: Contig_ID=SeqID_30362; Location=243..426; Strand=+
  SCN-specific regions: Sequence locations=1-184
atgtctgaagaaggcgaaattcgtgaggattcgccggaagcaccggaggcagttccacctcaggctgatcagcaagaagttgatcagacaatttttcgtgagaagaaatcgacgcacaaaaaaacaattcttgtccacgacggttatgagtacgggttcgacaaattaagccgtgcagacccca

SEQ ID NO: 60778 - DNA, 874 bp, Heterodera glycines
  Genomic contig location: Contig_ID=SeqID_30364; Location=130..1003; Strand=+
  SCN-specific regions: Sequence locations=1-168,192-457,487-504,526-874
atggggcctcaaaaatcgaaaatttgcctgtgttttcacttttgtgatggtggtcaagtggtgcacgatggcgaagtggtgactgatggttcgagtccgcgtgggtttaacaattttttattatttttactaactattttaaagtgaaaataagtgggcaaaaaattaaaatgcacaaaatatttaattacaacgatgtttgacgaaaataaaatgatcaaaacagagatttttagaacaccatgcgcaccgaataaaaggaggagaagtacagttttggcaagcaatataaacatcaaaattcttaaaacaatattcgggtggagttttaaaagtcactgccgctttcagaatcaaaatccaaatattcagtgaggggatcagtggggctttcagcgagaatggtctcaagattttgcacaaagtgtgaaacctcagcattatttttgtggcggttaaaatgaaaaatgtacaaatttatttaaacaaaaggttaaatgtttacatgaatatttgcaagaaaaattacaatcgtaaacataaaaccgaattaagtattcttgatttagaaaatctatgatcagatggctaaaaaatgtttttttttgttttttgctattttctcgtgatttttttttagaatcgttcaaaaattcgtccggcgaaaattttgtccaatgcatttcaaacttcaaactttggaattttatgtatagccaggcgattcagtgctcagatggttctgtcgttgttgtggttgtgggcgatttggtcgaagtaccgtaacaccgccaatgtggctgacccggttacggttgaacagtttcatgtacagtttaaggcaatcttggcgcacagttttattcagcgtcaa

SEQ ID NO: 60779 - DNA, 259 bp, Heterodera glycines
  Genomic contig location: Contig_ID=SeqID_30364; Location=765..1023; Strand=-
  SCN-specific regions: Sequence locations=1-259
gctttccaccggtcatttatttgacgctgaataaaactgtgcgccaagattgccttaaactgtacatgaaactgttcaaccgtaaccgggtcagccacattggcggtgttacggtacttcgaccaaatcgcccacaaccacaacaacgacagaaccatctgagcactgaatcgcctggctatacataaaattccaaagtttgaagtttgaaatgcattggacaaaattttcgccggacgaatttttgaacgattctaaa

SEQ ID NO: 60780 - DNA, 738 bp, Heterodera glycines
  Genomic contig location: Contig_ID=SeqID_30365; Location=287..1024; Strand=+
  SCN-specific regions: Sequence locations=1-333,355-738
atggacgaggaaatgttggaatttggcgattcgctgccgtcgaaatcagcgacgccaatcggcgatttggtgccgttcccgtcgacacccactgcaccaatggacactggagagatgacaccgccaccagtggccatcgacgagcgatcaccgcgcatcgaacagctggaaaagcaactgaaggaccgggatgacaccattcaatttctgcgcgagcaggtccgaaaccgagaagcgctgatcagtgatctgcgtcgtcagctggagcaatgtgcggcaccaccaacggcgacaccaaccacaagcaaaagtgagtgaaatttcgatgccttctcttttcccaattaattttctcaaaaattgatcattcattttttgtcaattttagcaacgccaaacagaggaagaccaaggaaggccatcgacgaactccaacgcagctcgcgaaaatggttgacggagcagattttggacgccattgatcgggaccgatcgagatcggcaagtcggtgttcactggagcgcatccaccgagaagtccggtacaaatacggccattatacaccaaaaaaggcaccagcgaagaagggcaaagatgaaatggaggccaatgacggcttgcttttgatgacccaacttggcacacaaaaaacttatcagcggatgaaagcaacccttcgtctgatccacaaaaaattcgacattttaccgccattaaaaaaggtgcatttgggttga

SEQ ID NO: 60781 - DNA, 171 bp, Heterodera glycines
  Genomic contig location: Contig_ID=SeqID_30367; Location=41..211; Strand=-
  SCN-specific regions: Sequence locations=1-171
atgatgtcaaatgcaaataatttgaataaactgcagaaaaaagagccgattgaagattgttttgactgcaaagtgacgtttgccactggctccttcttgctcggctcctacatgttttacgacagtttcaagtccacttccaaatcgccaattcttttgcgttcgatcgcc

SEQ ID NO: 60782 - DNA, 930 bp, Heterodera glycines
  Genomic contig location: Contig_ID=SeqID_30368; Location=310..1239; Strand=-
  SCN-specific regions: Sequence locations=1-930
atggactcactttttgatgccggcaaaaacgagggacgaaaaaaggatgagaccaatggagggggagatgggaatatgctgagaaatggacagcggaagagaagccagagaaaagatgaggaacaccaagttgaagcgcaaaatgaaccaaacgccgacaaagccacggtaacggtaaattggggtcctaaaaaggagggaaatggggaaagaacccaaaatcctggagcaaaatgaaagattgataatgaattagggatgggacttccaaaacaaattgaaaagtaaaacattctaattttcagtcatttaatttcatttggccccatcttaaagtgccaccaaaccatgcatttttggctgtcgctttctctttcagtgccaattcgtccgccgtccattccatgggttgggcagactcttcaacgagccggacattcttcgaatcagacgacagtggcatgccactcaggaagtgtgttggtcggttgggagttttgccgaaaagggacggaaggcaaaatgaaattcgatggacggaacgaaaggcattggccaagggaatggccgagacatttggaatgaacagctgtctagcacaaaaatgcatctgaagaatctgataatgtgaaatggattcgtattgtaaactgcatgatttttatgtattttaagggtagttctagagaatacaaaatgagtagtgaactgaacccttttaaaatttaaatataagaaactttttactgacaatgattactttttttaattatataaacataaagccagagtaaaaatttaaatttatttagtaggagaaaaagaacggattaatggatttgtaacttctgtagtgataacgatggtctgaattttaatggttagcgttacaagttgtaacactaaaaaaaattccaaatatgcattaaa

SEQ ID NO: 60783 - DNA, 864 bp, Heterodera glycines
  Genomic contig location: Contig_ID=SeqID_30368; Location=618..1481; Strand=+
  SCN-specific regions: Sequence locations=1-864
cagattcttcagatgcatttttgtgctagacagctgttcattccaaatgtctcggccattcccttggccaatgcctttcgttccgtccatcgaatttcattttgccttccgtcccttttcggcaaaactcccaaccgaccaacacacttcctgagtggcatgccactgtcgtctgattcgaagaatgtccggctcgttgaagagtctgcccaacccatggaatggacggcggacgaattggcactgaaagagaaagcgacagccaaaaatgcatggtttggtggcactttaagatggggccaaatgaaattaaatgactgaaaattagaatgttttacttttcaatttgttttggaagtcccatccctaattcattatcaatctttcattttgctccaggattttgggttctttccccatttccctcctttttaggaccccaatttaccgttaccgtggctttgtcggcgtttggttcattttgcgcttcaacttggtgttcctcatcttttctctggcttctcttccgctgtccatttctcagcatattcccatctccccctccattggtctcatccttttttcgtccctcgtttttgccggcatcaaaaagtgagtccattttcgttttctccaattttccatttttactcccccaccccccgtttcgtcacagatatttcacgcgaattgtcgccgtcatttccgtggacaccgcctcccggtccatctatcgcattggctacccctccgtttttgccacacggcgcagtcgcttcgcccgctttttggacgttcagccgttgtccaccaattcggacagtgtgcgaggcgttgcacgccttcgctttaccgatgggtttg

SEQ ID NO: 60784 - DNA, 1080 bp, Heterodera glycines
  Genomic contig location: Contig_ID=SeqID_6225; Location=257..1336; Strand=+
  SCN-specific regions: Sequence locations=1-11,34-411,443-516,538 -599,628-659,681-698,720-792,814-883,905-912,934-1080
atgaatgtaaataaagaagaggaacgactggaaaagaaagtcaccaaatgggctattatgctaaccagtgaagacaaggtgagcatgggcattcctcagtatgggattttgggtaatacataatactgaaaaattgcggtaaaaaggtaaaacagaaacccataaataattagatggttttgcaaaatataagtcagattcgcaatttagcaattttttttactggatttatttcagagaaagttataacttggaatcgcaattctgcaatactaccgggcccattctgcaatataaccagatattcaaatcgtctccgccgccggggggaaatttgaaaatttgcgtgtaatttgttcacagattttcagcaaaaaaaaggctggtttttgggataataggctcaaattgtaaatggatttctttaaaaaatgataaaatatgtgtcaattaaaaagaagactatgaggaatcatattttctcaataggaaaccaatgagtatacaaaaaggaaattgaaaataaactccaattttcatcaataatttttcactcagacccccattcttaccagtgcttgtttttcccggttgccttgccgggaccgggacctgagcttttcaaaatccggaaccgggacctcgaaaaaccgggaattcccggcctggtcccggtcccgctgcactctagttttttgtatcgttaaagcccagcagaaatattaaaatctatgaacctttgggcttaattttagcacttcgggaaattctttgaaaagaattttctcaaatcagctgaatgaataatgatctttgatcgatttaatagtgtaaaaaacaattttagttatattttggcttatgcaacgccacgttgggaaattgaagaagtaaaagcccattttcaaactaattcttcttttgttgttatttcagaacggaagaaacacaaatcaacattttgtgctataattagggctatacattgtatttttgtgattggatcccggaaaatgcgtcagtaatacagtattttacgtaacaaatacatatataaaaattctttctgaatttttttca

SEQ ID NO: 60785 - DNA, 795 bp, Heterodera glycines
  Genomic contig location: Contig_ID=SeqID_30372; Location=718..1512; Strand=-
  SCN-specific regions: Sequence locations=1-795
atggatgtgccttcaaaacaggaaagtaccaattttgtcattcagttggatgacgaggatgacaaaaaggcggacgatgagaaggaagtggagccgaaggaagtgtatcgacgacttatcgaattgctaaacgaaaaagagacaattggcgctgcgctgaagagactgaacaacgaaaaaagtgagtgatcggagggttggggatttttaggacaatttcacagcattggataatactgttgaatttaacacaagcatttttctagacttaaaatctatttttaagagtcaaacgcagcggaggagcgcaaacgccgttgggcggccaaaaagtcgggtgcgaatgtgcaggaggatgagaagaccaagcaaatcgcggaactaacctcgttggccgactcactgatttcacttggcaacatggaagcctatcagttggaccaggtgggaaaagcggacaaattggcacataataagccgacctttcgttgtttgttgaattccctgcgtttttcggctacccgacttttggggatcccgcccgacatagggaccggatatttgggcaccgactgactgtctccaaatgccgaatcctcaattgcccaaaaagtcgggtccccaagttgcaaattcccaaaagacgtcacggttttttcagaacagcatcaacgctttgttggacgacttgcaagcgaaaaacaaaattccgggcgcaaaagaagcgactttggatatgttttcggaggggtgaaggagaactgaattttaattgaatttggacctttgaataaa

SEQ ID NO: 60786 - DNA, 117 bp, Heterodera glycines
  Genomic contig location: Contig_ID=SeqID_30375; Location=149..265; Strand=-
  SCN-specific regions: Sequence locations=1-117
gacaaaattggcaacttcgaagcgacggtgtacaactacaagggccttagctttgaaaccaccacacggacgaatctggatgggccgacaaagcgcaactgggagaagtacattaag

SEQ ID NO: 60787 - DNA, 140 bp, Heterodera glycines
  Genomic contig location: Contig_ID=SeqID_30376; Location=410..549; Strand=-
  SCN-specific regions: Sequence locations=1-140
ttccaataaagcgactggattcgccgcctatgcccgtttttccaccagcgatgggccgccgtccggcagcagtgcccctcacaacaatcagttggcatcgccaaagccaagtgcggacaaaatggccgagatgggcaatg

SEQ ID NO: 60788 - DNA, 165 bp, Heterodera glycines
  Genomic contig location: Contig_ID=SeqID_30377; Location=1180..1344; Strand=+
  SCN-specific regions: Sequence locations=1-165
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaact

SEQ ID NO: 60789 - DNA, 499 bp, Heterodera glycines
  Genomic contig location: Contig_ID=SeqID_30379; Location=235..733; Strand=+
  SCN-specific regions: Sequence locations=1-107,134-263,292-499
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaa

SEQ ID NO: 60790 - DNA, 882 bp, Heterodera glycines
  Genomic contig location: Contig_ID=SeqID_30379; Location=423..1304; Strand=-
  SCN-specific regions: Sequence locations=1-779,808-882
ataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaaggacacttgaaaaaatcgattttttgttttcggggcattccccccgaaccgatgcgcccagatttatggggagaccgaatccctcgggaatagcttccctatagcctgtactttaattctgcgttggatttttgctccccataattgtttgagtaccccaaacggacacttgaaaaaatcgattttttgttttcggggcattccccccgaaccgattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaat

SEQ ID NO: 60791 - DNA, 1438 bp, Heterodera glycines
  misc_feature (1060)..(1060): n is a, c, g, or t
  Genomic contig location: Contig_ID=SeqID_6226; Location=1019..2456; Strand=-
  SCN-specific regions: Sequence locations=1-1438
aaccccggcgagggcttcaatttgcgaagggatgtctatttgagagtggccaacacagtacggcagctcagagagaaaggtgaaactgaatgaagtggagggaatgaattcgacaattaaattggaaggcttcgactttgttcttgtgctgccgccttggggaaactgttggcattggcgcacaaagccgcggcagacgaaaatccgttggtctgaactgttcgacttggacagtctgtcggactttgtgccggtcatagagttcgacgagttcctcgaaggtggacaaaaggaccgcctccccgggagtcattttcaacattagctcagggcacttccgtcagcactgttttgtatttgcagcattacgcggagggatgggccgaaggcggcgaatacactctcaaatacgacattcgcccgtgcattgaggcggacaaatattacgctaaaaggggcgacaaatggtgggaaaacgaagagaaagtgacacatttgccaaggataaacaaaaaaggaaatcacaggaacggccatttcttcgattacgctgaccatttccatgcgaaggatttgcaatgtctgtccatccagggacagtcgagcacactcgcagaagcaattgcacaattattccccgaggggttggcgaagtgtaaaagtgcggcggaatttgcctcctcaattttaagtcgttctttgatggtcgaccgtgccgaaacgattctgcacgaccaattcggcgaccatttcttttggaaggcgcggaaatcaatgcgatacgccaaaagacttcgttcgattggcgacactttccgcgccgaccaattggccaatacgtccgactatttgtgcgctcatttgcgacgggccgactttgtgtgggcccatcgcgaggaaattccgtcaattgaaggcgccgcggcacaggtcgaaagcaagcgatggcactttggattgtcagcaaaaaacaatgccccttctaagattgcgcaaaatgcgtcgaaattggacatcagcgacgttttccttagcaccgacgcgaccccctcagaagtcngaaacattggcgaatcttttggcgaaacaaaatgtccgaatggtaaaattttctgatgaaaatgagcaaatggaactgtcgggagcggccatttcgataatcgaccaagtcggacacattccgtgtttacaattaacccattaatccccaaaaatttcagtggatttgcgcaaattcaaggcaaattacccatgccattttctgtgacatccgtaaataaatgacaggtttttcatcggcactcatttgtccaccttttccttccgtattcacgaggaccgcgaaatactcggccacgacgcacggacaaccttcaaccgtttctgtcctgacaacgtctcggactgtgaacagccggccaaatggacaattgtaaat

SEQ ID NO: 60792 - DNA, 1095 bp, Heterodera glycines
  Genomic contig location: Contig_ID=SeqID_6226; Location=4969..6063; Strand=+
  SCN-specific regions: Sequence locations=1-127,149-315,337-394,507 -1095
atgcacaatcgcctctgttctgccgaaaaagcatccgttaaacgcgacggtcaccgaaaaagcgtcgatttgacttcgaatgcgagtacggcgctggtaaagtgtcattattttctcgttttaatttgcctatttccccagaattctcacatccttctgaatggcaataacgatccgaaatgggtggtcatggtcaattctctcgactcattggacccggagactcgcaaaaagacgagtgttccccgttactattcacagcagcagcacacgcgactgcaagggatgttcagaagcgcaacactcagtccgaacggaaggggagagttggaaaagacagcacacgacggccgttgcccgcgttatttattcgcacgaccaccgctaaatggggaggaaacgacgaagaataaaaagaaaagggtagaagaaaagccaaaagggaaggagaaacaatcgaagaaagaggcgaaaacggacgaaaagggaaaaaacaaaggcaaagacgaattggacgtattcgccgcattgggcacactgcaaaagtcactggtgaccagagacttgatgagccgattctgtggacaacaggtgagagaaaaagagcggaattggcatttgttgctcattttatcgataaatgccatcaaattttgccatttaagcgttcgtcattggtggcgccctccgaagaagcgattgtcagtcattcgacaaaagcggacaaatctatggacaatggctaccccctccgcggcacaaattcctttttgccacaatcgccgtccgttgggccacggtcgactgcaacgccattaacaaattcgtcgggcagcagcgaaagcgacagctcatcgttgggccggtttcgaagaggtcgtcgacaaaaaatacaacttttgttcagtttcattagtcttttaggactgtccattggcccggcatttcccggtatttctgattccgtcgaagacccctcgctggccgagaaaattacacggaattacgaaagtatcttcctaaagacattggagcaggtgaacatcactcgccgttgctctgagacaccgtcggcatcctctccggtaattgcaa

SEQ ID NO: 60793 - DNA, 928 bp, Heterodera glycines
  Genomic contig location: Contig_ID=SeqID_6226; Location=3986..4913; Strand=+
  SCN-specific regions: Sequence locations=1-928
atgtcaagacccattctcgacgaattaactagggcgctttttgcgcatctccgagggggaaatgcgtgctttgatgaagtaagccaaaagggttggagaaaccctccgacccaacggacggtcggaccgtccggggcatttcatgacggatttgctgggcgagtgatgtcggtgtgggcatgcgaaacgaactgaaaatgcacttttgcaggaaaacgaactcattgaactcttccgacggtgtccccgctgctcgcgcagtcttcgcccgatcattttggacaaatttaccgacgaaaaagatggccaacagtacgagcgaatgtggtggacatgtccgggcatagagcagaaggtaggcatatccatttttgaaattagcttttatcattttgtccactatttgtttctttaggagtgtttcttccccctggacatccccaaggaggtgttctggactcgtcgctccatggatcagtcccttcgtggcattctccctttgcccaacctccatttgttgcccctctctttgcgcgccctttaccacaaactcttcaaaagcaaggtcaacattgagaaaattgtgcgcatttccgccttcgttccgtcggatggacagaagagtgccgtacaacaagcaaattttggtgccgaagaacagccaaaacggcaagaaagtgctcaaattgtgcaggtaaaatctggaaatttctccaatcatttccattttccgaatggtttcccttttcagcgttccgtcggttctgtcggcccttcgcttccgagcactttcccgccacttcctgcctcttctgttcgacatttgccaacccctccctcagttcgttctcacaatcagtgcgcctccctttgtgacggctttccatcgtcgtcaaagcgttgcgaccaacgaacggtgcattcgtag

SEQ ID NO: 60794 - DNA, 1152 bp, Heterodera glycines
  misc_feature (1115)..(1115): n is a, c, g, or t
  Genomic contig location: Contig_ID=SeqID_6227; Location=1..1152; Strand=-
  SCN-specific regions: Sequence locations=1-233,255-877,900-1081,1103 -1152
  Gene Ontology: Mol. function=polypeptide N -acetylgalactosaminyltransferase activity; Cellular component =integral to membrane; Biological process=O-linked glycosylation
atagccattggtgaggtatttaagtttgaaagcattgccttggaatgccattctctgttctgtcagtgcaccgttggatggttggagcctttgttggcgcgaattggcgaggagaaaagggcggtggcatgtccaatcattgacgtgatcaacgaccgaacctttgcctatcaggtgggaactgatcaaaccaaagaacgaagagaacggaacttcagaagggcatcgaactgttcagaggcggattcaattggaacttgcaattccgttggtaagtgacaaagttcagaaatggcactttgatggccaatcggatggaattccctccccccccccccccggtgccaaaggtattccgtgccattggacattgcgcgcgcacggagtgccgtcccaacagcgccaatcaggtgagcatggcattagcaccttaattactccgccactgcactgctcgcgcagttcgcccacaatggctggcggtctgttcagcatcgaccgggcctatttcgagcagttgggcacttacgatccgggcatggacatttggggcggtgaaaacatcgaaatgtctttacgggtccgttttgtggggaatgaatgccacggcatttttgcgtgcttttcgctccaaaggtttggcagtgcggcggtcgagtagagatcgtcccatgctcccacgttggccacgtgttccgcaaggcgtcgccacatgactttccctccggcagttcgtccaacagagttttaaatgcgaatttggcacgactgagtgaagtttggatggacgaatggaggtaaagcgagccaaaaggaaggccaaaaccacccaaaccattgcaggcatttcttctataaagtggcgccccgtaagtcgcaaaatcccccaaaaaagcactaatttcccgaacagaagcacggatggctgtcaactcgcaggatgtcagtgaaagcggggcaattagcaaaatggcactaattaaaataatgacaaagtgaaggtcagtgaacgcgtggaattgcgccgtcggttgggctgtcgtccgttcgcatgggtaaagggacagaaacaactcaacaaaaacacccattcatcaacatcgaacagtacctgnagcacgtgtggcccgaacattttctgcaacaccggat

SEQ ID NO: 60795 - DNA, 682 bp, Heterodera glycines
  Genomic contig location: Contig_ID=SeqID_30383; Location=187..868; Strand=-
  SCN-specific regions: Sequence locations=1-31,56-278,302-417,441 -466,497-511,543-635,657-682
tttcaattgaccaatttggagcaattctggaaaaaatagacaaattggagcagcaaaagcaggacgaaaagaacacaaagcgtaagaaaatgaagaaaaaataagaaaataaaaactaattttgtatgtttaagcattggttgtccaaattgaacagttgcaaaatgatcagaaggcacttttgggacgaatcgcacaattggagaagctggaacccaatcgaaaaggtaatagtcatgactaattaccctaaatcatgctaattgacttgctaatttaagtgtattttcaatttgtataatatatattcccaattgagaacactagtatatattttcattggtcataaaaatctattttcacttacaaatttggggagtgaaatatttttctgtattttttgtttttcattttaccattttttaaaatttaaattttatgatgggctaaattttggttgaatatgaaatttttatattaatttatctaaatttaagaaagtttttcgtcgatatttattattttttaaactttttataaatcagttttcacagaaatggacaatggtgcacaaattgagagaacatttgagacaaacgctgattataaccagcagcagaaggtgaaaatagtattatttgattgttgttttttagttcttaaccataaaatgcttcattga

SEQ ID NO: 60796 - DNA, 56 bp, Heterodera glycines; identical to SEQ ID NO: 52733
  Genomic contig location: Contig_ID=SeqID_30384; Location=766..821; Strand=+
  SCN-specific regions: Sequence locations=1-56

SEQ ID NO: 60797 - DNA, 674 bp, Heterodera glycines
  Genomic contig location: Contig_ID=SeqID_30385; Location=813..1486; Strand=-
  SCN-specific regions: Sequence locations=1-495,517-630,653-674
  Gene Ontology: Mol. function=tubulin binding; Cellular component =microtubule associated complex; Biological process=cell cycle
gttggatattgccaaggctctgccttcatcgtcggccaattgcttctccaaatgcctgaggaggaggcattcgccgtgttcatgcgtctgatggagacgtatcggcttcgggagctatacaagccgacaatgaccgagttgggcttgtgcatgtttcaactggaagtgatcgtgcaggagcaaatgccagatttgcacatgcatttgtacgttgttctgccggtgtcaattagtctgataaattggttcagcaacaacatgggctttgacacctccatgtacgcctcctcatggtttctcactgttttcctcaccaccgtctcgttggagctcgccaatcgcatcatggattggtttttggtcgacggaattgacgctgtttttcgcattgccatttccattctccaacaatcgcggatcgacttgcttcagttggacatggaagggatgctaaaggtgtacgactacgccattcctttcgaattgccaatattcttttttccgttttaagtatttccaaagggaagtccgggaaaggtacgaaaatgaccacgaactgctctttgccatcgcgtcaaaagtgcatttgaacgtgaaaagaatgaaacggctcgagaaggaatacatgacgaagaagacgaaggagcaggaggaagcaatcgaactcagggcaa

SEQ ID NO: 60798 - DNA, 660 bp, Heterodera glycines
  Genomic contig location: Contig_ID=SeqID_30386; Location=296..955; Strand=-
  SCN-specific regions: Sequence locations=1-312,343-532,570-660
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 60799 - DNA, 262 bp, Heterodera glycines
  Genomic contig location: Contig_ID=SeqID_30386; Location=1144..1405; Strand=+
  SCN-specific regions: Sequence locations=1-262
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctataggga

SEQ ID NO: 60800 - DNA, 112 bp, Heterodera glycines
  Genomic contig location: Contig_ID=SeqID_30387; Location=8..119; Strand=-
  SCN-specific regions: Sequence locations=1-112
atgctgatcagatcaattttttacgaaatttctgatcgggtgatctttgatccttcatactttagaaagtacgtgttctacaaagctgccacatggctgtcccttttgtctg

SEQ ID NO: 60801 - DNA, 399 bp, Heterodera glycines
  Genomic contig location: Contig_ID=SeqID_30387; Location=177..575; Strand=+
  SCN-specific regions: Sequence locations=1-248,272-336,359-399
atggcaaatagtgtggcggctgctgccacaatgatcagcactgcggcagttcggacaaatactgtacaaattggagatgggggaaatttgaatttggcacatcacaaagccaaacgtgtgttccgtgccggcggctgacattggccctcgggcgccgcgtttggcaccgggttggacagtgcaccgacagaccgatcagtgcattcttggaacaagcctgttgtgattggaaattataattttgtagaataacctgttttaatttttttgtaaaaaaaatttctagggatgggattttgcagcagtcactgtctcagattttaaagtcattcccaaaaaattaaataattttttgttttgctaaaaacctccccaaatgtgggataatatggaaaaaaa

SEQ ID NO: 60802 - DNA, 170 bp, Heterodera glycines
  Genomic contig location: Contig_ID=SeqID_30387; Location=975..1144; Strand=+
  SCN-specific regions: Sequence locations=1-58,99-110,132-170
atgacaagcagaaaaagggacaaacagaggcaaaccagtgaaatcacctttaaaatggaggaaaaagcatatatttggaggaatgggtaagtaatgaattaattagtcaattcattataatatttaattcttagggtgttaattgtataaaaaaaattttttaatggaca

SEQ ID NO: 60803 - DNA, 401 bp, Heterodera glycines
  Genomic contig location: Contig_ID=SeqID_30388; Location=1..401; Strand=-
  SCN-specific regions: Sequence locations=1-20,89-107,155-172,379-401
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaagg

SEQ ID NO: 60804 - DNA, 90 bp, Heterodera glycines
  Genomic contig location: Contig_ID=SeqID_30391; Location=363..452; Strand=-
  SCN-specific regions: Sequence locations=1-90
actagcggggtcagcgccttcggcgcatcccccgctaggtagtacgattgtagtgtaagattatgtttgataaaatcgactggctcggcc

SEQ ID NO: 60805 - DNA, 115 bp, Heterodera glycines
  Genomic contig location: Contig_ID=SeqID_6228; Location=1148..1262; Strand=+
  SCN-specific regions: Sequence locations=1-69,91-115
atggatattcgatctgaccagcaccggtatcctttttgcattgtttggacgccaatccccctcatcagttggttatttccctttattggacacattggtattgcaactagcaaag

SEQ ID NO: 60806 - DNA, 925 bp, Heterodera glycines
  Genomic contig location: Contig_ID=SeqID_6229; Location=1..925; Strand=+
  SCN-specific regions: Sequence locations=1-33,56-925
  Gene Ontology: Biological process=mRNA splicing
taagcagcgtgaaatttcccttcggaatctgcaaattcctaccattgaaaatctcggagttaccagggtaagacagaaatgctgttgttatatataaagtttaattaataggatcaatttgatgtcattgatttgactgacaataatattcgaaaattggacaatttgccgagattgaaacgtttggaaactctgcttttgcacaacaatcgtgtcgactttatttcaaaggaaatcggagatcaattgacgaaattgtccacccttgtgttgactaacaataacctggcacaacttggtgatattgacgttttggcctcctgccctcgtttggaatatttgaggtgccatttttcgtatgtttgttaattattcaatttttcagtctccaagggaaccctttgacccatttgcccaaatatcgtcagtacgtcatttataaactgaagaatgttcgggtcctcgattataaacgcattcgccttgcggtcagtcattttttggcggggagcgatgtttttcgtttgtttaatcggacagatactacacttaatccccccttaggaacgccaagcagcgaagaaactctttaaaggtgaaagcggtgcgcggctgaagagcgaattggtaaagcgttcgcagcaaatttcggaaggaggcgaagagacggaacagccgccgaaaaagcgcgcgacggaagagcagaaaaaaatcagagtgagttgccaatgagcacagcagcagtacacctagcaaagtgacaagaaaagtaaagtaatattggccatgtcaggaactgatctccggtgctaaaacacttgtggacgttgaacgagtccaacaaatactccaaagtggcgaagccaacgggacagaggagcagcagaacggccaaaatgggacagacgtacacatggaggagcag

SEQ ID NO: 60807 - DNA, 396 bp, Heterodera glycines
  Genomic contig location: Contig_ID=SeqID_6229; Location=1648..2043; Strand=+
  SCN-specific regions: Sequence locations=1-104,126-134,156-396
atggaagtggtgcacagacggaatttgatcgaacgtttggataaactgaaggcatcgcacgaagccttcttcacagttccgcaggtcattcggagagactcgattttttgaattgaattttttaagcttaaagccgtctcaaataatcaattgtctctttttctgcgtcggctgctaaagtcagcggacatcaaacagcacatttcaacagaacttttggaaaggattcttttgattgaagaatcgaatgaaaatgcatcagacacagcaaaaatggcattccgaacggagggcgaattgggccaatttgcagatcgactgacatacattgggaagtccgagacacatctgaatttaaatcaacaaactgacgaggaggacgaactaacggacgaa

SEQ ID NO: 60808 - DNA, 1374 bp, Heterodera glycines
  Genomic contig location: Contig_ID=SeqID_6230; Location=55..1428; Strand=+
  SCN-specific regions: Sequence locations=1-456,478-491,514-687,714 -716,756-766,788-942,964-1374
atgaccaacgaaattgatcaagaaaggtgtttaactgggtaaaatcgagatggcggaaggacagtgcgttttcggagcagccaatgcaaaacgacgaccaattgggggaggggcagcggccaacggagaatagtgcgcggtgccgagcatttctcagtgggccacgacgtgccgtcatacggcgcgattttgacaggtgaacgaagcgatttgatcattgaattgaacagtttttgacatttaacgaattttagttcgctgaaaaaacagcgcaaaagtcggcccataataccaaacaaacggtgcagcacggaacagtacgccttcgcggactgttcgattcactcggaattgtcacttccttccggtgcgctcatttgtttgattattaattaatagggctgtttatataatacatattttttcctggattctccatgctctgaataataggaaaaacatttcttttttgtgtttgcgaacaaaagtgtggggacatttatttacatatatttacatatttctattttctaattatttcggaatttgctacatattttcaactttttcctacatttttgcactttttgaggattttaaattcttatcaaatgccccaagatttcacaaatttttcgtatataccctacacatcgaaaatttttgagaaatttgtagaattgcttgttaaaaattaaaaataattttttattcaaaaaaggagatatcaaaaattaatttgtaaaatataaaaagggatctaagcctatttaattttatggcattttgtgcctatttcaccgtttacaggatttttttccaaaaatataaatataattcagccgtaccattggatgctcaaattatgaaatatttgcatgtcgccgatttcatcccagtggaaattgaaatgagaaggttctaattatatatgaaaacgcccttttaagaatcatgcaaaaacagagcgattgattctctaaacctgacaaacgcttcggtttctgcccaattcttatttttccctcttttaggtttaaaacctaccaaacggcgttgaaaagtcaagaacaactaaatgagctgaagcatgcattttacaatttggaggaggactttcatgaagacgacgacagatttggcactaccgaagctaagggcatcaaaatttcgctgccattccgtaaaatgttaaagaagcgaagtgttattgtggaccaaaataccgagcaaactgacaccgaaagcgacccggaagattatgaatatgatgccgacccatcctcgccacgggaaatgtgcaaattcaaacgacgacggatgacatactcttcaggaacagcgaagccacccaaagtgactaaatcgaaataa

SEQ ID NO: 60809 - DNA, 1621 bp, Heterodera glycines
  misc_feature (1577)..(1577): n is a, c, g, or t
  misc_feature (1579)..(1579): n is a, c, g, or t
  misc_feature (1596)..(1596): n is a, c, g, or t
  misc_feature (1601)..(1601): n is a, c, g, or t
  misc_feature (1609)..(1609): n is a, c, g, or t
  misc_feature (1611)..(1611): n is a, c, g, or t
  misc_feature (1613)..(1613): n is a, c, g, or t
  Genomic contig location: Contig_ID=SeqID_30397; Location=94..1714; Strand=+
  SCN-specific regions: Sequence locations=1-349,602-681,704-846,869 -1394,1417-1447,1470-1621
atgaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaataagctggggcagagcggggacggggatgaaaataagaaaatgcttttattatctgaaccgattactatgaaaattacatgcgttacaatgcccagtggagaggggccgaggaatgtccacaaatttgactttggattcaaggaacattagcggatagggtaagtgttttaataaaataaaattaaaatagaaaaaaatcaataaataaatttaaaataattatttctaaaaaatttaatgaagcaaaaaaaaaattttttttaaagaaaaaaaatgaaaaaataataatttaatgaaacaaaaaaaaacagaataaaatttaaaataaagaaagtaaaaaataaatttaaaataattattttaaaaaattttaatgaaagaaaaaaaaacttaaaatatttatttttaaataatttaattaggcaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtggaattgatggaaacgaaattagttatggtgtggagcaattgccgaatgttcagaaatattgggtgggttaaatgaaaaaatgcaaaattaataaatttttcaggatgagatttaccccggaaagtaccgggttgttgcgtttgagaagtctgcagatccgcgaaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtggggggaatgccatgtgaaaaggagagtggagtgaagattgaatgcccaaagtgtcaccgttacttttacaattgggagtgttataattatcatcagggacatcagacttgcaaattatggaggcgttgcgtgatctgtgacaagacatatttatttaacccgaagaaggaacatgaatgtggtgagacttattgccagctttgtagtgtgagccatgaccccaagcgggggtgttatattatgccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggagaaatttacttttacacaatactntnataacaaaaacaccacnaattncaaaatcncncncgaggaga

SEQ ID NO: 60810 - DNA, 260 bp, Heterodera glycines
  Genomic contig location: Contig_ID=SeqID_30398; Location=1167..1426; Strand=-
  SCN-specific regions: Sequence locations=1-260
caatttcgccgtgccaccaatgccgccagctacaaaattcagtttactgctcatgcgccgtcaacgtcaaccatggtgccatttgaattggtgaatgaaagaacccgggaaaagctgacattcaccaaagcaggatacgaccgatggataattaaacgatgccaaattggggagacgacgacggcacaatggacggacgaaaattcgatcaacaatttgaacaatgtcagcattaatttgagcggtgtcaattgcatatg

SEQ ID NO: 60811 - DNA, 691 bp, Heterodera glycines
  Genomic contig location: Contig_ID=SeqID_30398; Location=1..691; Strand=-
  SCN-specific regions: Sequence locations=1-128,152-164,193-238,260 -516,539-544,647-659,682-691
ttttctcgaaacggatcgttaccaattgtatggatttggtgccgttgttgatttgttgaatggcaccaattgggagcaaagtggcattttcccacgtgtttcgctctgcgattttcaggtgcataatcatttatttatttttaaatttatacacacagagatgctaaatatatattcttatttataaaatttgtccttatttggcgggtatttgtttgcaccattttcctttttttagtgttggcagacataaaatttcaacaaaatttttttttggcaatttatttttaagaattttcccgacaatgtctgtcgaacccatcgtctccataatttcttttaaaattgaccaaaagttttgacaaaatttgaaaccttttgtccgtatttcggagaaagacttggtataatatgttttaaaaaggctaatgaataaaagcacaggtccgcgtaatgggaaatcttcaagaatataccattcaatgtgttctcatcatcaacatattcaatgaaaaaatttttgttctgctttggttttggtcagaaattattattattttctaataattaattcatttttaaatgtttttgcttcatctttttaattttatattttaaaaatattaaaatgtaaacatatttaatacttagaagattgtttaatgaattttatttgaatggcttatttttc

SEQ ID NO: 60812 - DNA, 2074 bp, Heterodera glycines
  Genomic contig location: Contig_ID=SeqID_6232; Location=114..2187; Strand=+
  SCN-specific regions: Sequence locations=41-814,845-883,905-972,1002 -1487,1509-1596,1619-1774,1797-1971,1994-2074
aaaaataaaattttaacaaaactttattataatttaaaatctccggcaagttttgcggggattcaaaaaattttaaacgaagcgaaaaagattgacccagacataacgaccgatgacgtaaataaattcctagaaaaacagagaacttacacgattcacaagccaatcaggaaaagattccctagactaaagacaataccgagtggcttccacaccgattggcagtgtgatttatgcatatttgatcaattgaaaaaacataacgacggttacaagtatttattggtctgcatcgacgtgctgagtcgaatgatctttagtgcaccagccaagtcaaagaagagtgaggacattatcgaggcttttgatcgggttttcgaaaagtcgaaaattatcccgatgaagatatatagtgacagcggactcgaatttcaggcgggaaaaatgaaaaattattttgagggaaaattcatcatcaaaaatgtaatgtatagccccgacctccacgccggcgttgttgaaagggcaaatcgaacaataaaagagcgcttgtacagatactttacaaaaatggacactctacgatgggtcgatgtaatagataaaataattacaaacattaacaacagtgtaaataggacactggggatcaagccaacttcaattacttttgaaaatgcaggaattatttgggaaagattatttggaaatatagaaactcaaaaaaataataaattcaaaattggtgatttggtccgaattacaaaagaaaagggtatatttgcaaagggttatcttccgaattttacggaagaaatttttaaaatttataaaataattaaatcagacccaatcgcttatagaattgaagatttaaatggagataacattaagggaatattttatgatgccgagttggtaagagtttcgaaaaatcaaataaataaaatataaaagaactttgacaaaagcaaaaaataaataatgaataaaataattttcttcgtagtttttggtttggcaatcggccaaataaatagtgattgttgttgcctatctaatgaagagaaacaacaattaaattctgctagaaaaactattgaaaaatgttttcgggatacattccgattaaatactgaagcccgagattttgctgctgcttctcatagggcaattacggaagcagaaaaaattaaagttcgtcatcctgaggcaccgggtatgaaaacgtggttcggtaggttattagaaggggtgagaaaagtacaaggaatttccgaaaaaattaacgaagaaaggcagaaaataggccacattagaaaagaaatggataagtgtttggaccgaaaagatgttttaatgtgtcgtgaattggcagacgaagcgaagggagcattagaaattgttaagcagtatagacaggacgtcggtactgcgtaccgtaacgcctatactcaatctgacctcgggattggggaattggccgataaagtaaagaaaacaatgaaggaatatttatcccgccccggaccttccccaagaccaacatttaaagaccaatttatatctgattaatgtataaaagagaatggaaagataataataaatttttaaaaatgattcaaagaacagaaaaaggaacagcaattttgttggaagcgctcaaaaaagaggctgaaagggcatggaaggaagtttcggtattggcagaggaagccgatgattttgccaaatcttcacatggagcccttaatcgggcaattaaatctcgagaaaaggccccctatgccccaggggttcgagaatggttcgtaaaaatgtcagattgtatctgggaaatttacaccattctggataaaattaatgcagagtctgaaagggttgagaccatgtggtttgagattgaacgttctaaagatttcgatcagaccacaaaacttgaggagaaagtatttaagagtttaaacgaaaccaagaagttgcatttcgagtcccgtcggattcatactaaaatattggagcaagaaagcagaattcagtctatagtgttgggatttattgagcttcacgagta

SEQ ID NO: 60813 - DNA, 1435 bp, Heterodera glycines
  Genomic contig location: Contig_ID=SeqID_6233; Location=277..1711; Strand=-
  SCN-specific regions: Sequence locations=1-1435
aggcttttccgcccgacttttctgagtgctccaatcagcatcacttcgccaacgcacaaatgcgtccgttcgatttgaccaacaaagatggtcagtgccaaaattggaatcgtagaattatttaaatccaaaaatggttagataaatgctggacattttgtccttttttaggtttgtccaacgcttacacggacaatttgttcagattctcagcacgcccaagttgcagttttgaagtgattgcatttggatcggcatttttccagacatttctcttggcattttcctaactttccccaacatttacttcggcaattccttggcatttcctcaacttttccttggcatttccttcctttgcatttttctcaacatttcttttaggatgactgcggttctccgtttttattctgcgaccgaagggacgccgaaactccgcattgcgtgtcaaaggtggaaaggacacaacaaattaatgtcattaagggcattactctcgaaataattaatgtttgtaatgataatttttcccagataagaatcggcggaaattgtcaaggatttgaggggatcgactgctgctgggagggcgagtgccaaaattggcgttgcgtcgcccgccaaattcaattgtcgaaaagggtatcccattgattagtgataatttcgatcactttgactcctgcttttcagcctccacaggcgatgtcccttcagcacagcaacggcgaatcgtttgccgaacttctccaaaatgcgattggttcgatgcctcagatacaaacgcggcgagtcgaggcaattttgaaattggcgaattaatcgaaatgattggcatttcgcgcaaaaggcgttcaattcgacagaagcgacgacgacaatggcaaagggagcagagaatggcacaaactcacaatcagtagcaataattggccacagcaacgactgtttcaacgacgacccgtgctgttcggcatgggcaaaactcagcgaatgctcggccaacccggcatttatgcacagatattgccgcagagcgtgccatcaatgcgaagcgcaaacggcgcacaaaggtcggaccgaatttgtgaagctttcattttgtttcgtcttaaggatgcactgatcggcacatttcctgcggctattggcggtccgccggcgaatgttcgcgaagacgccaatggatggcggagaattgtcggcagagctgtggctggtcagtgttcatcttttggccctgtttggcatttctttttcctttttgtccatttttataatccgaaccatttcctaaaggtgccaaatcagccaacaacaattgtgtgcatcagtggcaagaatgagtcggatgtgagaagcctttttgtccttttgtctttggtcggccgatagtaagcgaaaagttgaaaaatttcaaaacggcagacaacag

SEQ ID NO: 60814 - DNA, 58 bp, Heterodera glycines
  Genomic contig location: Contig_ID=SeqID_30404; Location=208..265; Strand=+
  SCN-specific regions: Sequence locations=1-8,36-58
tgccctatcgggaccgggacctgagcttttcaaaatccgggaccgggaaccgggaccg

SEQ ID NO: 60815 - DNA, 580 bp, Heterodera glycines
  Genomic contig location: Contig_ID=SeqID_30405; Location=284..863; Strand=-
  SCN-specific regions: Sequence locations=1-333,356-580
atgtcaaacggagcggcggagagattcgtcgacatcttcaaaagggctatgaaaaagtcccgaaaagaaggaaaggagtgggcagagaaagcacttttggcatatcggacaacgccaagtgcggcccttgatggacattcgcccgacgaattgtttcttggacgacgactccgaacgaaactctcactcattcatccgccaaatcaaaaatcaaaactaattgatttggaaaattttcaaaattcaaagaaaatttacatccgaaaaatggaacaccaattcaattccaaacacggaacaaaaacgacgaatttccaagcggaagaacccgtctatttttggaattttaaggacaacaaaagtgtttggctgccaggaaaagtgatcgaaagagtcgagaattctccgacctatcgaatttttgcaccatctcttggccgagcagtacaccaacacgccaaccaactccgtcgccgttttcccgtcgaattgaattttgaaaatgatcagtcgaaaaatcccgcaaaaccgggtatattcgactctgagaaggaagtcagcttaagaagggaggtgttag

SEQ ID NO: 60816 - DNA, 570 bp, Heterodera glycines
  Genomic contig location: Contig_ID=SeqID_30406; Location=505..1074; Strand=-
  SCN-specific regions: Sequence locations=1-286,310-335,366-378,400-570
atgtatattattgtgtttttattatctacattaaatatttcgataagttttgcgcggatttcaggaactattggaccgattcaaaccaaaatttacgtggatggggaaaattatgaaaacaggtaaaaaaatgaataattcatctatacaattttttttttgtatatcatattttagtaattttcaaattttgattacgtagctgagataaaaaaatgcttaaattgcattgtgttccaataaaaaaaaaatttcttggattagccgagtgaaatttcacatattacataaaatttaaaaagaatttttgaagtttagcgcagtgaacgtattacggtttcatgaaatttttaaaaattggctttctgctgattgttgtataataattaaaataattatcttttaagcaaagcgaatttggatcgatttccttttctaaaagatgcgacaaaggaggcaaaaaaagaattcgagaaaatttcgaacaacaaaagtctgacaaagtttgaattggaagcggcacgaatggagtgggcgaagaagcaaacgaagacaattaaggcaaattaa

SEQ ID NO: 60817 - DNA, 590 bp, Heterodera glycines
  Genomic contig location: Contig_ID=SeqID_30410; Location=590..1179; Strand=-
  SCN-specific regions: Sequence locations=1-129,158-165,187-590
atgattatctcaattaagagcgcaatttctgcgctgccatttgagccggaaaatggcaaaaagcttaatcattttccaattccgtactatcgccagtttcaaccaccatatgattcgccaagtcgtaacaattaaatgaaataaattaattttaaaactaaatgtatgataattctctcagctttgatccctccattttttggtgatgattataattccttcgataagaatatttggtgcaaaaattgtacaaacctaagaaaatgacaaatttaatgctttttttttgtacaggaatatcccaaaatcgtggtctgtttttggctatggcaaatggaaatgctaatggcgacagcgttgggaaagaagaaaacgagcgcggatttttaccaaaacggcttaggcctccaccacggtttccgagaccacgcccgacgagaccacggccaacacagccaccacgcccagtgcctatgacgaatgcttatacaccggcaccgtcgccagtgccgcacccaactcaggcaaaccatggcgattacccagcgggtccaccatataatccgcattggaaaaatcaatgcaattaa

SEQ ID NO: 60818 - DNA, 59 bp, Heterodera glycines
  Genomic contig location: Contig_ID=SeqID_30411; Location=1075..1133; Strand=-
  SCN-specific regions: Sequence locations=1-59
cctccgttagatccatccatggccgtaatgatgatgtgggtcgggtccacccggtgaca

SEQ ID NO: 60819 - DNA, 3033 bp, Heterodera glycines
  Genomic contig location: Contig_ID=SeqID_6234; Location=777..3809; Strand=+
  SCN-specific regions: Sequence locations=1-544,602-763,792-823,898 -900,923-933,955-975,1001-1013,1035-1049,1071-1292,1315-1345,1381 -1590,1648-1661,1709-1783,1959-2013,2037-2075,2182-2188,2211 -2274,2332-2364,2387-2426,...
  SCN-specific regions: Sequence locations=...2448-2453,2489-2514,2551 -2565,2587-2697,2746-2781,2817-2895,2973-2999
acgcaaagccagtgtattgcaggcctcgtccggtaccatacaacaccaagttggttgttgacgctgaattggaccgacttttggctgcaaatgtcttccgtcctgttgaccacactcggtgggcagcaccaatcgtggtcgtcaaaaaggctactggttcggcacgtgtgtgtgctgacttttcaactggtcttaataatgttttgctgtcaaatcagcacccgttgccagtgcctgaagacatttttgcgacactaaacggaggacaatttttctctcagatcgatttccgggatgcgtatcatcaaattgaattagaagagggatcaaaagagttgtgtacgatcgcaacgcaccgtggtaattttgagtaccattggttgccattcggagtgaagtcagctcctggctttttcaatccattatggattcgatgttggcagattgtccatttgccattgcttatttggatgatgtgattgttgtgagccggactcggaaagagcattggacacatttaatggaagtcttcaaaagaattgacaattaattttgtttaaacaataagtaattatttaaaaattaattattataaaaataagcccatagaactataaataattaatgcgtttcacaggaaagataataaagttttttgatattttgcagaataatagcgaacttatagtgctatgaactatttaagcaaggttatgataattttttatattacaatttagatataatgtattttcataccatgtatatttttatttaaatttgattttattgcatctttttaacatttttctattaaaaatttatgaaaataaaaatgaaattaaaaaaaaaattaatttctaagataactcaaatatgaaaaaacattaaaagaaattctattattaatttattttttaatgtttcgaggccaaaataagaagtaaatatattgtttcctatttattttcgataaatatttacattcatttttattaaatatgttcagttacaaaattatttttatttaatatgcacagaaaaaattaaattatattcagaaaatatttttcgatgaattaaacagattttattcgtcttaactcctatttttgtaaccatatttcgaaaaatgaagattgacgtctgctttaaaattttgatgaaataattctacgacagagctatagtttgtttattatcgttttttaattgttacttagttctatattttctaatatattcttgatttgactgcattgagttacgtagttgattgaagaccttttaacaatttttttataattaatattagttacaaattattcttttttcaaataggtggataaattttttatttaaaaatgaaattttataattctttatcttcttgagcagccaagtacaagttctttcacgaaatataatttgcttcacacttgacccttggatatgtttattcatcagtatttattatgtaattttcaaaaaaaaatcttttcaaatatatctattgcttttcccgctacatttataaaataaaaattaagctaattgcagttatgttttataacaaattttactaactggaatttaataataaatataatttttatttaataattataaactttcattaaaaaaaatgaaaattgcgctcgataaattataaaattttattgtatgaaatttaaaatacaaataattagggatgcgatttttaggccttctccgtaatgggaattacaaaagtaaaatagtcacaaatgtaaaggataatcagattaatttaatattcataaatattattttaatccgtattttaaaaattaattttatttaatataaatattaatttaaaaatttattcattatatgcggaataaataacaattaattacgacattttacctttttttaaaatataaaaataaattaaataaaaaaacaaaaaaaatgtaaagtttacaaagtgtaaattacattgacattcctaaaaagacaattcattgatggctgtaaaaactggagcagctcaaagtctcaatgtattatataaattttacgtgaaatacaaaattaagaatttattttaagaatttgatattaaataatttaattaactattgaacaataaaaatatacaaaaataaatgaaattgatttttttaatataaaattcatcaggaattataaaatgatcaaatacatattatgggactcagttttttttggataacaaaaaaaacctatttgttaacacaaattatggacaaaaaaaaatttttttaaattcaaaatgcaaaattatattattaaaattgaaaatttctaggtaaagtgataattgttaatttagacaaaatactttgataattaattttttatatcagcaaatgcttgtttatttatagagttgcgtgcactataaaattatatttgtttttccaaggatatatttcttttaaattattttgttaaaaatattggttaagttttattcctgtacatatgttttttattagtttctttaaattttttaaatttaaagctataatgtaatgatttaatttgtccaagcataaacattttccaataaaaacaaaacttaataaagttaaagctcaaattcactttttggttaaatatatggtatctcgtttaattactttcaaaactccagtattcgaaacatacaatttaataaaatttgatacattatttttaatttttatcttttaattagctcgttttctctaacatgcttttaagagtattatcatatttataacaattttaatattattttattaattggttcaggaattgtaattgactcattccatttattctcgtttcaagcttccattcgattgttgaagcttatagtctaagatattttaaatatatatttttagtatgttttttatttttcattattttctttacaattttgaattttaattattaatgaatggacactctgatttaaaatactgtttttaatgaaaaattattaataaatattttttg

SEQ ID NO: 60820 - DNA, 709 bp, Heterodera glycines
  Genomic contig location: Contig_ID=SeqID_30412; Location=309..1017; Strand=+
  SCN-specific regions: Sequence locations=1-388,410-709
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttgtcttttgaa

SEQ ID NO: 60821 - DNA, 528 bp, Heterodera glycines
  Genomic contig location: Contig_ID=SeqID_30412; Location=250..777; Strand=-
  SCN-specific regions: Sequence locations=1-60,82-507
gcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 60822 - DNA, 142 bp, Heterodera glycines
  Genomic contig location: Contig_ID=SeqID_30412; Location=1000..1141; Strand=-
  SCN-specific regions: Sequence locations=1-142
ggactttccacagtaaaatggtggtacaaaattttgcaactgtcccgcctcacggcggggcttaaaagcattgtactgcataattaaaaccgaaaataattttcgtatatttttcacaatttatttcaaaagacaaaaaaaa

SEQ ID NO: 60823 - DNA, 1185 bp, Heterodera glycines
  Genomic contig location: Contig_ID=SeqID_30413; Location=7..1191; Strand=-
  SCN-specific regions: Sequence locations=1-329,352-575,599-1185
atgttgtcaaattgggcaattcatttgccaaaccaacagcccattgtatatagggcattccagctggtgagcaaagctcaacaaatccagcaaggcgaactgccagaaacgcattgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttgctgtacccccatcggacccggaaaggttcgcgctctattcacttatgcgtcactttcctggagatccagatcatcttaagatggttaatgggttgctttgtacctcattcactgatgctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactcaattgccaaaaatactgacgcggcaattgaagagtttttctttggcgatgatgatttgaatttgcctccagggcaaccaaatcttcgtccacagccaaaagcccctccgccacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagaaattctttgcccgtcggattcgtgaggcccaactcatctggaagatgagatcaccatgcttcacaacacggtga

SEQ ID NO: 60824 - DNA, 113 bp, Heterodera glycines
  Genomic contig location: Contig_ID=SeqID_30415; Location=787..899; Strand=+
  SCN-specific regions: Sequence locations=1-113
aaaattccctcaaaaataaaaggtctattgcgcaccgccctccctatcatgctcgagagcatttgtatgtgtataaaatttatcaaaaaaagagatagccattttttctggga

SEQ ID NO: 60825 - DNA, 998 bp, Heterodera glycines
  Genomic contig location: Contig_ID=SeqID_30420; Location=235..1232; Strand=+
  SCN-specific regions: Sequence locations=1-157,184-321,348-730,753 -797,829-998
atggatgtgcaaaaaacaggcaaaaatccacagcgccgcccgaacccggatttggcctccggcgactttgtgaatgccccgccaaagcgccgaagaaacaccaactcggtgagtttacaattaggttctgccaggttaagacattccggttttcaaccgcatattggcaatggaaacctttgcagctttagttcactaaagattggcatgacctccccagttttttttagagccgtctcgaaggcaatcccccgcaagagcaaccggggcaagtccagccgtccgtcttaatggttcagcaacaacagcccgttttaccgatacagcagcaacagcagcagcgccaatttgtgaacgtaagagtgtgttcaggggtggggcgagggggaagcgggcaatgcaatgccgatgttagcatagcctggggctatttatttattatctggttttgaacccgagcattaaccaaaaaaggggggggggaatgtacattttggccaatgcaatgccaaatattatcattaccatggggctatttattgtcgaattttggaatcagagcattaaccaaaagggtgctgatccacattttataatatccaacccccccccccccccattttagcagagtccgcaaataagcttcagcccgtttgtcgaccctcagctgctacatcaaccgcaacaactgccgccgccggccactcgcatttccatttcggtaaataataatgatcaaattagttttcattgccaatcacacttctttttcagtattctaagccttttacgatgggggagcagcagcaacaacaacaacagggagaagaagatgtgatccgggagcgcattcggcgccgtcagctccaagaattggccgcaatggaattggccaagccgctccccgaagacctgcaattctgtgcccaatacaatgcctatggtctgaccgacatcggctggctgttgatgggatggcgggaccagatggtcattgg

SEQ ID NO: 60826 - DNA, 3110 bp, Heterodera glycines
  Genomic contig location: Contig_ID=SeqID_769; Location=793..3902; Strand=+
  SCN-specific regions: Sequence locations=1-826,848-1253,1275 -1482,1505-1692,1714-1755,1794-1991,2014-2875,2897-3110
atgttcccaaatgacgatggatacgaatcggaagatgatgaaattctcttgccacctccgccgatccccccgcaacttggccaccctccgccaaatgtgccggtaatttcggtctcgcttttcgttgctttttctcaaatttccgagtgcttttttcaggcagttcgagttcagccaatgcatgttgggcagcagcggctgccgctgagagacctgccgcaaattttccaccctccaccaaatgtgccggtaattttgggtctttctttcgattgctttttctcaattcccgagtgcatttttcaggccgttcgtgtccaaccaatgcagcaacccgtaccaatgagagccgtgccacaattcctccaccctccgccaaatgctccggtaatcttgagtctcgttttcggttgttttttcaaaatcccgagtgcattgtttttcaggaaattggtgtgggaccaattcatgatgggcaacaaccactaccactaagagcgttgccacaattcgcccaacctccaccaaatgtgccggtaattttgggtcgtttttttgttgctttttttaattcccgaatgttttttcaggccgttcgtgtccaaccaattcaacaaccgataccattgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgttgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacgtgccgtatcatccaccagaaaacgttccggtaatgttgggtcttgtttctcatatttccggatgcttattcaggtaatccaaccacggcaacgaccgcgcgagctgagagacgtgccactattcgaccacccactgccaaacggacaggtaatttcagaccctgtcttttacctaacaccgaaacatcttttcttaagcaaatgtatgccaaccccccgagagtgctggaagtgatccgacggctgggcgagtggagaggaagaccaagggacccagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatttatggattttttttcatgtgcattattctggtgctagtaagatattgccgaatgaattaattggttttttctcttcattttaaaatatttcacgtccccatgccctgcccacttcccacggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactctaccaataataacatttaaaataaaattataattttttatttcttatctgattaatttcgatcaatattttttgataattaaacaaattgtatttttccaaaaagaattttctcgcagtagcaactcatcgtcttttttactcccttcataaaatgtctcgcttttgccccctcgcccaaatcaatgaatcgggtcggcttaacacaccaaaggggaaatttagtgagttccaaacctatcaaattaaaaaagaattttgatattcgttttaggtcttttttacgctttggaaattgctcgaagctaccagctcatagggaaaagtataacggaaaacaaattccgttatctgatgaagacggagaagaaacaaagggaaatggccatggaattgatggaaaaggcagggataaacacggatgacaaaacttttggtacccaacaccttgaggctgtacaaaaatactgggacagggaattcccggatatgtttcgcattgtggcttttgaaatggtaaccaaattcgcttgaaaaaatatcccgttacttatttttagaagaccgggcttaggccaattttcaaaggagaaggtgttcgaagaaatgaagtgggtgtgataagagaaggagaccattgggatgggatcaaatcggcttcttggttttttggtgttcgatacttctgtgtcagctgtgaagtgacgtatgatcgacctgaaagacacagaatggagtgtaaggaacgctgcaaaaaatgttgccggatgggatttgggtttccatgtgcaaatgtatgcgaggaaatacactgcggcgaatgcaatctcaagttttacaacccgaaatgttttgaagcgcacaagaaggcggcttgtattgagtacaaaaaatgcgaaaagtgccgagagacacacaatactcggaacaaacacacatgcggggaaaagttttgcaaactgtgcaaagtttgtcacccagggcggcaatgtttcatcaaaaaaatttcaagtgcgaccacagaaagcctacagaattgtggcatacgacctagagacgactgtagatgggggagaacaccggctttaatcttgttagtgcggcacgtacttgtagcatttgtgcgggagaagagcgggaatgtgagatttgcgaaggccccagtaaaatcacatggtcagtagcggacggttttgatccaatgagcgagtttatcgtttggataatgggttttcaacgatttgaaacgattgctttcgcgcattatgctgggaggttcgattcacactttgtcttgtccgagctaacaaagaaggaaattgcgacggagttgatgatggctgatttgaaaatttatcaa

SEQ ID NO: 60827 - DNA, 1468 bp, Heterodera glycines
  Genomic contig location: Contig_ID=SeqID_770; Location=1414..2881; Strand=+
  SCN-specific regions: Sequence locations=1-885,912-928,951-984,1018 -1468
tggacctttattgcagtgccctgtcagaccccgtgatcatccctgcccgccccttccaacaatcgaacccagacattgttttcaacgagttcatgcacagacagcaatcatttggggaagtgaatttgttagaccagagaatttcaataattattgccacttattctttccctgttaaataaatttgtttcatttttccctttcattattttttgtttattacaataattatttattcgaccttttttctttattaatttttcagttaaaatgtactcgtttcaaaaatattttgaggaggctctcgaaaaagaagattttttctgccagaaaaacagagcagaagtggaggcattgttaattgaggcttcaaattataaaattataatacacagggactacgaaagccgctattctgattatattgccacctatcgccgcaccccactcttctgtttctgcatgattgagagaaatttaagatttttttacgacacaggaaccgggacgcctataggaagggttacaaccgtgctacatgttaccgttgaggcgagctatacaggagaggggttcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaattaaaaaaaatattttagagatttggtcggatcgtggtcattgttctatagactcccaccctcactttttgacacttcacgccgggtggttgcggagaataaactggaagaatttttaaaattaccatcattttttcgcatgcttttttataataaatattaaatgttcatgttgtatttaaagtgaaggttttgacccaaatatttaatcaattttaatttattattttttcgtagaaattcagaaaaaaatgcaaacaattgctgaaattaaaaatttcgagattattgaaggcggaagagtttttattgtgagagcgagaattgagaacgtagtacatgtggagtacagggtttgtattaaaaatgaaaaaaatatatcagtttttaaggcttgcgttttatgccgtaagggggcgtgttcatgtggcgttgagaaggcactgacaccttatttgaaggtgtctgtggcagatgatactgagatattggaaaatgtggcattttttggtgtacgtgggaagaaaaacggaatggtaatgttttaaagaaaaaataccattctaatttaaattcaggaggagttgagaggattgtctggggccgtgtgcaccatgaaaatcggcgcgagggtgaaagaattcggagggaagaaggggatctattactctttgatcgatatt

SEQ ID NO: 60828 - DNA, 886 bp, Heterodera glycines
  Genomic contig location: Contig_ID=SeqID_6235; Location=1658..2543; Strand=+
  SCN-specific regions: Sequence locations=1-194,217-269,292-368,390-886
  Gene Ontology: Mol. function=protein binding; Biological process =insulin receptor signaling pathway
ttgtacaatttgcatccgcacacgcgcatcctcggccatctctcctccattttttgcgtggcctttgaccgctccggacgatttttgttcactggggccgacgacaatttggtgagcacggaggggagggggcgggcaataataattaagcatattgacgaatcccatcaaaatgaattattgagtaattaatcaataaaaaatttaagaaaaaacattgcaatgttaatttttctttaattaacaattaaccaattgtttttcaaaaattcaggtcaaagtttgggatgctcagcggtgccttcttcgtttcacggtactgaagtaaaaaaaaaaatcggtaacatattaaaatggcacaaattatctaccaataaattatttcataagccgcaacagagacgaaaaaaaaatccaaaaacttttcagttccgcggccacagcggtgagataacggacctttcggtttcgtacgacaacaatttgctggccagcggttctgtggacaaaacgatcaggtgattttgagtgtttgatgtttttttaaatcacgtttcagagtttggtgtcttcgcaaagggaccgcttttcgcatttttcggggccacaccggcacagtgaactccgtccaatgggtccctttgttggccggtccgatgcgctatttgctttcggctggaaacgactgcgctgtgatgttccaacgatacaatgcagaaacgcttgcatttgaggacccacccttcaaattcaacgaacgtgccacggggtgagcgcatagcaccaaaaagccaaatacgacggaatgcacaatttatggggggggggggggatcttttgcttatcataccactttttcggcgcatttttcaaaaaaaaaaatgga

SEQ ID NO: 60829 - DNA, 1582 bp, Heterodera glycines
  Genomic contig location: Contig_ID=SeqID_6236; Location=476..2057; Strand=+
  SCN-specific regions: Sequence locations=1-206,228-690,712-879,902 -1582
atgatgtacaaactgagtgcgcaaggcgtcgcccgactgtacgagttccaagcacattcggtaaattaacataatttggttgtttaatttcaattggcattttacattttgattttttaggatcgcattgacactttggtgtggtcgcaccattcactgcgttttgtcagcggaagcaaagacggcaccgccaaagtgtggagtttggacgaggagggacgctgggcacccgtcgaattgaatcccttcccgacggtgcaacaaacaccgcgcgtaacagcgacaacgggcgatggtgaatcaccagcagcagggggtaaaattggcactagcaggcccgtactccgaaaaaatttcgggatggcacttttttcctgaatttgtaacagttttgtgtcaacaaatttttgcaatttggggttatgttctcaaaaaataatggtaaatggggtccggcggtgccggggatgtgcgccttccctggatacgggcctgggcactacaaaatgagtttttgttccttcactttacattttttgctgtagttgcattgccaccgtcgcaacaatcgaccaacagaagggcagccaacgcaaacgccggggcgacaccgaacaacgggtacaaactgacaatgttgtgctggacattggacgacgacatggtgatcagcatcggtgtgtgtttttgtgctggtttaaatgttgttccaatcaaaaactgctgttggggtgtgacgattccctgctgtttcctccctccccgagtttagggtccgactttttgttgcgttgttgggactggcgaaggggccaacttttggccaaatatccgggccatcagaacgacgtgttctgtctgaacgcgcatccgattcacaaagtgaacacacaaaacaattacttggtaaatttgtcaatttaaggaactgattgtgagcgcaggccatgacggattagtcattgtaagttactttttttgaatgtaaataaggcttttgccaattttttactccatttcaaggtttggaatgtttacaatggcaaacaaatgtccaaacatcgcaatgaaaacaacgaccgcgaggcggtggccattttcgacaaccaaatttcggcggacggcacaacggtcgcgtgtgtggacgccatgggccatctgtccatctacggtgtggaccacaaccaggaggcattgaaacggccccacgagcagttctttaccaccgattataagtaagtgtgatgctatttaaaaaaaacaaaaatgaggagtggaagatttttgttttgactgcaataacacggcaatagaattatttggaaaaatactactagtaattcatccgaaattttctaaaaacagaaaagtttttcaattccatttaactcaattttcacattaaaatcaaaatgcatctaaacaatcgaatcgttggatagcaattaaaaaaactcaaagaacattcggtaatactttgatatctccatgtgttttcagggtcgctgaacacgaatccggcatccatttcgctcgatttcgaaagccggatccggattcgaacaaaaagtcgaaaatttaa

SEQ ID NO: 60830 - DNA, 1990 bp, Heterodera glycines
  Genomic contig location: Contig_ID=SeqID_6237; Location=65..2054; Strand=+
  SCN-specific regions: Sequence locations=1-64,86-478,501-554,588 -756,779-917,940-1240,1262-1467,1489-1643,1665-1990
  Gene Ontology: Mol. function=protein binding; Biological process =insulin receptor signaling pathway
ccccaattgggcgacgaggtggcctactttttgcaagggcacaagacgtacctgaaagagctgaaggaaaatgggatacaagttaccaaagtaatgcagccacggtcagtgctaaaaagaaaagaaaacaaataaagaaacaattgaattcgtcaggcccgatctgaacgcgatggagttttgctttgtggacaagcttgagtgggttcagcattccggcattcacatggcccaccttcggttggcacggtgccagaatggacgacgcattggctcaaccttccaaatattgtatttgcaaattgcaaaattccttcacttcctcttcaaaaatttgttcagtttccacgacatgcaaaatgtgctcgactttctcgttctcaagcagcattttgacgccagcaaacagctgaatttgcagccgggcaaccgagtggagtcaattgtggacgacaaattctacacgggcaaagtgttgcgagtgaccgcggcggagtacgactcttatccaaagtggggaactccaaaaataatacagcaaaacactaacagacaatttttataatttttatttttcttaaaaatttgaattttcaatttcggggagggggtcattaagactttttcctcttccagctctgattggtgcgccgtttgtgtcgagtgggacaacggagaggatgaccgctattcgccttgggacttgcaagcgttgaccaaaggcagaaagtctggtgcgtgcgtaaccgtaaatggatggagtcattattacagccaaacaatatgaaaatgggggcttagaccgcctttggcttattgtcgatagaaaaaattttagggtcttttttctgaaaaattccggttttagtaaattttaaaaaactttcggggaggcgagggggagaccgtgctcatgaaaaaatattttcttttcagaaagtccggctaccaaacatgacactgccaaattgggcgagtaccatccaatggccggcgaatggctcgtgccagaatgggcgcttgccaacgcgccgccacgtgcctccagcagcgccgtttcgtcacggccgtcgaattcgttactgttagcccaggagttgttccagcagcgcatttccaagctgatcgaacagctcagccatgtaaaagaggttatcccttggatattgtttttaaaaatcggtagaatttttgactgtagctaaaagatatactatacattgaattgcttagcttttcgagctttcaactagtaatttctcggggttttccggtaaaattccgttttcaaatggcgttttaaccactactaaccttttggtctgtcgtttaggtgctcccctttttggaaccggtggacctgcacttgtaccaggactaccccacttatgtgttttatccgatggatttgacaacaatccaagagcgcattcacagcaatttctacaggtggggagagaaataatcaaaattaagaattaattaaaacacataaatgttcaggagaagtttggccattctgtacgacgtgcaaatgttgggcaaaaatgcgttggcttacaacaaaccgaagtatcccatcgtgcgccatgcttgcgctctcgtcgaaaccatttttgtgtttatggagtaagaaatatcctgttttttgaattaaaatgggttttttgccatcttttccagggattggaagcaaaacgatcccttgccgatgtttcggcattttgtcgaggccggcaccgaaggcaccaaatattggcagttggatctcctggccacgtcgaacggtggcggcattgggtcaacttcgactttgttcaccaccggctccggcagtgtttctgggtcggcattgagcaacggaaccgccaatcaccaacaaaatgccacttctgcacgtcttcaagtggcaccggggccatcttcttcgtccgcaactgccggattgccgctgtgggcttctgagtgttctgccatggtggacgaattg

SEQ ID NO: 60831 - DNA, 1047 bp, Heterodera glycines
  Genomic contig location: Contig_ID=SeqID_30423; Location=119..1165; Strand=-
  SCN-specific regions: Sequence locations=1-81,103-173,205-285,307 -334,356-635,657-855,884-965,988-1047
atggaagaaaagcaaaaatttattcaccaatttgacaaaataattggcaaaaaggagcaacaatcggtgggacgaaaggacaaattggaaattgctgaaagggtgggcattaatttgagaaccattgacaaatggaaaagcgaaatgggcttaaaaggtaaaatgggaaaaggaatttaaatcatattatttaaaattttaaatgaaaagttacgaaagaaagtcaaagaattgcccttgtaaaagaatactacagaataaaaaaggaagacccaaaagtgccgacaaaagaaattgccaaaagtttcaatgccagcaaagcgacattattttattggaaaaaacaatttgacaagaataattatgagtcatcatcatcagcggatggaccggaacaattaagctggtaaagagcttctgcatttggattcccgttcactgcccgcctctctaattatccccggcgggcggaagtttttccgcgatttgatttcctggacccgtagaaaaagacgatgtaagggttaaccgaccgttacccgcattaatcaagattgagaattaattagtgacttttggactacatatcaaaatccgtttctggggaaaggcgcgcctgtttcactaattccgtgttaattaatttgaaaataaatgcgagacaaaaggttttgaaaacagttagagatgagttaagcccattttgcaaatgtgacaatttaattgtataaaatgcaagaatttagaacccagaaaatgcattttctgtcccaaattccgttgttaaatttgttgttaaatgtccagttttatagtcctttgaccacaccaaaaccgaaagcacagtacgacacaaaattcaaaattccttttttagttctgatgggcctcatttgtgtgatcatttgccagtagatcaaaaggcatgggaatggaacaatggcacaaggaaacgaagtcgaaaaagaaaaataagtgaattttattgaaatatttgcaatatttcattggaatttatttgcaaaaacacgatgaattattaataaa

SEQ ID NO: 60832 - DNA, 186 bp, Heterodera glycines
  misc_feature (117)..(117): n is a, c, g, or t
  Genomic contig location: Contig_ID=SeqID_30423; Location=1252..1437; Strand=-
  SCN-specific regions: Sequence locations=1-93,116-133,156-186
aaaaaaccaagaccattggatgaaaaacagaaagtggaaatagttaaaaaatatgaacaaatgaaaaacgaaaatggcaaaatgaaggacagcgaaatttccaaaaaactgaaaatntttccctggaaaattattggagctgagaaaggaatttcagcctaattataaaagtaacggcggaataaa

SEQ ID NO: 60833 - DNA, 984 bp, Heterodera glycines
  Genomic contig location: Contig_ID=SeqID_30425; Location=86..1069; Strand=-
  SCN-specific regions: Sequence locations=1-39,73-275,354-374,471 -501,523-984
tttgaagaatcgccaccagctgatgctgatcaatcaactcagaaattggaaaaacaaaaagtaaacgaagaaattaatttttaagcctatttaattcggaataatttggcttaaatttaattcattccaaattaaagtgcttattctcattagataaaaaaatttaatggtttttgtttatataatgtattttattttttagtttgaagaggctccgctaccgccgcaagagcaaactgtggaaaacggccgacacacaatgaatggagaaaatgtaataaaaattaattatttaattattggcaataaatacataaaataaaattaagtttaacatattttaaattaaaaaacaaatgcgggttaattctaacaaaattaaataaattttccaaaattactttttttaattttaggcttatttttttatttaagagcaatataattcaataaacataattattttaaatggttattaataaatccaggttcttcaccaacagcagctcaaagaagaggaaaggacttctgctgctgatgcggtgccatcgaaaaacggcaacggcatgccaaaagttttggatttggaccaggcggctgaaatcatttacaagtcgatcaaccgcggcgggcacggcggtggactgatcaaaatgttcaaaaaggcacccaaatcggacaccgaccaaattttgaccattctgacagcgtccaattaccatacggtgggtggaatgtaagggcgtagccaggggggagggctgagtgggctaacccccccccccccctcagccgaatacaaaactaaaaatttttcagcaaatttttgaaacttttcggtctaaatttcaaataatagggtaaaatggggtccgatggtgcagataaggcgccgctgggaaaaacttatagccaaatttccgaaaaaaaaacgcaaaatttccaaaaatgcacaaaacaatcaaatcttggcgaaatattaaa

SEQ ID NO: 60834 - DNA, 740 bp, Heterodera glycines
  Genomic contig location: Contig_ID=SeqID_30426; Location=449..1188; Strand=-
  SCN-specific regions: Sequence locations=1-130,159-474,520-632,654-740
atgaaagtggtccggacaatccatctatggacggacaatcggtcactgaataatccatcaatagacaatctgtcattgaaagacattctgagtcagtaatggacaatccgtcagtgatcaattcgtcggcaaattttattttcttaaatgtttaaaaatcatttaagaaaaaaatggatgggaatttacaacattgttatttaattattcaattcaatttattattctatagaaaatttttaggaaaattcagctatatggcgctcagtggcactgaatgaatcatttcttagcacgaaaacggcacgacaaattaacagacgatttaaatccgacattttcaagcgcaatttcggcacatttcgtaaattgccaacgaagagaatgtatgctgaaatgatggcaaaatgttatgacaacattttttatttgcatgataaacaagtgacggattgtccgggtaagaatttcgacaaaatttgaaaaaaattatatttttaaaattaaatattttttaaaggaccacaccgatgcagaatcaaaccaattaatgggctaaactgttttattgcaaaacgtaaattaattgaacaagagttggcgctcggaattttttggtatatttcgccaaagaaaggaaaatttcgcttttcaaacgaaggatgttcactttaatattgtttttaatttcaaaacatatatctatctaacatgttatttggtcacaaaatttaaataaa

SEQ ID NO: 60835 - DNA, 280 bp, Heterodera glycines
  Genomic contig location: Contig_ID=SeqID_30427; Location=54..333; Strand=-
  SCN-specific regions: Sequence locations=1-77,102-280
atgaatgcaaaagtgaggcataaaaattatttgctcaattggaaatccatgccgtgatgctcgagcagcttttagcaaataataataataataataataatctttcagctgttttacaattttgtgatgacctgcgaaacattgtccattcatttttggcatttccgtcagaaaagcaaagaatgatcaaagtctttcaaaaattgaatgaattcgaacttttaatgtcatttctaaccacgcatgaattttattggtatgaaacggcggtaaaattaaa

SEQ ID NO: 60836 - DNA, 439 bp, Heterodera glycines
  Genomic contig location: Contig_ID=SeqID_30428; Location=891..1329; Strand=+
  SCN-specific regions: Sequence locations=1-87,122-439
gcgcattacacggtcgcgaaacctctcattaccaacaagccgcattttttgagctcggcgccatgattctacaaaatatgtttggtgaatataaaaaaaaataataaaataaataaataatgttgttttattgccatttccccaggcgctctctcctttttgcgcttccaaaaggacgacgacctcgtcgatcggctgtcctacttctacacttcctccttcctcattatgatggccgtattggtcagcttcaagcaggtgcttggcccttccgttggcattctgttccaccccaaatcgttcagtttggcggtcgtcctttggagtgttgggtacccgcgcagttcacttcgtcctgggaggcgtacacggaaatgttttgttggtccgaaaacacttattttgtgcccgttgaggaggtcggaataattggattatg

SEQ ID NO: 60837 - DNA, 607 bp, Heterodera glycines
  Genomic contig location: Contig_ID=SeqID_30431; Location=754..1360; Strand=+
  SCN-specific regions: Sequence locations=1-59,212-218,240-382,421-607
atggcacaaatggttgcaaacattgtgactgtgatcttggcggctctgaagtcagtgcctttaattgaaaattaaaaaaaattattattaattaatcattaaaaatgaaaaagtttattattattattattataaaaataaattccgaattttttttttattaataacttaaaaattcaccgcattttttattttatttattaaatattttgtcaatccctttttgaagagtacccattgcactgctgaagaaggcaaatgcaagtgcaaaccgaactttgaaggacgccgctgcaatataaccaccagtggttattattgcccaaccatcgacgaattcactttcgaggcaaaaaaaagcaaaacacaaaaacaaatttccaattttatttaattaaattgatatttaaatatattttagggttgcttcccgaccgaccctccgggagagaaaaaaagtcgggaaacggggagggaaattctcacaaaaatctgtcggggatggctgtaagaacttaaaaaaagatatcggagaacgacagcaacggtgttggggaatatttttcataaaaagttgaaaaaaagagaaccagaaataatttattta

SEQ ID NO: 60838 - DNA, 353 bp, Heterodera glycines
  Genomic contig location: Contig_ID=SeqID_30432; Location=175..527; Strand=+
  SCN-specific regions: Sequence locations=1-158,222-222,244-353
gaactagcttatggattgacaagatttgagcttctttgtggttttcggccatccgacgaaattgcattcaatatgaaaggtaaaaagttagatagaaaatgatatgcgcctactgatttggataaagcttacccggctttataatatatttacatgagaaaatttaataataaaatttatttataaaattaaacgaattattttaaataatattttattaagcatttcctgaactttgtcttgcaatgggcaatgaaaattgtgcgcttttcatcgcagcaaatgaatcggagaacacaggctttccagatctttcacagttgctaaaaagatggtgggttaattaaaaaata

SEQ ID NO: 60839 - DNA, 1498 bp, Heterodera glycines
  Genomic contig location: Contig_ID=SeqID_30434; Location=167..1664; Strand=+
  SCN-specific regions: Sequence locations=1-65,87-629,651-922,944 -1206,1228-1498
atggaaccaaaatggatttggaaaggaacacatttggcctttgccaatgaattgttgtgtgaccgaaatggacttttaagggaaaacagcacaaaagaaattcttaccctaaattctgaacgaaagaaaatggaaattgacccaacatttgtaggcgatttttctagggccatggtcaaagacaaagatttggaaaagctgaaggcattaatcgaagaattttcagatgtttttagcaaattcaggtacgatcttggacttttcacagccgctgagcatcacatcacaaccacaactgaggaaccaatcgcatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaactcaacgaagttacggtgcccgacaggtaccctctcccacgccttgatagcatcatggaaagggtcggaaattgtcaattttacagctctctcgacttggccagtagctattttcaaattaaattgagtgaagaaacgtcaagaaaatgtggaattataactgaagacaaagtgtaccaaatgattacgatgccatttgggctgaaaaatgcaactgcagcattttcgagggccatggctatcgttttgtctggattggaggatacttcattggcctacgttgatgatgtgctcattttcacaaaaagtccgaacttttcagagcacctaacggcggtaaggaaggttttggagcgttttcggctttacaatctgaagcttagcccgaaaaagtgcatttttgcctcaaatgagatgaattttctcggatttgttttaacagcggaaggttttaagccaagcttaagtcgaatcgaaattctcaaagaaatgccagtacctttaaatgttaaagaggtaaaaagggtgctaggacaggcaggcttttacagacggcacattgagaactttgcaatggtcgtagagccattgctgaagcttacgaggcaatgcaataaattcgaatggggcagggaacaacaaaagtctttcgacaagataaaagaactacttactcaagccccgagtctaatttttccagattacgacaaagcatttcacattttcactgacgcatcatcgactggacaaggaggagttttaatgcaaaaagatgacgtgacgggcacattttctgccatttcctattgcaacagaaccttctctgctgctgagaggaaatggccggcagttcaaattgaaatgagtgccattatttatgctttaagggaattcagaccattcatcttcatgtcggacattgaacttcacacagatcacaaacctctcgcgtttttgctgaaaaaatccgaaccaatcagcaattggcacgatggctcattgaatttacaaatatcag

SEQ ID NO: 60840 - DNA, 612 bp, Heterodera glycines
  Genomic contig location: Contig_ID=SeqID_30436; Location=523..1134; Strand=+
  SCN-specific regions: Sequence locations=1-82,116-202,250-332,381-612
gatttactaacaattcgtccgggaccaaccgggaattttcccaagagtcgggatttctatttttcaaaaaccgggatcgggacctgaaaaacccgggaattcccgacccggtcccgatcccgctaaactctacattataattaaattgattagcaattttacatttttttttgcaaaatttgtgcttggaacaatagtgatgttattataattttttaaaagtaaattacactttaaattatttttttagtttttcgcactcggatagcaaagtttgtaaagaaaatctaacggatgaagaacatgaaaggtatgctgaatagaagtttttcaatttatacaaattaaaaaaatcattatttaaaatgaatttatatttagggactttttaaaaaatccgggttgaaaattcaaggagaaattgggtggcgcagttgatggagaaaaagaaaaatgtttaatattttttaaatgaagataaaaaagaagaaaaaaaaactaaaaatagtggcaatttcaaaaaaaaggcaaaaccatcgctgagtagtaatctccgacccctcggggaaggaaatggcggagattttcgagaaagatggccatcctaattaa

SEQ ID NO: 60841 - DNA, 696 bp, Heterodera glycines
  Genomic contig location: Contig_ID=SeqID_30437; Location=210..905; Strand=+
  SCN-specific regions: Sequence locations=1-137,198-413,438-485,534 -611,633-696
gcaagaccctttgggattggatcaaaaagccccgggcgcgtttctccgactcaatcgaccggctcaattgccacttcgtgcctttagtcctgctcttcttcgttgccatgatctcagcaaacatgtgagaaacctgcaaaatataaattgaaattaatttaatttataaataaaaaaatacatattttttaaattttgattgctcgattgagaacgggttttatccaaaaaaatgactaatttattttcagcgatttggaaaattttttgaaaaacttaattattggtcataaaattttgaaaaaatcattaaaaaatatttcaaaaattgtttaacggatgcaatttaaaattcatttttcttttatccaaataaacaattcaatttaaatattttattttacccatatttatttctttggtttcttttcagtttcggctttggcggcatggagcccatgcgttgccttgtaaggctatcgatcattaaaaatgattattaaatatttaaaaataatttttaatttaaaattgcccctttcccccacatttcagcgatctcccgaactgaatgaggaggagcgcgagtatgcgctggattattgtacatcaaaaaaccagtactacgtcgcgccggaggagggcatcccgtgggcaaatccggagcggcgggcacggcaactgggatattaccac

SEQ ID NO: 60842 - DNA, 100 bp, Heterodera glycines
  Genomic contig location: Contig_ID=SeqID_30438; Location=172..271; Strand=-
  SCN-specific regions: Sequence locations=1-100
ggaagctattcccgaaggattcggtctccccataaatctgggcgcatcggttcggggggactgccccgaaaacaaaaaaaaccatttttttcagtgtccg

SEQ ID NO: 60843 - DNA, 294 bp, Heterodera glycines
  Genomic contig location: Contig_ID=SeqID_30439; Location=671..964; Strand=+
  SCN-specific regions: Sequence locations=1-17,39-294
atgcatgctatcaatgacataattacacagaatactgtacaaatctggggtactgtatatttaaatttataggcaaagattaaacgtggcttccgcgcaggcgacgccgacgcgttgcttcaattggggctgcagctcgtcaccgatctgaatcagtactgatcagaaaacaaaagtatctcggtgaataagaacatattttaatcgatgaaaaataggcaaaactatgagaaaaactgaaattattggcacgattgttgaatttcatgcaaaaaaaacaggcactgaagtaaa

SEQ ID NO: 60844 - DNA, 289 bp, Heterodera glycines
  Genomic contig location: Contig_ID=SeqID_30440; Location=67..355; Strand=+
  SCN-specific regions: Sequence locations=1-289
tccgtgccccccgtgcgactcggaggacgaagttgtgctgaaggtgggccccgagcagttcactgtctccaagcactttctgatgtccgtgtcgcccgtcttccacaaaatgttctccgtcgacatgttggagaaggcacagggcgaagtgagcctggaggaaaccaacggggaggagttcggcgcgtttctggacgcaatctcgcccaaaatggcatcgccaaatcgtaaaaagaaaatgcacacaaatgccaaaaatgttccgctgttcacacagctgccaatgtga

SEQ ID NO: 60845 - DNA, 381 bp, Heterodera glycines
  Genomic contig location: Contig_ID=SeqID_30441; Location=8..388; Strand=-
  SCN-specific regions: Sequence locations=1-63,88-126,172-225,248 -324,350-381
atggaacatgattttggttttggaacttcatgtggaccatcatcattaaatgaggacaaaagcggtaacaataacaacaacagaaatggagatgacgaggaacgaaaaataatctctgtgataattgacgaggatgaggacgaagaggagggggaagaggaagagggggagacgacggaattggcacaccaaactgaggacattggacagtcggcggagttggcaccacaacaagcggaggacaatgggtcagtggcattggcaccggcaccaacttcagcgccagcagaaacattggaatcggcaccacccccggcgccagcaacagaagaagagggcggagcagaagatgctgattgtgagccggacaatttgtcatag

SEQ ID NO: 60846 - DNA, 426 bp, Heterodera glycines
  Genomic contig location: Contig_ID=SeqID_30441; Location=859..1284; Strand=-
  SCN-specific regions: Sequence locations=1-116,138-202,224-229,268 -279,301-368,390-426
atgcggactgatcccgaagcgaaaaattttgctgaacaacttttagaaattggtaatggtaagagaaacatcccaactaattaatgaccatgctttgcataataattaaacgagggcatatgtattaagagttaattcgaaattcatagttagagttaaaaattctgtcaaagtcgttttaattccaaacaggtgcgccaccaaaaagttaaggcagagtttcgatctcaaaattttgaaaatccttatttcagccataaaaaatcttcatttgtcactaaaatacctgaaatgaaaaatccggcgctagtgtctaaaagaggactgttttgaaaattttgcaccttttttggtcaatttttttttgtttatttaaacacataatgatgaatattaagcataacaaacacaattatggcgaataaa

SEQ ID NO: 60847 - DNA, 2555 bp, Heterodera glycines
  Genomic contig location: Contig_ID=SeqID_6241; Location=955..3509; Strand=-
  SCN-specific regions: Sequence locations=1-672,697-766,788-980,1002 -1010,1032-1149,1171-1343,1365-1455,1477-1609,1631-2442,2466 -2501,2523-2555
tttgagctttttaatccatattccaggaatttttactccatatttatgccatatttgatgttttttagtccatctaatttcgagccctacttattaaaattcactaattataaaaaaacaatcatttttaaattagtttcaatggcgatgagttggtggaatctgcctttgaaaaatgccgcatttttgtgttgccatgccctcgtgcaaaattcactgagtttgaggtggctttatccctttttgaacatccaaaaattttcatagttcgatttaatacggaaattcatacactcgggtggctctgtgcttgtaatgtgtgccgagggtggggagcagcgcaatggcaccaacatcaattttctgttggaagagtttggcattgcatttaattcgggtagcaaatgcgtcgatccctgcccattgtttgtgcctttccgtcagattgcgtcattcggacaatgttccacaaatatttcgatcccaaagaggctttggtgcccaacggagtgattaatcgcgcaatcccttcggccgcgggcgttcaaaaggcaattagccacggaagagaagccgaaaggaacagaaaagggttgccgaaagagcaaatgcaacagcaaaaggcggaaaagaggagcagcgcatttggacaaaagcttagaagggacggaaacgacgacgacgacgaggagacgaacattcggtgcgggagggggcggggaatgttgatcaattaaataattaattgggggggggcaaagcggactaattaaataaattaattaatgtaattgatccaataccactcactcatgcggacttttgccctcctttctcagttcggcattgactttcgtttatcctttcggctgcactttgagcgttgaccgtcgctccgtttgtgtgctgtccacgggcactgtgtgctacccaatttcacgaccaatttgtgcatttcacaaagttcaaaaagtaaactaacaaataaatgatcaagcacaaataattagttgttaattgtttttccatttataggagaatggttgtggcaaattggctgttgtcggtactttttccccgattttccaattgcctttcatttttcactttcccccccttttttctttaggctccgttcaaatgttcaccgaccctttctttggcaaagaagataatgcaaagatatttgtaatattctaaaccgcaaaagcattaacaaaaatataattaggaagtgattgtcaaattcctttccgatggctttgaattgaatcaaatcgatgccgccgaaccgaacatttcggacttccaccaaatccccgacaatttacaactttcgagtaaaaaatatatatttgggaacaatcgaaaaaaacaactcaaaaaaggccaaccgaaaatgtgcctgcaggaaagtgaaatagagcaaacattcactggcgacatcaccaaactgttcgacacttctctcagctcaattagcctagagcattggcctgaagccatacggtaggtgtactgcagggacgaaaaacatgctagcggactgcacccttgtcgaatggtgtgattcatctactgtatcaattcattatttgttaaagtgtccaatttttaagttctctctcaaagtttgttcgataacagtcaaaactgaatgaatttttacagtatgaatcggtttttaccgtattgggcggggctttgctctgtgttcgttctttctctttatctgttgtcaaagtttgtatgacaaaatcggactgaagcatgagcctctgactttggtctctccggcattccaagtgccaatgccgccctttgcgcctgccgtgagttcaccgttcgttggctgacaacgaccttcgctgacctcttcagatttttgcgccggaatttcgtgagttggcaccgcttcaattggaactgttcgatttggacgacgcattcgccacccacgaaattcaattggcacagctaacaaatcgatgtgacggggcgagggaatggccaaaggaccgaactttttgttaaggcgcggaaaatgaattggatttgtacattcgcgaggcgggagagattttggacattaacaaaacacttttgcgaagtgagcgacggacggagggaaaaataacggccaaaaaagtgatggaatacgtaattctgcacattatcgaatggaagaaatccacgggaggaatggttggtagcaattcatcaacagttcaaacaaaagcggcttaaaaaaagaaaaagccaaaaatgggaagggaaatgcccaaatttaagatcttttactagctttaaatgtttccaacaaaggtacttctaattattgggattcgaactttttttttcacttgtaaattgtacaattacataacgttgagtgtttcattaattgactactttaggacgattccgacgaatttccttctgcctttttgaccgatgaaattggcatgccaatcgaagcaaatgacagaaaagcaacggaagacaaagaggaggaagaagacgcattctcaaacatagaccaatatgacgatttg

SEQ ID NO: 60848 - DNA, 1090 bp, Heterodera glycines
  Genomic contig location: Contig_ID=SeqID_30442; Location=245..1334; Strand=+
  SCN-specific regions: Sequence locations=1-54,96-116,142-252,277 -392,414-758,788-796,829-1090
atggtgctcaattggaaaaactcgggatttctggcattcgttgcctgacgctattttttagataaaagacattttttaaaaccaaaattatttcccgatttggaagtaataattttaaacaaaagatttttccattattaattataggactcggcagaacgattttttactccaaaaccaagtccgagtgtttccgattggactttttcgagtgaaatggtacggtgataatcaattcaatcatttttcacttttttaaaattattcataaaataattctttaggcaaaaaagaataataaagccggaattaaaggtaaaataaatttgaaaagaaatttaaatcagcgaaacttttgagaggacactgcgcaacagcaaaggtcgatttggggtgatttgaagaaatggatgaaaggtatagtcgtaaactgtaaacatttaccgttaattacatatttaacagtttcagaaaaaaatctaatccaaattaagtgattaaataaaaagaaatgcttttccttttaattttgaaatgaaatttgattgtttttttttaatttagcggacaccgagcaagagcctgtcaatgagcagcaaagctattttgatcaattgagacagctgatttttgatacccccgaattcgctccccatggattggaaacagtgaaagacgaagaacaaacataaagcgcaatgaatacgacgatcatttttaaacattccattttaccgtaagaagtggttacgatagtttcaagagtttatttatttatttgttgagaaaattttaccctaatttggctcttttaaaataataagaaaaacaaagtaatttaattctctctaaatcagtaggacaaagacttttaagcacaaaaatgataagtaaggacttaattagcatcaatattactaaattaagcacaaaaaaacaattaaggaaaaaacgaaaaaacattcttagaaggtatatttttttgaaaatgaaaggttgatccttaagggtgaattttttgttcatttatgttaagaaacactaccaagtctgaaattgtttggacttcggaaattgttaaaaaataata

SEQ ID NO: 60849 - DNA, 223 bp, Heterodera glycines
  Genomic contig location: Contig_ID=SeqID_30443; Location=1022..1244; Strand=+
  SCN-specific regions: Sequence locations=1-175,197-223
atgtctctcatgcgtcaactgctgacctttttgtccatcattttgctgctgctttccctcgtcactttgtccgatgctcaattatttggcggatggggtaatttttacataaatattaagatcaaattaaaattttaaccaaaatttattgtcaggatggaactccggcatttacatgcctggcttttactgtgcacatgccaaagtgtgcggataaacaaaa

SEQ ID NO: 60850 - DNA, 1828 bp, Heterodera glycines; identical to SEQ ID NO: 30444
  misc_feature (29)..(29): n is a, c, g, or t
  Genomic contig location: Contig_ID=SeqID_30444; Location=1..1828; Strand=+
  SCN-specific regions: Sequence locations=1-396,432-517,540-829,854 -860,956-1153,1198-1828

SEQ ID NO: 60851 - DNA, 828 bp, Heterodera glycines
  Genomic contig location: Contig_ID=SeqID_30445; Location=90..917; Strand=-
  SCN-specific regions: Sequence locations=1-828
atgagcgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggt

SEQ ID NO: 60852 - DNA, 502 bp, Heterodera glycines
  Genomic contig location: Contig_ID=SeqID_30446; Location=273..774; Strand=+
  SCN-specific regions: Sequence locations=1-124,153-256,278-293,315 -387,409-424,446-502
caagttttttacaaccacttattgccaatttaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctgcggttctcggcacagcaaagcactaatacggtgtttgactcacttcaaaaaataattcattacccaaaagttttttacaaccagttattgccaatctaatttcttgcagattgaaagccatccattgcctgccggttctcggcactgcaaagcactaatagggtgtttgattc

SEQ ID NO: 60853 - DNA, 338 bp, Heterodera glycines
  Genomic contig location: Contig_ID=SeqID_30446; Location=816..1153; Strand=-
  SCN-specific regions: Sequence locations=1-99,124-124,154-338
taggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcactaggcgattggaataaatggacaaaaaagcaaagtcaaagacaaaaccttaaagcatagtcgattggaataaatggacaaaaaagcaa

SEQ ID NO: 60854 - DNA, 439 bp, Heterodera glycines
  Genomic contig location: Contig_ID=SeqID_30446; Location=1161..1599; Strand=+
  SCN-specific regions: Sequence locations=1-439
gtgctttgcgttggttggttggcgtgggtgagtgtggtggttgggccgtttttgcgatattgtggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctaagagttcgtggatcggaactccttgcctggggacccagtgt

SEQ ID NO: 60855 - DNA, 897 bp, Heterodera glycines
  Genomic contig location: Contig_ID=SeqID_30447; Location=737..1633; Strand=-
  SCN-specific regions: Sequence locations=1-30,52-897
  Gene Ontology: Cellular component=mitochondrion
gaccggaaaatctatcagtacatttttaaaacagttctgtagcattaagtagtgtaaacaaagtaaaattctgtaagaacttcgttgaaattccgaatcccggaaccgaattcgaactaaaagtcgaaagtccaagtttcaattttacccgttttttgttcaaaatcggttgaaaaacacggaaacaaaactgaaaggcaccaatcctgcaataagagattatttacgcattttagaaccaaaaatgggtaaaatttaaatttgtatttcgactttttatttgtgtcaggaattcggaattgacgcattttccgggagctgccgaatattctcacccccccccccccctttttttagctaatgaacaaatgccgccgcgggtcgctgtcattaccttccgtagccgctccgaattggtcgaacagctttttgttctttcaattttattttaattgaatataattggtattttttccttcttccgccttaggtgcaaaaggcattggacgcgttggaggagaaaaagctgatcagcgaagtggaacgcgcaggaggcgcgggctttaaagtgttgcgctgtttggagggggccactgcttttgtttacgccgcggggggcaccaaaaaatgggacattgccgcgcccgaggcattgctaatggctgccggtacactttttagaaattgttgttttttttacaacaaacagttttttgccacttttaggtggcactttatcggatatgtccggccgacagattcgttacgacggaccctccgttcagctggcaaacagcgggggactgcttgcgaccgcctcgggcgtggaccatcaggtgagcgggcggaaaaggaaaggactgcagtagtatagggacagaaatctgggccccccct

SEQ ID NO: 60856 - DNA, 530 bp, Heterodera glycines
  Genomic contig location: Contig_ID=SeqID_30448; Location=675..1204; Strand=+
  SCN-specific regions: Sequence locations=1-23,45-67,118-173,195 -296,318-330,358-443,466-530
atgcgcaccattctcttcatagccatggtttgcttgctgatggctgtcctaatggaaatgggtgggcaaaaatattttattaaaattataaaaaaatttataaatttattttttttagcaaattcaaaggctgtcaaaaaagacaacaaaaaaggtcaaaatgaatttcaatgtattttatataattaaatattcccttaaaggagcagtggcggcatcaccagcaaaaggaaaagcatcgccaaaaggaggcaaaagcccagcaaaaggaaaagcggcaaaaaaattgaaacctaaaaaggatgctaaaggcattaaaggtggggagtgaatttaattttaataattttaaattttgttgacattttgaaacagctaaaaaagcaaagccagcaaagaaaagcaaagcggcaaaagcagtaaagggagcgcctaagacaggcaattaaataattaattaattatgcaattaaatagaaaatgtagtcaaaaaactcgcatttgccaaaacagcagcgcaagtgaaagaa

SEQ ID NO: 60857 - DNA, 1101 bp, Heterodera glycines
  Genomic contig location: Contig_ID=SeqID_30451; Location=81..1181; Strand=+
  SCN-specific regions: Sequence locations=1-18,40-44,222-449,471 -603,625-830,852-1101
gttatccccctccttttggagagcatgagaaagaggagaaggatgatgagaaagaaggaggcgaaaaagaagtcgaagaagctggagatgaagaaggaaaaggggagagggatggagacgaccagcagggcggtgaagagaggcggaagaagaagggcacgatgatgacgaagacgagagggttgattaagaggaagagcaacaagaagaaggagaaaaagtaacaaaaaaattttaacaattccgttgcccaaatgcgtggttttcatacaacgaatcataattcggtcaaatgattttgtaaaaattataataacataaaatcagtgccaacgtccaaacccaggaaatgttgaaaatgaggaaattggcactgggtactgcctgctggggctcaccttttggtatgtttattgctttgtttggggctagttaaagaccacaaacaacttgggttaacacttattttttgtcccgatttattttatttaactctgatttacataaatttttgaagtttgtttgcataattaggtttttggatttggcggcaccacccaatgctaatgacaccgcgacaaatgccgaacagagcaacattgcggtcaaaattaaccttgacgggttcgtcttttaactaattgtctgatctaagctataaatataatttctattttcaatttaaacagaaaagcgcttaagcaattaactgtgccggagttgaaatgtgaaaaagaattgaacgtcgtccataagtagtgaagaaattaattgatttatgagaccctttaaatgccatcctcatattgacttgttcatttttttgttataatttgaattttaaaatacaattcaaatatgcagatttttactttttaatgtaatttaatttctctcaataattgaaacaataacttttattcataattttctgaaatggggattgattcttaaatttagcgattttttgtttcaaaagtataacaaatataattgagatcaataattaaactcattttgaaaaattatttataatcaatcattaacacagaaaaatgattaaattaaagagctttttgttcttgcgcatttgactgaata

SEQ ID NO: 60858 - DNA, 1462 bp, Heterodera glycines
  Genomic contig location: Contig_ID=SeqID_6243; Location=114..1575; Strand=+
  SCN-specific regions: Sequence locations=1-141,163-380,405-616,638 -861,883-905,935-979,1001-1462
  Gene Ontology: Mol. function=zinc ion binding; Cellular component =cytoplasm; Biological process=signal transduction
atggatgacgcggaaaaaccgttagaaattatttcactttgtccgaactgtcacgaaaatggtacaaccaaaatgattgttatcaatattccgttttatcaccgtgttattgttatgtctttcagctgcaatcgtaaacatttattaattaactaatttattgttttcttttagactgtggacatcataatagcaatctccaatcaggggaacaagcgcaggttattaataagatgcaatcccgaaaacccgtaaaacaagtttctatgacattaaaattttgggttttttattcgaaaagggcgcggagcgccatcggtagtattacggttaatttattaaggtttttttatttgtctttaattaaggaatttggtactgaaattgttttgaaagtacaaaagctcgaagacctaaacagaacaattgtgcgttcggagtacggaactattcaaattcctgaattggaactgacaatcccagctaaatcacgttctggaggtaaaaacaaatgacattattgttgggaacatgaaaaaatatttgctgcagatttaacaactgttgaaggagtcgtacaatcagtgagagaggacttacaacattttcagcccgagaggaagaaaacggagccaaatacagcggaaaaaattgaccattttattgggcgactgtccaaacttctttccttgcagtcaagttggaccctggtaagaaatagaaaatgaccaaagtgcgggattttaggcaaaggtcacgaattggtgttccgacgaaaaaagtgttaaaaatttcgcagctattttttctgggcttaaaaaatgcgctgatcacgaatctggactcagattttgaaaatcattgatttttatctatgatttttcatcaactagttaatgtttcgcatttttaaaatttattttacaattaatttgggttagaaaaatgcgctgatcactaacccatttttttaaattcgtattttagttgtaaaactgatttaaagaaacaaaaataattagacacaaatcactgcaaaccaaaattttattctatacagattcgaacataaatatgaagtggtaagcgacctaaaaataacctcaaaaactttaagaaacttcgtgatccctctgggaattgtttcatccaaaatcccgacccgttccacgtcgaccctcgctgcatcacaagtcattattatcggcgattggaagaggacaaattactgggactgatcgatgacgatgcatatgaaatacaaagtgcaaagctttcacaagatgaagttgatgaccgggaatggaagtcatatgaagatgtgaaggctgaagtccttcacttctccactcaatgctcggcttgtggcgcttcttgtgacacgaggatgaaatcgactggtaatttttatggttttcacttggtttgccttcacttgaaaagcactaaaggaaatgaatga

SEQ ID NO: 60859 - DNA, 696 bp, Heterodera glycines
  Genomic contig location: Contig_ID=SeqID_6244; Location=423..1118; Strand=+
  SCN-specific regions: Sequence locations=1-618,641-665,689-696
  Gene Ontology: Mol. function=zinc ion binding; Cellular component =cytoplasm; Biological process=signal transduction
atgtctacggattgcgatatctgtggcttcaaatcgaacgaagtcaaaagtggtggtgcaactcaggaaaatggatgtaaattgatattacgcattgcagaggtaaaacgaccgcgttttatgtaaaaattctaactccaatttttaaggctgccgacctttccagggatttgcttaagtcggacacatgtcaaataattatccccgaattggacatcgaaatgggtcaaggagtactgccaagcagattcacaaccgtcgaaggtcttttgattgcaataaaagaacagctggagagacaggcgcctttttttcttggcgatagtgcaacagaggaagaaagaacaaaattccaaaaattattggacagattaagagatgcgattcagattaaggagccgctaacgcttgttttggatgacccagcggggaacagttacctccaggctcgttttcttgcttattcatttatactttttgctttatttcagagcctaactgaccacgtggaagataaacgtcttcaaaaagagttttacaccaggacaaatgaacagaatgaggaattgggattgaatgacatgaaagtggacaattatgaggagttagaaacattgaaggaagatgatgaaatggatgacagatagcatttactcttaaaccgatctttgttttttgttttgatattgatgataa

SEQ ID NO: 60860 - DNA, 404 bp, Heterodera glycines
  Genomic contig location: Contig_ID=SeqID_6244; Location=1270..1673; Strand=+
  SCN-specific regions: Sequence locations=1-4,26-129,153-182,204-404
  Gene Ontology: Mol. function=DNA-directed RNA polymerase III activity; Cellular component=DNA-directed RNA polymerase III complex; Biological process=transcription from Pol III promoter
gtggttaaatttagtcccacctgtggcacaattctgactctctcagacggtaaggattactgcaagcagttcagctgtggttcttgctcctatacattgccaatttccaagaaggttttggcttcatttattccttttatatatatttttagctgacaagcagaatatacagcaaaaagaaagaagatgagaagataattgggggcaccgaaatgtgggaaaacgcccaagtgacaaatggtctgttaggctcaaagcagagaaaatgcgcatttgtgtgttcagagcgatgcccaagttgttctcatgacaaggcctacttccagcagatacagacgaggagtgccgacgaaccgatgaccattttttatcgatgtgccaattgtggacacagatggaaggag

SEQ ID NO: 60861 - DNA, 80 bp, Heterodera glycines; identical to SEQ ID NO: 51817
  Genomic contig location: Contig_ID=SeqID_30452; Location=515..594; Strand=-
  SCN-specific regions: Sequence locations=69-80

SEQ ID NO: 60862 - DNA, 54 bp, Heterodera glycines
  Genomic contig location: Contig_ID=SeqID_30453; Location=930..983; Strand=+
  SCN-specific regions: Sequence locations=1-54
atgtatatgaaaatggtagccaactatctaaatgggtcaagcccagtgtcagcg

SEQ ID NO: 60863 - DNA, 332 bp, Heterodera glycines
  Genomic contig location: Contig_ID=SeqID_30454; Location=346..677; Strand=-
  SCN-specific regions: Sequence locations=1-61,83-97,119-137,159-310
gatttgccggtgataaagactttgtaatgatgacaatcaaaaataaatttccgagaacaattattctagaagggttaaaagcagagaaagatagtggaattgaatggaatgttgaacaattaattaagggattagaagagataataaccatgagggaagaagcaatgagatgtaccaaaataacaagagcaattggtggacaacatgaaaactgggatagtggacaaagacaattcaataggccaagaagcaattggcaaaataatcggtacagaaataataacagagaatatattaaaagagaagaaagaaatcctcaaaataatcaaagg

SEQ ID NO: 60864 - DNA, 388 bp, Heterodera glycines
  Genomic contig location: Contig_ID=SeqID_30456; Location=702..1089; Strand=+
  SCN-specific regions: Sequence locations=1-388
atgcgcatcacagaagggcatgacaccgtatgggttgaccaggcaaattcgaatggactgattgagaaagaagcgatcagaaagtgatcgaagagtgatcgatcagaatcgattgacacaatgataaagctggacagatggttgaaattgataaatgctaatgaatgaatgatattttgtctattaatccagcgttgggatcgtccaaatcctcttcccaagtacagctatgccaattgacaagtacatcacgggagaaatttgtgaaatccaagtacataatacaaaattttattaacacgttattataaaagggagaagtttattcagacgtccgaaatatatagcaaatatgtataaaaactcccaaatatgtaaacatatgtaa

SEQ ID NO: 60865 - DNA, 1402 bp, Heterodera glycines
  Genomic contig location: Contig_ID=SeqID_30459; Location=36..1437; Strand=+
  SCN-specific regions: Sequence locations=1-232,254-618,654-1402
cctgttctacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcgatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaa

SEQ ID NO: 60866 - DNA, 367 bp, Heterodera glycines
  Genomic contig location: Contig_ID=SeqID_30460; Location=51..417; Strand=+
  SCN-specific regions: Sequence locations=1-226,248-367
atgcaggctgggacaacccagatccctggctttggccagctatacattttggacccagtcgaggctatggaaatgcgtcgaaacaaccccatatttactggggaaaatgttaaaaacgaagatgcgtttgtgcagggtcatgagcttaatgaagcgaccctagagcttttggtagaaatgatcaaaaagtatcaccctgctgcgcaagcatataagcaggcgcgtgagcagctccaggagctcctcaaaaaacacaacccggaagaacttcgcttcttccgtatgactttgttgaatgagcgcagaacccctgcagctctaaaagacccaaagctccacccgcatcaaataatcaccccttcaacgg

SEQ ID NO: 60867 - DNA, 2528 bp, Heterodera glycines
  Genomic contig location: Contig_ID=SeqID_6245; Location=120..2647; Strand=+
  SCN-specific regions: Sequence locations=1-82,128-233,269-317,339 -481,503-532,554-1426,1448-1509,1646-1844,1866-2198,2239-2528
cttccccgcaacaattagtggaaagtgccgccaacaatttgccgcccgcggcgatgaaaaagccaccacattttgtgccgatcaaaccaaatcaccatcatcatcagcagcagcaacagcagcaccctgttgttgaggagaagttcaagcagtacatgccgtcttcatcatcatcgacggcttcctccgccacttcgtcccctgcggcgatgccaccaccagcggtgacgccgaataatgacaacaacaacaacgacggcggcggcggtcggcaccaaacgaacgcgacgacggccacgacggcactggccatggtggcggacgagtacgtggacgtggtgggcgacggagcggagggtcgcagctcgctgatgcgacaccagcgcaaggcgcacatcgaattctacaggtactgtacgggtggtacggtatggtacagggtacagtagaatgtacacgaaggttaagagcagcagaatacaatagaatatgtagaaatgtgcagagtttagtaaagcacctgaaggacacgttacagtagaagaaatagtttgtgcggtaatgaactactgtacattaggctacaggagtacatatgttgaaaaatttttgagttacatttattataaaattgaaaaaaatttccaaaaaaaaactaacctagttttccctctaaatttcctgcgtcgcggatactatatgtggttagaaaacaggaatattatactataagtatgtgattttatgtgatactgtaggtgaagttaatgtcgacctttcccccccccccaaaaaaatatccagaaattttaaattttttttcagaaagctgaaaggccttcgcagtcgaggctccacgctagactgccaacagtgtggccaaacggtggcaaacacggacgcgtgcgcacgctcgcatttgcacgcgcattgcgacgtcgcgcagttcgtgtgcaagctgtgccagcgcgggttcaccgaccagcacttggtgttcgagcacatcaacacggagcatccgaccaaaaaagtgtgtgcttgggaccaggcctggcctggaccaccggaccgtaaactgatggatttccaattacggatgtccatgatccgtaattaaaggcatttttcaattacggaatttcgctgaagccgtaattacggggggcggcaaaaatgccgtaattagagattttgcgtccagcccagcttggggacaagagtcagtcggtttgactcgagaattttcgattagagccccaatactgagatttcagcacgagaatcgagaccaagattctcaaataatctcttcttagcaggccaatttgatcaaaataaatgaccgattgaaaaatcggtctgatcaatcaaaacacaaaagagattgtttgattagcttctgatcaacaaggaacaagaaatcgatcagaaagatgattttggaaaagttctgatcagaggactgatcaattagtcttacaattagtcaaaaaggcctagggattaggcatttaaaaaaataaatatatttttacaatttaaattttaaaaaattttccagaatttaaaaaaatttaaaatttttaaatttaaatttttaacttttccagaatttaaaaatttacaatttatattttgaaattttccagggcacccaatgcattgaggaccggcgcgacatggtccagctgatgcaactgctcacggactgtttcccgcgcattgtgtgcaagaccaaggacgcaatgcaggagcatctagagcgtttgctgagcgccgacacgcagaaacttgctgctgctggtgatgccgtggcatgcacagccgctgcagaaccaacggtgtgcagcaacaacagcagcgatgtaaacagctctactgttggtggcacgtcgtcaatgcagtgctgccatctttgcgtgagttgggcgcgcataaattttttttctacatgaactcattaaacgccttttatagaaagcggacgtgccatcagaacgcacagcactgcatgcacacctgaacgcgcatcccgcattcaggtagcagcgcacactgctgacttgcacaatcacgcacgcatttctcactcttttcagatgcaaaaaatgcaagtttgtctgcatgtcacacgcagagcaaaaagaacaccaacgggttgagcacgggctggacgatgaagtgacagcaaattcgagtaaaaaaaatttttaaaaatatatttttttgaaaatttttcttcaggccaactgccctactgcgtgtccagcgcgcttgaggtgcagtacgacatgctgcgcgcatgctttccgctccaaaaccggcaacagcagcaaagccatagcgcaccaccaccggcgggtgagcatccagcaactgcagatgcttctgttgcggtgtcacctccagcagctggcgcaaagcgcaggcgcaagacgctgaagccggacgactcggcaagtgcggcgtgcggtggcaaacaaaagcggaacaaaaagtgcagcaccgcctcctccatcgaggattaa

SEQ ID NO: 60868 - DNA, 1293 bp, Heterodera glycines
  misc_feature (1147)..(1147): n is a, c, g, or t
  misc_feature (1266)..(1266): n is a, c, g, or t
  Genomic contig location: Contig_ID=SeqID_30463; Location=43..1335; Strand=-
  SCN-specific regions: Sequence locations=1-387,427-962,984-1293
atgcagaggaaaaagtatgagctggaagagttggaacgtgctgctgaacgtcgtgatcaggaaagtccggagaatgagcaaagaaagattagcgattttttccaacatcatcccgaagattataacaaaaaattgaacgagtcaagacttatattcacccaacatctctcggggctgcaagaggtgatgagcaagtacattggtgaaaaagatataaatgaaattcgtcagcttaacaccgaggttggcaaaatacgcacaaaaataaaacacatgcagcacaatttgaccatctttgaaaatgctgcgcttcagcgtgaccaccaacaatctttgtcggaatatgaggagctcagccaccagcagaatagtgcatttgttgaggaattttttcaaaaacatcccaaaaattattggcaaattattcacaacaattataggggtcttacagaacattttcagatgcaagcaaaggcagtagggttaaaggataatgcctctttcgaaaaccaaatagatcgagcaaaacagctgattgagtacagacgaaagagattcgctgcgctggaatttgaggcaaaaaagcgtgatgagcaacaacagtttgttgcagcagcagcaaatacaattactgcaccgactgcgtcggcattgatcggaagggaggcgttaaaaaaacgtacaggcatctctgccagtacggatggtgaagtaggtgataaagcagatgtcggtccacaaacagctaccacaacaacacatggggaggtattaaaagagaaaatactggagcagcaaaaacacacggacaacgatgatacagcagatgccggtccacaagcagctaccacaacgcatggggaggcattacgtgagaaaatattggagcaacaaaagcgcacggacgatgatgataaagcagctgtcggtcagcaaacaatcccaacagcaacaaaaacacatggtgagacgttaaaagaaaaaatatcgcaagagcagaagcacctagttgacgataagtcaaattctgccaatgcaaaacaagatgatggtagcggtactgatgagaaaatcgcgcatggtcaaacgctaattgcccgacttaaacagagcgaggagcagaaaaaagaatggggggacccacccnccagatataatgatgatgatgggcgagcgccgaagcatggagaaatgctgtggaaaactgtgcgatcaacggtgccgactaaccaacagcaaatgggcgatgtcatccaccaccatttngctgatgctgaacaaacccgtggacag

SEQ ID NO: 60869 - DNA, 61 bp, Heterodera glycines
  Genomic contig location: Contig_ID=SeqID_30463; Location=1546..1606; Strand=+
  SCN-specific regions: Sequence locations=1-61
atggccagaagaaaattgctgctgctgctgctgatacacctcacgtatgaggctgttcagg

SEQ ID NO: 60870 - DNA, 436 bp, Heterodera glycines
  Genomic contig location: Contig_ID=SeqID_30464; Location=147..582; Strand=-
  SCN-specific regions: Sequence locations=1-147,169-436
atgggagccgatccaaaaacactcgggaaatgggtaaaaaagttcagatgaattcgaacaaaagtcgaaagttcaaattctcgaatctcgcatttttcgtctaaaaacggcttaaaataatttttattgcaggaaatgctggctttcagtttgtttccatgtgtttaagccgtctttagacgaaaatgcaaagctcgaaaattttaattttcgactttttgttcgaattagggtccgtggttctaaattgatcgaaaagggtgtcagattggtatttaacgtgcctgaaaatccccatagacaatgctaccatgtacactattaccaaaaacattaattttatagaaactaaccggcaaattctcctgaattgatgatgataattgatccattaaaaaagtgaaagaattgatatgtattctaaaaaatgaataaa

SEQ ID NO: 60871 - DNA, 606 bp, Heterodera glycines
  Genomic contig location: Contig_ID=SeqID_30469; Location=302..907; Strand=+
  SCN-specific regions: Sequence locations=1-62,86-137,159-160,186 -327,362-382,424-457,490-536,582-606
atgttcagctttcgcataaggtcagaccaataaaacttggtctatcaagaaaaagagtatgatgtttttgtcttaaaaattgagggccgaaaaatttcgacaaatcaaattccaatacgtttaaatcttaatactacaaaaaaataatatttttttttccaaaatttcccccaccccctttttaggcatacagttcaaaagaacatatccaattggagccttgggcatcaattgaaattgatggagaaattgataatgaaataaatcgggagattgattggaggaatcaagcagcttcacacactgattgcctcttaaaatatggagtaattaaaaaataataattaaattgatttaaatagcagcagacaaaaattccaagataattataattgaattaattaactaataattaattaaatagcaccacatactaattgccttttaaatatggagcaattaaaaaaattaattagatttatttaaattgcagcagacaaaaacgccaaataactaacatggtttcggaactttactttaatttattattttttttaattttaaaaaaattagtttatattccagttctttttttcctttttttaa

SEQ ID NO: 60872 - DNA, 1418 bp, Heterodera glycines
  misc_feature (68)..(68): n is a, c, g, or t
  Genomic contig location: Contig_ID=SeqID_30470; Location=53..1470; Strand=-
  SCN-specific regions: Sequence locations=1-193,217-373,395-401,423 -576,603-1318,1340-1418
atgtcaaatttgttttacgttcttttacctagtgactctcctggttatgacaataagcctaataaatntagggttcatttgcctagaactctaacttttggaggtcaatggttgtgtgggttgcacagtataatttatacaaattcttggcccgccattggtaccacagagaaccaatggattaaggtgcatttaaaaaatggtgataaaataaaaattgatattcccgcagggtcataccaaaatgagcaagaattggaaaatgctataaatgagtcgataaaaaatggtataaaacaaccggctacaagagttaaaagacaattggaagatggagtggatttgttttttcattataatccagatgattactgggaaaaaattgaggaagaaaggcaaagatataaagaattgttaaaattgatagtgacaaagtcaagagaacgtgatgatgaaacggacacgcataggaagagaaaaatagaggatgaggaaattgaccctctccaaaatcaatcattgactaagaaagcaagaatagaggcgcttgaagaagcagcaaggcaaagagatgacgggaaggaggaaaaggaggagagaactggtcaagaattcctcgaaatgtatcctgttaactatagggagaaattaaatgaagttcgattagaattaataagagatttattcaacattcaagaccatatgaaaaaataccaaggagtaacagatggtagaacaattcaagaactaaatgaaacaccactaaagatgagaacagcaatgaaacacagaagaaaaaatttgaatgcttttaacaaggctgtattgaaaaaggatttacaaatatcagctgaagaatatgagaggacgagctatgaacaaaataaggattacgttgagccattttttgatagtcatccaacagattactgggaacatattcataaaaaatatgaaggccttcaagacgattacaaaaaaattcgcgaattaagagaacaacaacaatttttgactgatgaacagaaaaaacagtcaattcaggatgaaattgatcaacttcgtcgtcttgtcgattataggaaaaaaagatttgcagcgctagagtatgaagctaaaaagagggacgcactccaacaacaaccaatggctttagccttgactcatggtgaagcactgaaggaacgaataggaaaaattgagggaactaccaccacagcagacggggaagagacaaaaactcatggaaaatctttggttgagttaatagaacaggtacagaaagaaagagatgatagcaaggccaaaactgagggtaagacacgaggagaaattttaggagataaattaaaagccaaaattgatgaacaagacagtagtgcagatggtaggagcatggtgaagcactaaaaaataaa

SEQ ID NO: 60873 - DNA, 623 bp, Heterodera glycines
  Genomic contig location: Contig_ID=SeqID_30470; Location=409..1031; Strand=+
  SCN-specific regions: Sequence locations=1-460,487-623
aagttgatcaatttcatcctgaattgactgttttttctgttcatcagtcaaaaattgttgttgttctcttaattcgcgaatttttttgtaatcgtcttgaaggccttcatattttttatgaatatgttcccagtaatctgttggatgactatcaaaaaatggctcaacgtaatccttattttgttcatagctcgtcctctcatattcttcagctgatatttgtaaatcctttttcaatacagccttgttaaaagcattcaaattttttcttctgtgtttcattgctgttctcatctttagtggtgtttcatttagttcttgaattgttctaccatctgttactccttggtattttttcatatggtcttgaatgttgaataaatctcttattaattctaatcgaacttcatttaatttctccctatagttaacaggatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtttcatcatcacgttctc

SEQ ID NO: 60874 - DNA, 316 bp, Heterodera glycines
  misc_feature (96)..(96): n is a, c, g, or t
  Genomic contig location: Contig_ID=SeqID_30471; Location=63..378; Strand=-
  SCN-specific regions: Sequence locations=1-233,278-316
atgtttcactcaacatatgaactttcgtttaaagacgccgccattatcaacaaaatttattgcaacggtagatcgaattaattcatacgatattgngtataattaattgtagaaaattgcaaaaacaccgaaaacaaatgccaaaagggaggatacccaaacccaaagaattgcaatcaatgcctttgcccggtgggttacggcggcgaaaaatgcgaaatggttgaaaatggtaaaaaaattaaaaaaattaaaatgataaaaattattaatatttcagatggaaattgccaaactgacaggggcaatgaattga

SEQ ID NO: 60875 - DNA, 147 bp, Heterodera glycines
  Genomic contig location: Contig_ID=SeqID_6248; Location=2045..2191; Strand=+
  SCN-specific regions: Sequence locations=1-147
atgaacttaccagccgaagagatttgggcggcacacgaaggctacatccagtcagacacaacagtggaagaagtggcgcaaatgttctaccaagaacaagttgcagataacggacgacaaatcacacgagatcagtatttgaccgag

SEQ ID NO: 60876 - DNA, 232 bp, Heterodera glycines
  Genomic contig location: Contig_ID=SeqID_6248; Location=338..569; Strand=-
  SCN-specific regions: Sequence locations=1-232
gatcaaacgacgcttttcgcccgaggcggtggacaccattttcgagacggacgagacggggaccatcgattggattccgatgctgatcagtgtccagtgctggcggcgactcgtctttgaactggccgagcagttcccgcactgtctgatgctcaccttcgccatcaaattgatcagtgacgcgggcttccaacacgaaattagcaatgtgaacaccgcggcacagcaagtg

SEQ ID NO: 60877 - DNA, 108 bp, Heterodera glycines
  Genomic contig location: Contig_ID=SeqID_6249; Location=13..120; Strand=-
  SCN-specific regions: Sequence locations=1-108
atgtccaacgcttcccgagggcccattcctgacgatgtcgccacggtgcctacacgtgagattcacctcaactcgccattcaacatccggaccatctacaacttccgc

SEQ ID NO: 60878 - DNA, 2940 bp, Heterodera glycines
  Genomic contig location: Contig_ID=SeqID_6251; Location=391..3330; Strand=-
  SCN-specific regions: Sequence locations=1-21,43-75,104-761,783 -879,914-960,982-1152,1174-1222,1330-1506,1528-1540,1562-1753,1776 -2830,2852-2940
atgctaaggacggacaaacacttattgcttcagcttatggacactctcaaatctgatccgatgttggactttaccttccttcaggtctcctctcttctctctttcacactttttctcccttatcgtttctctttatctctccacatttttagagacttaattcttcttttaattttcagagcaattctgagctgcgcaataaaagtcgacaacaacttgttgattttcttgtgtatggaattggtcgaaaactctcgggttttgagctgaaacgtcgtcgcaacataagcagtcggaaatcgcccggacttctcaatttggagggcgaagcgagcaaagagtgccctgggaaagaaccttcgtcggctgccactgattgggaagaaataggcacggccaatgtagcagaacaggtaaggcaaaacctaatttacaataatcatatatatttaaggtggatttactggtccaagaggctactgattgggataatttggcattgatgtacgaaggatggaccgcgtgggtgtagcggttggccgatgcactaacaaaccgtatccgacaacacactggtttaccgacccttccagtgcgcttgttgttccagtcaaatgcgatttgcccgttcggatcatataaatcccttgtgaagaataggcatccggcatgttcatttgaaggaactctgattatgaaccgacaacaaagataattaatgtcatcttttgtccgattcgggttcaattttgctcctattcatttactcttttcccaccaattatgatctaataaaagtgatcaatggtttgtgttaaatgaaaaacgcgagttttactagtgctaatgagtttggtttgcaagaataaaaaaccactgaattttttaaattaatagaaaatatttatattttcgtttatttctaagcctccatcaaagacattttggtatcattcgaattggagaatgttttttatgcatgttgctgacaaataagcaattgatgcatacttgaaaatttgagcctttaaaattttcttacgttaaaacgttggccaaaaaccgagttgggtttttaccgaaatagaggctgaatttgaccccccccccccttaaaaaaatccaaaagaattcaaatttaaatttgcgacaataaatgtacattttgcttcaaaaatacttcatgcccatgttttgtagtgatgctcgagaccaaaaatttcccgagactcgagaccgagaccgagactcgaccccgagaccgagactcgaccccgagactcgagaccgagacccaaaaccccgagaccaaaaaaacccgagacccgagacttttttcaaaaattttttcttacacacttaaaaatcgaaaaaaatcaatcttttgagttttctcaaaaatttttgtttttttccttatttaagctaccatacatttttccttttcatatgattgacttttttacaccattttttgtggtgctctttttcaaaaaaatgtttcgtgaacaggggtccggcggtgccgataggcgccgccgggaaaatttttaaaaattttactgcaatttgttaacggatttggtccaaaaaatgaccaaattttgcgtctttgagctacttttttaaaataaaagtaagagttttgggtgccggcggtgccgttaggcgccgccggagaaaattttgaaatttttagtgcactttgttaatagatttagtccaaaaatgacatttttacgattttaattgttaaaattgtgtttgttaattttgaaaaatgagaagaaaaaataatacttggaggggaacgatccaacgcaaaaataagtaacaaaactaagaacacaacccgctggaccacacatatattaaaaaacttgaacaaaaaagaacctaaaatttataaaatagaagtttaccaaaggccaacaatcattaggggtgtaaaaaagtctcggtctcgagtctcgaaaatcgagacctagacttgaaaacccgagaccgagactcgagaccgagaccaaaaaaacccgagatttttctcgaggcgagactcgagaccgagactctcgagcatcactactaattgccacaaaatgaaccgacggtaaaaggacatttagacaaatttttcctttgccctgattagttttcccgcatttcagttggatttgcaacgatgtttggatggacatgttcccattttttgaccatgcccaactcggcctcaaattggcactaatttcgcctcgtttcaatgttttaattgacaaacattttgacggcaaaagcgaattgacaatttggaatgacattagaattgacaagggccgtgtcgcagaagtgccaaaattacgtgtgtttatcgactatcccaattctgttgaattcccattgccggatcgtccgttgcccaacaaaatccgctttaccaaaatttggattgagtaaatcaaaattcaatgaattatagtgtgataaaagtattcctctttcagctacatcgatcatttcgtcctcgcgtttctccgtgccaataagcaaatttttgacaaagacaccgctttgcttttgaatgtgtggaagtataacgacaacgacattgtccagccaatttggaatgttttggtccatgaaatttggccaatttttgcgccaaacatttgtcacttggactttcccgatggtgatgatttgaacaatttgcgtcgtctcatttcgcccacaattctcactgatctcaagcaattgaactcaatcaatcccgacaatattttcccagctgcaattggtgattttgatgatgagccaaatgcaactgctggccaaatgctgtccaaatggctgcacaccccgcgaaaagatggacagtcgaagcggttgttttttatggagaacaaacaacgagacttcgagtgggtcaacactttcaaggtg

SEQ ID NO: 60879 - DNA, 649 bp, Heterodera glycines
  Genomic contig location: Contig_ID=SeqID_30474; Location=354..1002; Strand=+
  SCN-specific regions: Sequence locations=1-44,154-210,261-457,498-649
atgtattttttaaaattggtgcgtaataggttcgggaggccatgtaaatattttaatataaaaattcactgaatacaaatattaagatataaattttatgttcaaaataaagcattaaatgaatttaataatgaaaatttttttagaaaaaatgaaaattgctatttactaaaaccaagtataagatttaaataagtagcaaaaggaaagaaaaaatttcttattactaataatatattttattaatattcttaaatattgcatttctatcaacaacataaaaatttttaagcttgaagtggcacttaaggaagcaaaagtacaagatgttggacgattagtaatagaataataaatctaaacaatataaaagaaaagcgatacgctcaatcggcttgcttcactttgcagccattgaacatatatcattttaaatttaaccgcgaattatcgccagtttaaatttaatcaaaattataaaatatatcaataatttagaccaaatctgttacctatatttagttaaaagacatagaaaacatttaaattacgttaaaccaattaaatctaaaatcgtttttggtgccgctatccttgtctcagcgtttttgtgggtccgaaagcgtgagtaaattaataattcttgtta

SEQ ID NO: 60880 - DNA, 333 bp, Heterodera glycines
  Genomic contig location: Contig_ID=SeqID_30475; Location=129..461; Strand=-
  SCN-specific regions: Sequence locations=1-6,29-246,268-289,312-333
atgattcaaagaacagaaaaagggacagcaattctgatagaagctgtcaaaaaagaggctgaaagggcgtggaaagaagtttcggtattggcagatgaagcggatgagtatgctaaatccgcccatggagcgcttaatcgggcaattaaatcccgagagaaggccccctatgccccgggggttcgagaatggttcgtaaagatgtcagattgtatctgggaaatttacaccattcttgataaaattaatgctgaatctgaaagggttgagacaatatggcgtgaggtcgatctgtgtaaagacctcgatcaagccacaaaactagaggataag

SEQ ID NO: 60881 - DNA, 1336 bp, Heterodera glycines
  Genomic contig location: Contig_ID=SeqID_30478; Location=119..1454; Strand=-
  SCN-specific regions: Sequence locations=1-1,90-115,137-172,405 -1209,1233-1336
  Gene Ontology: Mol. function=ATP binding; Biological process=protein kinase cascade
agaaaaggcaaagaagagagggcggaagagataggagagaaagtgagagacaaagggaaaggagaagaagaggaaaagagggatgaagacataccgacggagttcgaattggacacgagcagaggcctgggcagacatttactggagacactgtccagggagttacagtatcaggaggaggtggacacggagatcagcaagagaagacgaagagttggagcagacggaagggaaattccggaaggagtggaagaggaagagcggacgacagaggaagaaaaggggaggggaagggatgaagggagagggaaagagcagagaatcagagaggaagagaaacgaaggacggaagagcagagaatgagagaggacgtagaacggaggaggcgagaggagatgagaaggacgacaccaattgaagaggaggaagagcacgaactgctcgaaactgaagaaataacgcaacaacagcatgagcaaaaggtgagtgaacatataaaaaagtaaattagaaattaaaagctcatcaatggcagaaagcatttgacatgccattgttcgtgccaatccatcgttccgatgccaaagtgtccctttcgggcgaattgtcactttcgcccgtaagggaggagggcgaagatgaggagaaggagacgagctttgagcagaaagaggtcagtctgtcagtagcttctcctttccgtctttccagctatctttctttgcatttcgttccgtcaacttcgagcagttcaccccccccccccccttcccctcacttctcccattttattgtctgttccgtcctccgttcgtccgtcgatgagtttgtgcatcggaccatgtccgtctcctgttttgcttgtcttccccccttctcccccataaactttgtcatctctccaaagtggccattcacaaacattccctctcacccaccaaatttcgttttatgtgtgtttcttatcggcaatttgtgacgagtgttgagccacaaaattggccgattcgccgccacaatttgccagtgaaagccctccccaaagcgatggaatgtcacacattccctctgatgagcacttaataatctctccaaatagaataattcccccataaagtcgaaagaaagtacgataatcgaacagttaaaagccaaaaaggaccgtcaaaattcacaaacattctgaggaattttacgatggaacagcaaaaacaacaaaagcagcagcagatgaaccacagcacaaaacaacgccaacgctttcaacgcattcaagcggaaaaaccgaacgacgaaacggtggaaatgtccagcgacgggtcaatttcaccggag

SEQ ID NO: 60882 - DNA, 136 bp, Heterodera glycines
  Genomic contig location: Contig_ID=SeqID_30479; Location=1..136; Strand=+
  SCN-specific regions: Sequence locations=1-136
tgatcaaaataaacaatcaaaaatggcagtgatcactcgccacttgtaaattttgaattagcgcgcaaaaatttatgccacttacgctatttggtgttatgagcaattttgtctaacactgggcttgacccatagt

SEQ ID NO: 60883 - DNA, 305 bp, Heterodera glycines
  Genomic contig location: Contig_ID=SeqID_30480; Location=416..720; Strand=-
  SCN-specific regions: Sequence locations=1-69,91-305
atgtctccaagtgaaaactctgaccatccctttcaacaacccgacaatgttcaagctgttcaacagccacatgaagaacaagatgaagaagccgagttgcgtgcacaaattgaagacgcggaggaggatttgctcttgaattggtggcttgaagacccaacaattgtaagttttttttcaatttagcatttttttaaatttcatcacattttcagattcgttttttttggacaccgtcgagcacctgccatcgaagcagcacttcttcagtgcacgcacatgaggccaagatcatgcgccaataa

SEQ ID NO: 60884 - DNA, 1550 bp, Heterodera glycines
  Genomic contig location: Contig_ID=SeqID_30481; Location=109..1658; Strand=-
  SCN-specific regions: Sequence locations=1-574,596-685,707-1044,1067 -1260,1283-1550
atgagacgggaccatctcaggatattgtgggatcccagtcagtaatcaattttttggaaatttgaattgataaactaaccttaacattacattttagtttatgcctacctaaagccgcttttctttctcatggctacaagcgtgactcaattgagcattttgccgacttattaatggagcatttagcaagccttggtaaatagaataatactgcaatataatcgaattaattaatagattacgttaccttgctttgcgcgaacattactttttatggaaatccggaaaatgctgatatttatacttcggagatcgaacggattcttgatcctgtctacaaattcgtgaaccaatggtttgattctttattggatagcacatggccgacctacgagaaccttttaattcgaaacaccatgcaagacatctcgaaaggcatgatcattccggaaacaaatgcaacatatcaacaaattgtcgatgtcgtttacgaaacaatgagatttattggccatccagggtaggagattatatgcatactctcgttacctttttctctggtttcaattgcttcttataagaaaattttttagttttcataaaaccgtaaaatattctaatccttttcgttaatatttctaatttaaaaaggaaatcataacagcatttttggaattatgtagaatttacattttatttattttaagctatcgccggaaatatgtggtaacaagagaccgacgattcgatttgctcagctgggatttttggtttgcatgtcgaccaaattcatgtacaaacacaacaacattgaacgcgcgattcatttcaattcgaacgaaaacagacacaaatgatgtctttgagtcgcttcagaagctcataaatttcaaagtctcaagttggccgatttttttttccgctatggacaggttagttttagaaaaacaaagtaatttcttgatatattaaagaattttgttttttttgcttgtaaatacttctagcttttttctttcaatgagagtagaaatttttattacttttagtctattttgttttgtttggtgaaaataactaagccctataattgatccccagataaaaaaatacttaaaaaattgcaaaatttttattttcgggaattaaaaaatcaaaaaaattcccacatatattaaatgatatttgtcttgcaaaatatcgttttcagtgaactatatagctacacctttattgaaactgctattaaagtattggcgaaaaaatacggattaaatttcaacaactttaccaaccattcatcctatgttgtacttcgccaggatgtttatttatcgggttgtctgaattcgtttgccatgaaatgcaatgaagacttggacaatgcttttctacaagctttacactaccatgaggatggcactgtttttaccaattgtgaagattgggttgttattctgggcatttaaaaacttttctcgtgctctaatgtagtagataattaaatgcacgttcgccttttcttatattttagtccattcgtaaataaa

SEQ ID NO: 60885 - DNA, 113 bp, Heterodera glycines
  Genomic contig location: Contig_ID=SeqID_6252; Location=30..142; Strand=+
  SCN-specific regions: Sequence locations=1-113
aatctaatccttttgtcttaggctacaaaataaaaaacgaaaaacatgcaaaattattcgctgctgaacaattttggctaaatctgaaggcttcctgcttataggaacccaaa

SEQ ID NO: 60886 - DNA, 113 bp, Heterodera glycines
  Genomic contig location: Contig_ID=SeqID_6252; Location=451..563; Strand=+
  SCN-specific regions: Sequence locations=1-113
aatctaatccttttgtcttaggctacaaaataaaaaacgaaaaacatgcaaaattatttgctgctgaacaattttggctaaatctgaaggcttcctgcttataggaacccaaa

SEQ ID NO: 60887 - DNA, 1728 bp, Heterodera glycines
  Genomic contig location: Contig_ID=SeqID_6253; Location=190..1917; Strand=-
  SCN-specific regions: Sequence locations=1-414,438-1168,1190 -1223,1245-1314,1336-1425,1447-1728
agtgactcgtctgggccgaatcgcgtgcatttctttctctctgttcggcattccgcttacgctggtcaccattgccgaccttggcaaattcctctccgaacatttggtttggctgtacggcaaatatttgtgctttaaggtgactaatttttattgaccctaccaggccacctaatggccattcaaagagtgatctagttattctgatcaaacttttttcttcctgtagcattttgtggccaataaattgcaacggaaggcattggcacgggacggagatcgcatctgtggaaagtgccgccacagagggctcagcacagtgcgtggtggcggcattcaattggtggaggagcgcaagtgcgtgccgatttgcgacacgggttcaagcctcaaaattgctctcgaattcctttccttttgtcccccttctcgggttaattttgcctttttggattgctttttcctttaaattcgttcgcttgttcttccgatcactccatttttgttcttagaattcctgcgctgcttgtgctcgccattttggtcctctacaccgcactcggcacttttttttttgaattttttgccaatttacgaattccaaatgaatgccattccttccggtttaggtggcgttttgatgtcccaattggagccatgggtaggcacagtttcactatcttacgaatttaatttctcaccacgcacagtcaatgttatgtttagagttttttcacttccttctattggtctttcatcacaatgactacagtaattttttgctaaatctttcattaccgtatctcaccgtaaaattccctctgccaaaggtcggtttcggcgatttaatgccacgtcgagagcattacacggcactgatccttctctatatcgtcctaggtaagattcgcaacgaagtcatcctattcatttgtatttgccttacaccgccaaatgccaaattccatggcacaatttgttgtccttttggcatttccattgcttttcatgcccttccgccataggtttggccatcaccacaatgtgcattgaccttgtcggcatccaatacatccgcaaaattcactattttggccgtaaaatccaagacgcgcgttccgcgttggctgtggtcggcggaaaggtctaaagaagagagctaaacagcttgaacattgtgacttcttgtttttcaggttgttcttgtgtccgaactgtacacaaatctcgtccaaaaaagacaacggaataacacactgagagacgcgtttatcattgaggtgaaattggaggataatggggtgcctaattcaaacataatttgtaaaagaaaaagccaatcccgggcactcatggcggtgagaaggataagtggggctgatcagtgattggacctaagaattttacggagagggaatattgatcagatgaagtggaacaatgtgtgattagttttggggtaaaagtgatttttaggggggggggcggaatggttgataattttaatggccataaaaccgttggtatattttgtcaaatacacagaatttgtacgtgtcaaagcgtcacatcatcccgttcattccgtcggacattcgtctgatcaaatacatcgaccaaatggagccgccgctcactcgtagcaattcgctgctcgcatccgaccacccccactccaactcgtgccgtttttgccattctcatttcggcatggcccatcatattgaa

SEQ ID NO: 60888 - DNA, 851 bp, Heterodera glycines
  Genomic contig location: Contig_ID=SeqID_6254; Location=1..851; Strand=-
  SCN-specific regions: Sequence locations=1-157,179-188,210-347,369 -744,770-851
aagtatgccaaactaattctgccccatgtggcgctggtgttgctcacttgcgcctacacaatctttggtgcctccattttctactcagttgaacacccacacgaaattgcctcaaagcgacgacaggtcagtcccggagaaaggggcaaaagccaattcatcgccatacactcacaaacagactccactcaagttgattaataaatttacattgaatttgttatatttttccaacactcatattgggactgaaaaatacctttacgcgtcgagaaatattctctcaccagtccaactgagtcccaaaatgggtctcgtatacagtcaaatttgttctgccttaatagtaagttagaaaattttaaaattctccgtgcttaattagccttattccgccgtaattgtctcatccccattatgcacacataacttttccaatcgatcacatcagttggatttgatcaaccgtcaacaggacttggttggtatcgcgctcttttgtccaacgccagccatttggtcgccacccttttcagttcgtttccgcgctgcttcgtctcgcgctttccaatgccagcggagtgcgcgtcgaatgggaacatttggcacggagtcatctgcacgaaatgagcgacaatttgttcaacgctttcgaaaagcactttctgaccgccactgaagtgaagcgaaacgtgacaatttcaatttggtaagaaaaaggcaaaaaaaggggaagaggggaaaaacgggggatttgggccttgggcccttgattgcccagcagaaagcgacctgatcagtgatcagagtctgtctgatcagtccgatatttttcatttattcgtttccga

SEQ ID NO: 60889 - DNA, 1410 bp, Heterodera glycines
  Genomic contig location: Contig_ID=SeqID_30482; Location=4..1413; Strand=-
  SCN-specific regions: Sequence locations=1-124,148-303,326-334,358 -504,542-994,1017-1027,1049-1210,1274-1327,1352-1410
atgtggggttgtgaatcaatggctgagatgtgtttggcgattaaccgttgcttggaactcgctagtcccaggctgacacgttttctattcgatggcaaacgcattttgctatggatggttagtcaatatttaaaaaaaaatttaataggtcaccctagccccggaagcaaatttacaattttggcatcattagcaactctaaatatcgtagttgcgaaattttatattcttagcgtgaaccgaactcatagattaaaattttatgcctttttcaaaatttaattgaaattcatggtttaaaaaattttatcatgggttaaattttgcccatttctattttatttaaatttaaaaaaagttttcgctttttcagctgtttcccaccttgtacggcttgtactttttcatcttcaccaagccgatcattttcagcggcatgtacatcacttggttctttaacccgcactttgagtacatcaatgattttgaggaaaaggtaaagacaattttttaattataaataaatttttttttttttttacttttcataccttttacaattttttacatttttcgaataaattggcattttaaaaaatttacaagcctcagatttaaatttacccgaaaaatttacagtatcgcaacgatttgcacacagtacacaattacattgtggttatcgtactctcgagtacttatttgacatttgccgcgattctgttctttcaagggcgccaattcaaaacaattcgaaccgacactacacgtgtttcacagaaaaaggtcataattattaataaaggttcttggccgagaatgggaggagaaaagtcgggaattggggagcaagtttgacaaaaaaaaattttttttgtctaggattggacaaattaaaaatgtcggagagcaacaacaccttcatcggggagaacattttcataaaaacaccgaaaacggaaacttttcttaaaaaaccaaagacgagaattggaagaaaatttcccacaaaatttgtcgaggatgattgaacaaataaaaagaaatgtcggggagcaacaacatcttcctcggggaggaaaatttcataaaaactcgagaaaaaaaataacagaaagttttttaaagcaaaaattttcaccaactctaaccctttggagtgcaatcgaggaaattcacaattttcccgaatcagatgtgggaggaaccctaatttatatattctatattattttaataatacattttttacattgtatatatatatttttttcagattttcatccaagtgattctgatcagcattgtaaatggatgtgctgcactcatttatgtgtatatgaactatgtgccgctgagccgatttctgatcattcttggccaatttctttggatcatggcacatggtga

SEQ ID NO: 60890 - DNA, 299 bp, Heterodera glycines
  Genomic contig location: Contig_ID=SeqID_30483; Location=225..523; Strand=-
  SCN-specific regions: Sequence locations=1-36,81-231,253-299
atggctttcactgttttctttgcttatcgtggcaggtaaatatttaaaaaaataatttttattttatttttgttaatttagcttcaatcgcaattttgtcattttgtcgaagtaataattacgaacgccatccgttggttcacacattgagaaatttaagtgatgcccgaaattggcaaacattggccagggaaattgacgacgaagtaagggacgacggcacggggcgacttacaaattgccaaaacaaaaccatttttaggtccgtgctcctttgctcttcactattttgtacaaag

SEQ ID NO: 60891 - DNA, 1280 bp, Heterodera glycines
  Genomic contig location: Contig_ID=SeqID_30485; Location=66..1345; Strand=+
  SCN-specific regions: Sequence locations=1-101,124-149,172-200,222 -300,330-349,371-438,475-588,651-874,897-1133,1155-1226,1248-1280
atgacaactgcgatgctggagggcattcccggattggtaacttcgacttgcgggaaaattcgggaaaatttcccgacccttgaccaacaggtagaagcagtggcaaatagttggagatcattttactaattctttttcgatttaaaaccaaaattttggaatttttgttttgaaagattaacctaagtggaaaatgttaacaaaagggtcaaattccattttttcagcactttgttcgctacttcattttctatggcctttttttcttcatttccattttcaatttggtacagttttttcaaaaaaaaaaagaaattataaatttttatcttccacaggctttcgtcgtaaaattcattttgtttttgggcattcatttcatcatcgatgtctttttgtctgacgccgaacgacaaattgtaaatgtttaagaatttgtttaattatttatttttctgataataattttttttagtctcagtgaattatgaattatttaaattactaaagaccggaattttgaaagtaccaggcccgggacagggtttaaatttacgggctcaattgttttaatgaaatgaaatgaacaaatatatttaataattaagttttgaatttgttttgatatttttaatgtaatttttttaaatccggtgtttagacatcgtacttctatggtaatggttggttcgggctcacttgtgatgtcatcattttcaaacttccagcagtaaaaataattaacaattatcattttaaatttcaagactcaaaacaattaatttgaggtattaaacgctcaaaattctgctcgacttcccactgatcttctacaggtgcttacgtcttgtgattattcataaacaataataattatgcacagtttgtttttgtggcctctttcatgttcaccgcttgttcgctgttcatctttgatctgatcgtttgtcctttttgccaattttctcgctacagtatcccctcctacttgcaccgtatttcagacatttgtcttcacctatcttttgctgatttgtgctcttcaattcgccaaatatgttgtcatcgacatttacaaatgtgtccaaaatcgcacttcgcttccaaaagattgtggacaaatggtccatgtcaaaatggaagaaatttttgccgattttatcaaagaaataaaagcgacgcacgcggaaattggatcgattgaggagattcgtcagggatccaaagccattttttggcacattcacaacaaaattcaaacggacaaggtcatttggaag

SEQ ID NO: 60892 - DNA, 663 bp, Heterodera glycines
  Genomic contig location: Contig_ID=SeqID_30486; Location=476..1138; Strand=-
  SCN-specific regions: Sequence locations=1-64,87-123,146-216,289 -325,347-531,579-608,630-641
atgttagatcaaatccgatcggatttcagccgtgccgacaaatgcgaactgagcagccgaataaatctggaagatgaaggaaaagaagttctaaaatttggccaaatattatatgaaactctggaaaagcattctgaaaatgtgaaatatgacgaaaagaagcaattgctaacattcccattacaaatgggtgaacgcatcattaaacgactcggcaaattaattgaaatgtaattattaattaattctcattcatttttttaaattttattttaaagaaattttaatgaacataaaaaaatcgctaatgacattgattttataaaaacaattcaaacggttgcatcgatggaaaatgaattaattgcagaaaaacggaaagtcacaatttcggaatatgtaaatttgaggttgatcaatttgcttttctcattggcactccgtttactcattcaaactgaacaaaatgaattaattgatcaatatctgccaatttatttattcgctattaaattgagcagagaagaatggtatttaattattatcaaaattaaaaacattaaaaatttatttataatcgaataatacttgtgcaaatattgtataatatattaatttttgttactatccattctatgattatttgtttaaatataaaataaa

SEQ ID NO: 60893 - DNA, 412 bp, Heterodera glycines
  Genomic contig location: Contig_ID=SeqID_30488; Location=353..764; Strand=+
  SCN-specific regions: Sequence locations=1-132,169-382,404-412
atgccattgctcagcttgaaccttttatcaattgaatacattgtatggcccatttgcaatggtctctttgtgatggcatattcaagctgtactccggtgctttttctgtgcaggtagataactaattaatggattaattaattttaatttaaaaaattattaatttttcattttagcactgaatatcgaaaagcattttgcaaatacgtttgcagaaaacaacatggattaactgttgttgtgccattgcagaatatgcctgcttgaaaactttgtttttacattttgcatagtaattcggactcgatgataaggcctcccacaaatcttagcattaagagcctccaatctgcaccaaaaatgttttggtgacgtacgaatttttgaaaaattggcattttttaaaatttga

SEQ ID NO: 60894 - DNA, 174 bp, Heterodera glycines
  Genomic contig location: Contig_ID=SeqID_30489; Location=403..576; Strand=-
  SCN-specific regions: Sequence locations=1-174
atgccagaaaaaagcatcactttcctcatccttttatttcttttaattttctctgcatatgaagccgcaatgctgagggaatatgtcaaattgccatatactcctgaacaaacaagttttgtaggagatgtggccaccggagctggttatgggatgatgcttaatgtttcaaaa

SEQ ID NO: 60895 - DNA, 2298 bp, Heterodera glycines
  Genomic contig location: Contig_ID=SeqID_6257; Location=44..2341; Strand=+
  SCN-specific regions: Sequence locations=1-358,380-657,679-690,724 -1086,1109-1215,1237-1569,1591-1969,1991-2298
  Gene Ontology: Mol. function=protein serine/threonine kinase activity; Cellular component=nucleus; Biological process =spermatogenesis
aagggagtaaagcgaaaagctgacacgaccacttcttttgatgaggaaggaccttcgacaaaacagccaattaaaagagaggtgcgaccgattaagaaaggacctgcgcctgtcgactactcacagctcaagccacttctcaaaggcaaattgaatgagaggatgaaattctgtcataaattactcaatgagctcattacctccaaaagatgcaaggtgagactgacaattgaaaacattgctaatcaaatatttccatcttcatccattagacattcaattggccgtttcttgagcccgttgatgccgaggcattgaacctcccagactatttcgacgtcattaaacaaccgatggatttaagcaccataaaaaagaaaatggatgcacgtcagtatatttctcccgatgaatttcggaatgatgttttattgatgtgccggaattgctttacctacaatcctgaggatcagcccgttcacaaaattggaaaacaattgcaggtgagttaagaactttcattaaattgttaacaacgtgtaaagagttgttcaaaattagtgagcggcgttgaccagatatttataaatattccaaaactgaagtttttagtcgtatttcaatgtgaaatggaggcatttgcctgcagaaatgccgcctgatactgcagaaaaggccgtgccaactttagcactcccaccaaaggaggaaaagaaggaaattctgacaaagacttcaatttccaataagccatcgtcggtttcgccgactgcgcttctacaaaaatttaagcctgtggacgacgatgagcaaattgactttcttattttgcaagtccaagctgaacatgcacgggttactgagaaacagacgcaattgcagcagtactcacacgacctcctccaattaaagtgcataaaatgttaaaaatagttacttttctttttatagaattaggcgccgagaagcacgaacacaacaacagataacgccgccattaagtgctgaatcgcatcaggccattaaaaaattgttgaacgcgtgtcttcccatttcctccattccgacatcgctttcgttgcctcacagcactgcttttttgccttctatcaatgcagttcaaacatccgtcgttgggttgcttcaaccaaatgttcagtcgcaacttcctcccgcaatgcctacgatttcaccgccgcagcagatgaagaaaaaggctgggcccgggcgaccgcgtgtgacgaattctggctcttcggcttttatcggtttgttacattttatcacttataagtagttacttattgtttactattttcttttcgatatttcaggacaaacttctgcagaatcgagcattagtgcaccttcacaaagtcacctttctctttttgatctcccacctgaaaattttattcccatttagctcaaagcgtttccgtctcacaaataaaccaagtccctgtgcaacaacagttccctgctgttgatgctccccatcccaatctgttgcctcagcaacccaatgcgaaatcgggtcgagggagaaagcccggctcaaagaacaagccgaagacggagtctcagaaggaggacacgttgacaaaggaatacgaattcaactccgaagacgagcactcctctgagccgatgacttatgacgaaaagcgacaattgtcgatgaatatcaacaatttacctggcgacaaattgaccaggtcactcactcattcccttcctttcattatgtacttcattcatttgtttgtttagtgttgtgaacataatcaaagcacgagaacaaatcaaagatttgaaccccgatgaaattgagattgacttcgaaacgttgaagccagtcacgctcagagaactcgaggcttatgtgaaggcttgttcccaacaaccggacaaaaaaccgaagaagacttcgacgacctcttaccgttcgttttatttactttcacggtaaaatcagtttaatttaacagcgaaatctttgcatcccgaacacccaaaaaagaaggacaccgatccccaagcacaacagttcaacggaagcgcaccgcctaccggaaaatgtaaatttttgctgccttatttaattaattcagcttgattcagtgcccaatggggacagtggtcaactttcggtcacaagtacgaccacggcctttgctggacgtacgacccaaggaatggtcgcgcagaaggaggacgaaaattcctcttccgagtcttcgagtggttcttcttcttctgagtcggattctagtgactcatctgattcagaatcag

SEQ ID NO: 60896 - DNA, 661 bp, Heterodera glycines
  Genomic contig location: Contig_ID=SeqID_6258; Location=140..800; Strand=+
  SCN-specific regions: Sequence locations=1-35,57-277,299-448,500 -547,573-661
attcggggtcttttgctgccagcaaagtgccccctccggtgcctcctcctccgccgtccatttcctctgccgtcattcccccatccgtccccaaagcaccgagttcacacgtgcacagtggcgcggctccactccttcagacgaacaatcccacggaaattagtgcggggatttccggctccgtgctcgaccatttgttgccgagtgtgacaaacggtgaaaaaggcaccggaggagcggctattggtgctgggttgctgaacaaaaactcgtggagttcattagcacaaaaggcgacggagggcgtgggccaaatgggtcatgcggtcaacgccacaaacgcttatgaactgttccgaaagcaagccagggaaaaggaggaacgggtgagtaaggcggcaacaaataaaaatggaatgaaataaatggtttacaattagaagcgacttctgaaggaggaggaggaaaggaaaaagcagcagcgggagagggagagacaaatgcacacgggcggaggcggggaaagtatttcagcaccaccaaacgatggacaacagcagcagcagcaaccgaagatcaacccggaggaggttaaccgacttcgcgaacaggaaaaggtttcactgttgaggggagaaatggggacaattcgcttcatttg

SEQ ID NO: 60897 - DNA, 866 bp, Heterodera glycines
  Genomic contig location: Contig_ID=SeqID_30493; Location=482..1347; Strand=-
  SCN-specific regions: Sequence locations=1-33,56-144,166-200,222 -409,438-565,588-866
atggcgaaagaattggtgatttcggcaccaaatttaatgaatgaaataaagtcaggaaactttgacgcgaagttggcaattgaatcgcttaacaaacattcttttgccgtgtgttgtggcgggaaacttgaagagaaaatattgatgaaaatttgcaaaatttacgcaaatatttctgtgacaatttgccaaatggaacattaacaaatgtgatgaaaatatacgcaaattaatcacaaaagtccaaattaatgagcaagcaattaacaaaaaggcaattcgtgaaaaagtggtgaaaaattcaattctcagcaatcaaaacatgacaaattttgtggaattttttgacaaattaaacattggaattgaaaaaacggctgccataattaaagctcaatttggatttaaattattaaattaaaggaaaataaattgtggcaaaatgacaaaagggaataggccattaattcaagggttggcatctcaaaatttacaaatcagaatatgcagccataaccttttcttgttggaattaatgcggaaaacttttttaaagtttactcatgggacaaaattttaatttactttttcagcaaaaaatcacccattttgataccagaaaaacaatcgctggttgaaccgaagaacaaagcgtgatgatgatgatccggcaatgggtggctgtgtaattacaacaattctttccattatatgcactggcccgccctttggtttcctatttcattaaatacttgaaggagggcaacgtggacgtttatgatcgttatggtggtcattactattcgcataagcttctctatgatgttatcgtgattgcaatcgtttcgtttgttgtgctaagataa

SEQ ID NO: 60898 - DNA, 656 bp, Heterodera glycines
  Genomic contig location: Contig_ID=SeqID_30494; Location=561..1216; Strand=+
  SCN-specific regions: Sequence locations=1-314,345-534,572-656
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagctgggagaagggagtgggaaacatgatttcaaaatttttgttgaaatatttgtcgtgctctgaagggcgtgggaggggggggtgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaacttaccaaattttatttacatgttagtttaggcactctgatgctttttctatcaataatggaggtga

SEQ ID NO: 60899 - DNA, 927 bp, Heterodera glycines
  Genomic contig location: Contig_ID=SeqID_30497; Location=162..1088; Strand=-
  SCN-specific regions: Sequence locations=1-200,223-495,674-714,747 -871,893-927
  Gene Ontology: Cellular component=cell wall (sensu Fungi)
ggtttgcgacccctactcgtggtttaactacccctagattggctaccagtacccgaagtacggattgctattacgtcgacataacatgcgacgcaccgaacaatgggcaaccggtgtacatagaggtaattggattatttgacgacatttcaaaaatgtcaccgttaagttcaacaacaacaaaagcacaatcgtaaccgcaattctgccaccgtacaccaaagttactgtatctctgaaatgcatttatggcgaaaacggtaaaaaggtgtacgttcaaatcggtgtggacggtaacccgaaccaagtggtcgaagtggaaaaggtaggaacggcatttgaaaagcttaattccgattaaatttcaggtgagctgtggaagaaaatgctacgtgccaaccacgccaacaactccaacctcgccaacaactatcacaacgccaacaactcccacgacccctacaactccaaccacgccaacaactcccacgactccaaccacgccaacaactatcacaactccaacaactccaagcacaccaacaactccaaccacgccaacaactcccacaacttcaaccacgccaacgactccaacaacgccaacaactcccacaacgccaacaactcccacgactccaaccacgccgacaactccaacaactcccacaactccaactacgccaaccaaaaaccgttcgaattcaaatgaacttttttggtttaaattttaagtttaaattttaagcgcccaattgttgtgacaaatgcattgccggttcggtaaagccgggtgaacaaggaattgactgcaacggcgccaaattgaatcccgagttcggttacaaaataacgaattacaaatgtgcgtcactgaatgtcacttgttcctcatatctggtcaataacggaattatcgccattaag

SEQ ID NO: 60900 - DNA, 754 bp, Heterodera glycines
  Genomic contig location: Contig_ID=SeqID_30498; Location=155..908; Strand=+
  SCN-specific regions: Sequence locations=1-517,539-672,713-730
atgcacattccaaaaatagaattccccaaagaaattgttccaagtttggccaatttgtcgctaaatcgtcaaccaattgatgtggttttttcttcttttgactttctttttaatatattttttgagtcctcggaaagggtaaaatgatttgattttattgttagtctgattttgtgcccttagccctgggttcaaattaagtaatactttgaaataaaaaagaatttgattttaggaccgtcttttgaagttactcgaacggacgcaaaaggatgtccagcgcctgacgaccgccaaccaacagctcaccaccgccaaccaacaacttactacaacaaaccaacaacagcagaacacaatcaaccaccagcagcaaaacatccaacaactccaaaacttattgggtttgtgcaaaatttattggagatttaaatttcttttctcgagcaattgattgtaatgcctaatttttcaagccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtcagtgccttggttaagtcaggcactttctccattttctttcgtttaggtgttcagcagcagcacatgcaggagcagcagggtccccctcctccgccgccaccgca

SEQ ID NO: 60901 - DNA, 1309 bp, Heterodera glycines
  Genomic contig location: Contig_ID=SeqID_30500; Location=63..1371; Strand=+
  SCN-specific regions: Sequence locations=1-152,174-253,275-436,461 -522,544-628,653-683,705-1118,1140-1208,1230-1309
atgccagcgcaaacgattggtggacttgaagatgctcaaccacgacatgaagttcaaattggagagtgcgcagaagaactgattgtgagacgggtcgaattcgatagcgcataatatttattgtccattgtttattgttgtaatattttgccaattactatattatatgtaattcaaagaaacatttgcctaagtccccaaacgcaccacccttttacgcgcacattatattaatttgaaaatttttcgattaaataacttagaaaatatattcaaataaaggaaccggtaatagtaccgatggtagcccccctttttcgaaaaataaaatttttggaatttttttcaagaagaacgtataagaggttctaagggtcggtgaatccgaatctgacataaattcgacccatgtcgaaccccggacccgaattcgaacaaaaagtcgaaaattcaaattttacgtatttccaggggtgccattttgccctggaaaccggcatttgcctggttttgggggtccgtgccgggtttttgggttttttgccgggtttcctgtttccactcatttatttgaattttattaaacatttcgccaaaattaagaagcaaatatagtttttgttaattgttcaggtttattttattcatttttgatcttcattttctagtccgcagaatgtcccaaaaatctttttctgatttcatttccaaagttatatttcaacatcttcaactcaaatttccagcgctgaggaagcaatttcaggttctagttttgttttttcagcaattttacgcggacgcacatgaatatttgggcaattggtcacagcaattctctgagacggatgaaattattggagattgggtcattttcgagtcagagccaacaattcgaaaggcgtataggcatttctgtggggcatcaactgacgaaatggatgctttgtttggtgagatcgctgagttgaaacaaacattgaaggagctcgagggcgaccggttcaacaggaaaaacgtggacgaaaaatgggcggctattttcaaaaatcctaattttgtcctgctcaaatcactagtctctgcaattctgtcgatattcccttctaatgcattttgtgaatcagtcttttctgttctgatgaacatcaaaacggacgagagaaacagtattggcatgcctttgttaaactcgctaatttcaatcaaattcaatgcaaatatttcatgtcccaatgctcacaattactttctttcattgccaaatttgctcaaacaggtgaaaagcggtgataaatatgttgtttaa

SEQ ID NO: 60902 - DNA, 1062 bp, Heterodera glycines
  Genomic contig location: Contig_ID=SeqID_30501; Location=240..1301; Strand=+
  SCN-specific regions: Sequence locations=1-105,127-272,294-446,468 -471,696-879,936-946,970-1062
agcaaaaagaaaatggcgaggcaaccgcagaaacgacgacaaaaacagcaataaccccaacaatttctgaacaacaaacaactggttcttcttcaattgctgctgttcaatcaattttggtggtaaaaaatggttaattaattgcaaaattttctgaaaaacacacaacaaaggcaaagaaaaagagaaaaaaatgctggaggcctagagattaggctagaaaattttttggaattgttcgaaatttcatgataaattatatatatacattgaaaatttttggcttaattttcagaccgatgccccaacaattgtgccaacaagttcaagcagttcagcatcaccaccaccaccaccacaaacaacacaatcgcccgtaatttcatttatgacattgatgaacaaagaagaaaacgccaacattaaacatggggaggagaaagtgagaaaattaatttgattaaaaaggagattaaataaattttctttttaaagaatgtattaatttaaattttatttgaaatattaaattaaaataaaagaattttttgtaaatatattttttcaatatatttttcattgacgaaaacttattaaatggaaatgtttttaaatcaaatttatactatttttcaaaatttataattttttacatttcattaattttgcattttttcaataaaattattttaaaactttcaaattctttgttgtatttaataaaatcacttttcatttacactttattattaattctgctctttttttcattatttaataaaataatcgtcaaaattttagggattaaaattagaagaaaatagcggacaaattgcagctgagctaaaggcatttgaagaagcacaaagtcaacttggcaatataagtaaaaaattaaattaatttaaaattattaaaaaaaatttgttttttttcaaaaaaggtccaattggcattgggccagctcggcttcacccaaaacagctgaatgaagaggcgacgcgtcaatatggcgccaaaacaattgtctaattttctgaaatatttgttaaaaataggaaa

SEQ ID NO: 60903 - DNA, 378 bp, Heterodera glycines
  Genomic contig location: Contig_ID=SeqID_6260; Location=802..1179; Strand=-
  SCN-specific regions: Sequence locations=1-336,358-378
atgttgttatttttgctccaaaacgacgttcagacccactttttggagttcgaacaaatttcatttgttattttcgctcacagagcacttgtaagacctcagaaaagagtttaaagacttgtaaattgattgacagctctggattgctgaaaataacgagttcgaacaaaaggtcgaaaagtcgaacattgttcgaactcgttattttcgttcacagagcacttgtaagacctcagaaaagagtttaaagacttgcaaattgattgacagctctggattgctgaaaataacgagttcgaacaaaaggtcgaaaagtcgaacattgttcgaactctacaaaaatgatcaggattaggtctaaaatctgaattaaataaa

SEQ ID NO: 60904 - DNA, 412 bp, Heterodera glycines
  Genomic contig location: Contig_ID=SeqID_6260; Location=2415..2826; Strand=+
  SCN-specific regions: Sequence locations=1-412
atgaatcgttttgaccaaaatgatttcactataacttctgttcatcaaatgcgcaatcgccctcggaacacaattggagaaattgcggaagtgagttttgcgccacttgaagaagtagaacggcccgaccgcgtgcttgagcgtcttgtgcgacggttgtttgatcgagtgcttgatgggcgttcggcacctatgctaatcgggcttcaattacacccaccgacctttgaaaacccatttacaattccgcttcgtcctcccgagcagaacaatcccgccgcaattgccgatttaattcaaagacttaacgatcaatctgccgctggcatagatctaacagctggcacaactgtgacaaaagtacttgcggtatggccaatgcaagcagatcagagcgacgctggaagatcag

SEQ ID NO: 60905 - DNA, 773 bp, Heterodera glycines
  Genomic contig location: Contig_ID=SeqID_30502; Location=35..807; Strand=-
  SCN-specific regions: Sequence locations=1-338,360-773
atggtcgggatcgggatggcattccttctcgccataatgggatgcatatgcccaattctcggacgattttggtcgggagcagcagctcttggcaaagcaattgcatggggagcaaagtaccccattcgtctcttcaattgggcgaccggaagacaaatttcgccgccaacagcagcacaagtcgagattaagctgaagagaggagcgagaaaagcgcgcacgagagttcgagagctacagcaacagcttcaattgtcacgacgggcccgagcagccgcgcacgcatggagacaaccgaaacggaaccaattgacagtccgaggaacagtcgcggcggggctcctcccgcttcttctcctaattggcaccacattcgcctcaaagccgctctcggtcactgtccgatcggaggactgtgcccgaacggccaaaggacttcaatgtgccggaactgccaccacaatcatcaccttactgccagccgatcaggtcaattcgtttgtgatcagaacgcagcaggacgagctcctggggacggttcgactcaggttggcctcgatcacaatggtttgtgtccccaaaacggagagttggctccgatcatacacaatctcgactgtggcagtgaaaaggtgcccatcagctgggtcgtgccgcgacgacaactgcagcacaatgaacggtcgggtgatggtccccgaactcaacgaactcaatcaccggcctggccattcaatgtgcatgagcagcacaagcttctgggcagtgtgcct

SEQ ID NO: 60906 - DNA, 399 bp, Heterodera glycines
  Genomic contig location: Contig_ID=SeqID_30502; Location=1..399; Strand=+
  SCN-specific regions: Sequence locations=1-399
cggtagaacaggcacgaagctgatggatgcccacaggcacactgcccagaagcttgtgctgctcatgcacattgaatggccaggccggtgattgagttcgttgagttcggggaccatcacccgaccgttcattgtgctgcagttgtcgtcgcggcacgacccagctgatgggcaccttttcactgccacagtcgagattgtgtatgatcggagccaactctccgttttggggacacaaaccattgtgatcgaggccaacctgagtcgaaccgtccccaggagctcgtcctgctgcgttctgatcacaaacgaattgacctgatcggctggcagtaaggtgatgattgtggtggcagttccggcacattgaagtcctttggccgttcgggcacagtcctc

SEQ ID NO: 60907 - DNA, 1540 bp, Heterodera glycines
  Genomic contig location: Contig_ID=SeqID_30505; Location=14..1553; Strand=+
  SCN-specific regions: Sequence locations=1-250,272-1383,1405-1540
ggaatttctgccgatcctggtttcttcctctcaacattcacaatggaaagttggagtttgagttggacagcggtgcggacgtcacagtgattgacgagatcgactggaaacacattggaaagccaaaattggaaccatcccaaggattggttgcctatggcgggaaatccattgcgggcattttaggaaaggcaaaagtgaaactgacgcacgaaggaagaacgactgagtccaatattcatgtcataaatggtaagcacaaaaatttgtgcggccgcgatttgatcatgggactgaaaatcgatctgaaccgagctttcggaattccgacaattcgtgccgttgaaaacaaaaaggaattggaagcatgtttggcccaatatccggaggttttccaggacggagtcggacgatgcaaaaagatggcgtcattgaaattcaaggagggatgccaaccgaagcgatgcaagccgagaccggtgccattttcacttcggaatgaagttgaaaaagttttggaccaatggcaggcggagaaaatcatcgagccagtggcaaccagtgaatgggccactccgctggtcattatgccaaaggcaaatggcaagctgcggttgtgctttgactataaggtcacggtaaatccttgggttggatgtacaccaataccctcttccacgccccgaggagctgttcagtatcttgaatggtgtcgaaaaattcacgaaaatcgatttgaaagatgcatatctgcaacttttgcttgacgaaaaagccaaaagttgtctcacaatttgcacgcacaaaggacttttccacttcgctcgattgccattcggagttgcttcggcacccgcaatttttcagcaagtaatggaagaagttctgcagggcattgatggcgtggcggtttatctggctgatattctgatcacagcagccactgatcagcaacacgtcaaaagaagcgaccaggttcttaaacggttgtctgagaacggacttagagtcaagcgtgaaaaatgtgagttcctcaaaccggaaatcgaatatttgggacacattgtggacaaaaaaggtctgcatgcgtcacctggcaaaatcgaggcaattttgaaaatgccagagccgaaaaatctgaaagagttgcatttctgggaatggtgaactattatggaaaatttgtgccatccctggcaacgctttcagaaccgctcaatgaattgaggcgaaatgatgccaaatggacatggacaaagagccaacaaaaggcattcgataggatcaaaaatgttttgacatcaaccaaagttttggtccattatgacccgcaaaaaccactttttctggccgctgacgcatccgactatggagttggagcggtcatttttcacaaagatgaaaaaggaaaagttggtgtgattgcgtatgcctcccgaacgctaaattctttggagcgcaattactcgcagattgaaaaagaagcgagggcaatcattttcggagtcgacaaattcaaacaatacttgtacggtcgaaa

SEQ ID NO: 60908 - DNA, 261 bp, Heterodera glycines
  Genomic contig location: Contig_ID=SeqID_30506; Location=1580..1840; Strand=+
  SCN-specific regions: Sequence locations=1-261
atggactctacaaaaccgatcgtgtttttgaaggtcagcctaaaaggaaagccggcaacagttgtagggcgagtcggtgagttgtaagctcttctctatgaatgattaaaaatggcttatcaaaaattctgggtgattgtttgtattttttcagatacgaagacgtccgttttgtcagaagcttttgcctctaaaattggtgacattgattcgaacctgcgtggccgtgaacgaccccaactgccgatgtgcccgttgtag

SEQ ID NO: 60909 - DNA, 606 bp, Heterodera glycines
  Genomic contig location: Contig_ID=SeqID_30507; Location=196..801; Strand=+
  SCN-specific regions: Sequence locations=1-114,156-366,389-489,511-606
gatcatcaaatgattatcaaccgaataatggtcaactgattaataactctgaccaaggaaaaattaacgggcaagtgggaaccgttgttggtcacgaccaacaaggagcaggtcattaattaaattaaaattatcattttattaaattaatttaagcatctcttactaatgaccaaattaaccaactaattactcaacttcaagcaaaacaagcagcaggtaattttggtcaaatgttcttttaaattaactgaatttattttcaattttgtttaggcttacccaacactaatgaccaaccatcaatcactggtcagacaaacaaaggtttattcgcatataaatcatttcgaatattcaaatcacattttaaataaaattaaaatttccagggaagggccgtccccgcgttaaaattacaaaaactgtggccgaaattttcctggacgagcaagagacaacgaacgaagcgataatggcaaatccatcaaataaataattgtttttcattgctgtttattgaacaagcattgttgtgagaggaagcggatttgttataaaaaatatccgaaaatatgaaaacatttttattacccgaatcgcaga

SEQ ID NO: 60910 - DNA, 912 bp, Heterodera glycines
  Genomic contig location: Contig_ID=SeqID_30508; Location=498..1409; Strand=-
  SCN-specific regions: Sequence locations=1-217,239-302,351-826,849-912
atgattgaaattgttataatttttctggcgaagtctatcaaagagctgagcagaagggcaccgatgggaaggtatgcgtcatttcttgctggacttgagccaccgcggaaagctaagaaataccaagcggctgatgagcgcctcttcaatttggtgcagaattacatcccggtgaacccgaacaatgaaaatgatcacaattaccacataaatccaaattttcatattattttagaatttctccgtggaatttcgcgcaattatcatatgaacccataaattgtttccatttcttcattttgttaaatttattatatttaacgaaaaatttcatttttttataatttttacaatttcttcctgcctttttttcatttttggcttggcgccaaaacgtcggcgccaaatcgtcggcgccaaaacgacctggtcccctgtcaaaaatgactggttttttccaccttagtttttgggttcccttatcactagagaccggcgggagtttacgggattcccgctcccggaaaacttcaaactcccgctcccgtaaattttaccgaaaaaacgggagtaaaattacactggtaagaattgaatttttttggcaaaatgaataatttttgatcgaaaaactgttaaatatatagccaaaatatcaaaaaaaaaattttccggcggcgcctatcggcaccacagggcctttaaaatccttaattttcttaaaaaatttgttcaaaaaattgcaaaaattggtcatttttggacaaaatctgacactgtattgtattcaaatatcaattttttcccggcggcgcctaccggcaccgccggcctccttcctcctccctggtcctcaaagttttttttcaaaaaatacggcgcaaaaaattgaaaatttaggacagtaataaa

SEQ ID NO: 60911 - DNA, 1000 bp, Heterodera glycines
  Genomic contig location: Contig_ID=SeqID_30509; Location=410..1409; Strand=-
  SCN-specific regions: Sequence locations=1-238,260-261,283-391,414 -512,536-675,705-1000
atgccaaaaaaagcgaatgaagcggagaaagaagcggatttaaagcctaaaaaagcgaataaagcggagaagggatggacgaatggagtgaaggaaattgcgaatgcgatatttgaaaaaagtaaaaatgttttgtacccaaagaagaaaatttatttcgcatttggcgaaccgttcaatgccacggcatttcatggtgataaagaattgaaaatttacactgaattgaaggcagatcaaaagaatggaaaattttatgtggaagttgacatgacagattttgatcaatttcaaaatcaacccaaagcgatgatcgatttcaaaaatgccaaaggattggtaagtaatataaaaacaactttgattatacctttgttcatatttagtagtgttttctctttattttttaaattgactcaaaaaccgcgaaagtacttagaaatgtcaatttttttggttaaatcaaatctaaaaaatagcaaaaatttgttaggaaaagcctcaaaaattgattttttaatttatagaacttttaaacgatttttaagcgaactagaaaattttgtgaaaaaaagtctcgggtttttgggtaacggtgtcgaattgctcgggaaattttttgttctcgaatggcaagcactatatttagccatcttatttttatttatttgaaggaatttatgtaataaaatttaaactgaaatttttattccagcgattcgcaggaattttactgaaagttttgctttaaaatgataataaaataatcgcagaaattaataaatatacaaatttttatcagatttatggtggagctacagtacaggtgttgcataacgttgcagtcttggatttttcggatgaagttagaaactattttcttaatgggtctggccagctctttttccgtaatgagtcaactggtcaacaatattccgtcgatgccaatggtgattatgacattgtgcataacgaaggacctttccgtggcttcggatga

SEQ ID NO: 60912 - DNA, 80 bp, Heterodera glycines; identical to SEQ ID NO: 51817
  Genomic contig location: Contig_ID=SeqID_30510; Location=403..482; Strand=-
  SCN-specific regions: Sequence locations=69-80

SEQ ID NO: 60913 - DNA, 117 bp, Heterodera glycines
  Genomic contig location: Contig_ID=SeqID_30511; Location=460..576; Strand=-
  SCN-specific regions: Sequence locations=1-117
atgaatgacctatgggcaaattgcctttgtttcgaatggacaattggtcattttcgccctttggtgagtttggaggtaatgggaaaagcagcagcagaagaatatggaaattgtaaa

SEQ ID NO: 60914 - DNA, 607 bp, Heterodera glycines
  Genomic contig location: Contig_ID=SeqID_6261; Location=237..843; Strand=+
  SCN-specific regions: Sequence locations=1-34,56-266,289-330,389 -405,427-468,518-565,587-607
atgtttttcactggcattgatcgactgattgcaattgctttttgggaattgtataaaaatcaataattcctatcgctaattacagtaacttttttagtcacgagtatttggcactgttaactgttatttctgtgtcctatgctgtctgcgaatctgttgaggtgtaccaaaaagcaattatgcatggtgatcagatgaccaccggatcatatttagatttcatgaaagtaattatcgtattgggacatttataaattccgccaggggtaaaaatgaaaaataaaattatacataaggtaatatattcaaaatcttggtaatatttacccgaaataaaaaaatcaataaaaaaaaaatcttcaaatatttacaaaatataattaaaaatgaaagaaagaattcactaatttttgaattttattttgaaattatcccatggcggcggcgcaatttatgaaataccctagcatttatattttttacaaaatataattatttatatttttttagattaaatcattttcaaacataataaatgttttgcttatttcaatgacttgcatcatttatgtttttcttggaattgtggtaaattttcaaaagtcag

SEQ ID NO: 60915 - DNA, 1126 bp, Heterodera glycines
  Genomic contig location: Contig_ID=SeqID_6262; Location=797..1922; Strand=+
  SCN-specific regions: Sequence locations=1-77,99-692,714-748,770 -823,871-1126
atgtttttcactggcattgatcgactgattggaattgctttttcggaattgtataaaaattaataattcctatcattaattacagtaattttcagtcacgataatcttcaaaagcgactgtatttggcattgttaacaattctttctgtggtctatggtttttgcttctctgttccggtgtaccaaaatgcaactagggatggtgatcagatgaccaccggatcatattttgattttttaaaggttcttgtgtgatcctgatccgataataattaaatatttctctgctttttagagcgcacctatttttgacaaattaagttttttgattacttcaattacttgcattatttatctgcttcttggaattgccgtacgtataaaagcttcaggtaaatcagtcgttcattaagcatttctccggaaaatggtcataaaagcagaccaggattttttgtgccattggcaaaaaaatttcggcatcttttttcttaaaatttgataagttttctaatttttgcaatttttgagttaattctctttttaaaacaatgattcacttgtgcaacattgctattaattacctaattaattgatttttataggtttgccgtccgccgattcgttcaatcgtcgcacttttcgcgcacttttttgcatcatttctgttaatattggcggctatttcttttcattaatttgttacattcttttaattcccaaaatttcgtctccgatcactgcgtggttttgcaatgtaattaccgcaattccaatgaacattggtgcagcgtcaggcggactcattttatattttaccaggtatttttaattgaaaaaatatattaaaaaaaattaatttcaattttagtacggaatatcggcaagcattccaaacagcgtttccatttgttttcaaacaaatttcgaatgtaaatcaagtaattccattgcaaaatggggctcaattaggcaccacacaatgttgaatgatgtcactcagcaaatacaattgccctatcaggtccatataaatggcactgaaattgatacagcttttattgatctgtgaccaagaatcacatcaatttttaaattcttgtatttattagactcatttcttgta

SEQ ID NO: 60916 - DNA, 435 bp, Heterodera glycines
  Genomic contig location: Contig_ID=SeqID_6262; Location=2606..3040; Strand=-
  SCN-specific regions: Sequence locations=1-124,161-257,279-435
atgacttttttattttttatgaataaacaatacaacgctttttctggacaaaatttcattgagtaccgcttggcagcaatgattttattcattcctgtgattggacttggtatttgcacggagcaaattattaaataaacattttaaatacatttaaattcaggggcaattgttccgacgatgtttttcactggcattgatcgactgattggaattgctttttcggaattgtatacaaattaataattcctatcattaattacagtaattttcagtcacgataatcttcaaaagcgactgtatttggcattgttaacaattctttctgtggtctatggtttttgcttctctgttccggtgtaccaaaatgcaactagggatggtgatcagatgaccaccggatcatattttgattttttaaaggttcttgtgtga

SEQ ID NO: 60917 - DNA, 809 bp, Heterodera glycines
  Genomic contig location: Contig_ID=SeqID_6262; Location=2949..3757; Strand=+
  SCN-specific regions: Sequence locations=1-202,224-317,339-409,432-809
atgaataaaatcattgctgccaagcggtactcaatgaaattttgtccagaaaaagcgttgtattgtttattcataaaaaataaaaaagtcatcagaagggcgaaaaccacttactctgacgactattccggtaaatgtgtcgtagagtaagtgacaaaatatatggatgatcacaggaattaaaaaaagacaaaaatatgtgaaaataaataataaataaattgaggtcaaagtcaaatgaggtcgaaataccaaatcacttagaaatttgttacattcttgctttcccggtcttacatattaccctagtgaactttaagttttattttaaattgatttagagaatttgtttttattagttctttatcgagttgattccacaattttgttaccctcccagcaaatggaatgaattttttgcccagtttgtattttgtgttaaatctataaaaggggatgttaaagcgtgctgatggattaaaaatagaaaatagtttcagatctgttcggccataaacaattttatgcgccatgaacagatcaaatagctttcgcctattctcaagtgttggcagttgcaggtattctaatcgattttggtatggaattggcggaaggctacatttaaaaaatactcttttggtgaaatattaaaaagtagcaatgaaaagaaaacgattcgaataatcccaacaatacacctgccaattaattaatgaaattacaccttttcttcaaatcaactaaatgaattataaaaattgaactcaaaaagggcaaacttcaagggattttttgttcaaattaaa

SEQ ID NO: 60918 - DNA, 879 bp, Heterodera glycines
  Genomic contig location: Contig_ID=SeqID_6262; Location=4188..5066; Strand=+
  SCN-specific regions: Sequence locations=1-369,391-401,438-696,727-879
atgaatgacaataacgaagtatgcgattatttgaacatcaccacaaccaccaattccgattcaaataatttaacggcaaaatgtgccgttttggaagcgtcgcaaaatgtgaccattttcgagtggtttttcagctcaatgacgcaccaatttgtggtggcaaaatgcgcttatcaattcaaagtggcgcaagttgcggtaaaattagacatttttaattatacgggtaattaattaattacaaatttcagtcggatttttatcatgacaatgtgctcattttctatgagaaatatccaattatttctccagtgaccgcatggattgtgttgccaaacattttcacaccgatttcgatcattttcaatctttccctcattttggtcacaattacaacaatgtaattaaaatttttaattagttttttcaatatttttcgtttcaggagagatcgaaaagtttgtaattggctgatcgccttcgattcgctgtgccaactcttcgttgtcgcaactttcggcgtcaatttggtcggcgtcattttccagcacagtacgattgactactgtatctgtcttgccactctcatggccgctaccgtagcatcatatgactcaattatggcaatgtttctgatctctgtggagcgattgttgatcgttctgtgtccaatcaggtgactctccttatatatggaatatttattttatatatatatcttttttagaatgaattcgatcaaaaaatcgacagtttgccaatgttcacttctttccgtcattctatgcaccctttttggcttggtaatgaatttggaagtgtttaatatttggacaattattaacatcccttgcgacaggtaattaacatttggtttaa

SEQ ID NO: 60919 - DNA, 1166 bp, Heterodera glycines
  misc_feature (1150)..(1150): n is a, c, g, or t
  misc_feature (1155)..(1155): n is a, c, g, or t
  Genomic contig location: Contig_ID=SeqID_30512; Location=42..1207; Strand=-
  SCN-specific regions: Sequence locations=1-21,107-339,361-380,402 -407,475-487,514-548,570-782,963-986,1014-1028,1163-1166
  Gene Ontology: Mol. function=ATP binding; Cellular component =cytoplasm; Biological process=apoptosis
atggcatcaaaaacaccgacggaggaagaaattggagaagagacaaaaaagagagaggaaaaacaggaagaagaaaggaggaaaaggaggaggaatatgaggaaaacagcgggaggaatacgatacatgagaaacatcgccatccaagtaaaaaaaaaagagagtaattaaaggaaaaatgggttattagaggtaatgaattaattaccaggtcgagagcgacacaaaagtggccgacaaatacgccgattttacatgccaattcgacaatgacaacaaaggagggacaaagtcggatgagaaggaaaagcagcaaaagacgatgatggacaaatggacacagcacaaaagcagtgaagcgaatttatggcaaaatatttggcaaagtgtggagaaagaaaatggccaaaaaaggaagggaatggcaacagaggaagaagatgaagaagaaggtgaagcagaaaaggaggagaaagtgggcgaagagagcagcagaacagagaaagaaaggagcgaacagacgcaatcggaattcaatttgtatgttcataaattcaaaaattgaaatgatggtcgagattctcgactgtccctccatggctttacattttccaacgccttgcagaaaaagaaaatgcaagcgaagccaaacggaacgtcttttgctggtcagtcgtccggctcagactcaattgtcgagcacatttcgaagaagtgacggggacggaagagaagagggaaaagccgagggagagagtgaggcacaaatcgaaccccattttgagagagaaaaagagagggaggagttgaagagagtgttcggactggagaatgaaaacatcgaggaattgaggcagagagtgatacaaatgaaggaaaagagaagggaagaccgacagagacgcagaagggaagacggacagagacagagcgaagagagtggggggacagagaggaagagaaacacatcatcggaagaggaagatgagctggatgaggaggagaaggagattctaatcaacgagattaagaagatgaagagcaggaggagaagagtggaggagcagagaaaaaaagtggaagagggaaaggtagaaaagggaacggaagaagaggaagaggaggagaaagacgaagaggaggaaaaggnaacgnaagaagaccat

SEQ ID NO: 60920 - DNA, 195 bp, Heterodera glycines
  misc_feature (30)..(30): n is a, c, g, or t
  Genomic contig location: Contig_ID=SeqID_30513; Location=1309..1503; Strand=-
  SCN-specific regions: Sequence locations=1-195
ttcaagtgtccgtttgggggtactcaaacnaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 60921 - DNA, 1496 bp, Heterodera glycines
  Genomic contig location: Contig_ID=SeqID_30514; Location=271..1766; Strand=+
  SCN-specific regions: Sequence locations=1-1212,1235-1496
atgttggaggacgctcagaaaaatggcaccaacatttcgctcaagaaaattgaggaggaacttcgggcaattcagcttgtcaaggagagcgccctttcgctggtcaacccaccaattgccacaaacgccattcgcacaaggccacggcaatggaccgacccagcgcaaagacaaagcggcggctccaatcaaaggcaaactccaaatgccaattcaagcggaaagccaacgcgtggtcaacggacgcatccatgtggatcatgtggcaaaattgaccactggcgctccgattgctcattcaaggacgtcacttgcctcaagtgcaacaaaaaagggcacatttcaacaatttgccggtcaaagaagacaaaggcaccaccgaacagccaccggtcattccacactgtcaaaatcgacgcaaattgcttacatgtcggcacgactcaaggacgatggtggaaattgtgcattttgattaatggaaggcaaacttccatgaatggcgacaccggcgctcaagccacaattatttcattgcaaacatggcgagagttgggagaaccggaactgactccatccgatatcgatgccaaaaactgcaatgatcagccattctccttacttggcaaattccaatgcactgtccaatttgccgacaaaccaccgcaaattctgatcgcttatgtgagcggagaagtcggacataatttattgggattgccgtggatcgaagctttggagatcattccccgccaaattttatttccgaccaacaaatcggatcaggcgacaaaaatgatcgacaatttttcggcagtgaagccgccaaacaaatcgatcaataatgtgtcaacgcttaaagcggtactccaaaaagatttccctgaagtctttgaagaaggactgggacactgctcaaaggcaaaggcgcatctcattttgcggtctgatgcaaagcctgtattttgccgagctcgcccaattccacatggcgccatggaagctgtgaatgccgaattggatcgccttcttcaaattggcgcaattaagccaatcgatttcagtcattgggcagcgcctatcttagcagtaaaaaagaagaacggcaaaacgagagtctgcatcgacttctcaactggcctcaacaacgcactggaattgaaccgccatccattgccaaggccggacgacatttacgcctcactgaatggcgcaaaatttttctcaaatttggatttacgcgatgcgtatttgcaaatggaaatggatgaagaatccaagcaattgtgtgcgatcaacacacatcgagggcttttccaatgccaacgcctgccgttcggagtcaaatcggcaccggcaatatttcagcatctgatggaccaaatttgtgccggaatcccaggagttttcgcgtacctcgacgatggactaatcgccacgaaaaccctggagcagcacatcacggcactttacactctttttgggcgcataaaaga

SEQ ID NO: 60922 - DNA, 960 bp, Heterodera glycines
  Genomic contig location: Contig_ID=SeqID_30514; Location=433..1392; Strand=-
  SCN-specific regions: Sequence locations=1-960
gcagactctcgttttgccgttcttcttttttactgctaagataggcgctgcccaatgactgaaatcgattggcttaattgcgccaatttgaagaaggcgatccaattcggcattcacagcttccatggcgccatgtggaattgggcgagctcggcaaaatacaggctttgcatcagaccgcaaaatgagatgcgcctttgcctttgagcagtgtcccagtccttcttcaaagacttcagggaaatctttttggagtaccgctttaagcgttgacacattattgatcgatttgtttggcggcttcactgccgaaaaattgtcgatcatttttgtcgcctgatccgatttgttggtcggaaataaaatttggcggggaatgatctccaaagcttcgatccacggcaatcccaataaattatgtccgacttctccgctcacataagcgatcagaatttgcggtggtttgtcggcaaattggacagtgcattggaatttgccaagtaaggagaatggctgatcattgcagtttttggcatcgatatcggatggagtcagttccggttctcccaactctcgccatgtttgcaatgaaataattgtggcttgagcgccggtgtcgccattcatggaagtttgccttccattaatcaaaatgcacaatttccaccatcgtccttgagtcgtgccgacatgtaagcaatttgcgtcgattttgacagtgtggaatgaccggtggctgttcggtggtgcctttgtcttctttgaccggcaaattgttgaaatgtgcccttttttgttgcacttgaggcaagtgacgtccttgaatgagcaatcggagcgccagtggtcaattttgccacatgatccacatggatgcgtccgttgaccacgcgttggctttccgcttgaattggcatttggagtttgcctttgattggagccgccgctttgtctttgcgc

SEQ ID NO: 60923 - DNA, 830 bp, Heterodera glycines
  Genomic contig location: Contig_ID=SeqID_30515; Location=123..952; Strand=-
  SCN-specific regions: Sequence locations=1-39,85-193,215-315,348 -407,440-533,556-608,651-709,732-830
  Gene Ontology: Biological process=body morphogenesis (sensu Nematoda)
atgcactacaattcaaaagcgttcgcaaaaaatgacaagtaataatttaaaaataaattaaatttattaaaatttcattttttaggcttgaaacaatcgaaacgattgacaaaaactatcagcaaacaatgggatggcgcctgggcctttcatttttggacgccaaagcgattaatcaccgctattgcgaacgtaattaaattaattaatatttgtcaataaggcgtccattttgatttcaaaaatgaaagaaattgacaaaaaatgggaaaataatattaatttggatatcaatagttttgtgcacaaaaatacaaaatactaataataaattatttagttttttaagtagcgagtttgaccatttttgattgaaaattctttaattgatgaaaaattatttagggaaatatatttttgtaatttaaaatattttttagtcgtcttatttttggtgctgttaccacttcgacaagaaaatttaaaaattatcaaagttttctagcaaaagttttatgtatattactaggtccaaattatttttaaaatatttttggtttaattgacccaatttcatatgaaatttcacattatattttacctacaagaaataaacatttaaattatttattaattatttttatttattagatgtttgtgacgactatccatggcattcgccggattgtcgaaataacggctacgcaaacccgaacaaatgtacggaatgtttatgtcctgatggctatgcggcaccgtactgtgacagtgttgagattggccatgtcaatggagaagcgggtaattaattaatttgacaattaattaaa

SEQ ID NO: 60924 - DNA, 146 bp, Heterodera glycines
  Genomic contig location: Contig_ID=SeqID_30516; Location=116..261; Strand=+
  SCN-specific regions: Sequence locations=1-79,113-146
atggctatctcttttttgaggaaattttctatgcaacaaacgctctcgaacatgaaacgaagtgcggtgcgccatggccattttatttttcaaataatttttatatttaatagatattccagaaaaatggctatctctttttttga

SEQ ID NO: 60925 - DNA, 146 bp, Heterodera glycines; identical to SEQ ID NO: 56264
  Genomic contig location: Contig_ID=SeqID_30516; Location=368..513; Strand=+
  SCN-specific regions: Sequence locations=1-79,113-146

SEQ ID NO: 60926 - DNA, 146 bp, Heterodera glycines; identical to SEQ ID NO: 56264
  Genomic contig location: Contig_ID=SeqID_30516; Location=620..765; Strand=+
  SCN-specific regions: Sequence locations=1-79,113-146

SEQ ID NO: 60927 - DNA, 146 bp, Heterodera glycines; identical to SEQ ID NO: 56264
  Genomic contig location: Contig_ID=SeqID_30516; Location=872..1017; Strand=+
  SCN-specific regions: Sequence locations=1-79,113-146

SEQ ID NO: 60928 - DNA, 66 bp, Heterodera glycines; identical to SEQ ID NO: 59916
  Genomic contig location: Contig_ID=SeqID_30516; Location=1124..1189; Strand=+
  SCN-specific regions: Sequence locations=1-66

SEQ ID NO: 60929 - DNA, 657 bp, Heterodera glycines
  Genomic contig location: Contig_ID=SeqID_30517; Location=422..1078; Strand=-
  SCN-specific regions: Sequence locations=1-69,93-360,382-657
caggacaaaagcagcaacagtgcttctggttcgtctggtgttcagcagcagggctcaagtggaaatgggagtggtggcaatggtcctggcgggtcgtcatcggcaaaaagtgttgggaatggcgtcgccgccacaccgaacacacaccatggccacgggggacagaggtacggttaattgaacaaatgaaaatagggaaaaatgccgataaacttggggcgtataaattggattggagtttgcttttacaatctgttttcagttcgtcaggaagaccgcaccaccacacaaatcagcagcctcagagttcgtcgagtgtgcaacaggacgccaggtttttttacgcctattatactatttaaacaaaatccttttcatttatgggaacgtttcactttttgcgctgaatggacttacaaaacgctttcctttggtttagggctcagcgtgccaacgcctttctgtccacaattgtgccgcggatgcagcaaatgctcggctcgaccaccggcgggggcagtggcggaagcggtggcacaacgactaccgctgcgctcgacctgaacattgcgggcggagctgccggactcatcgacgccacagcaatgcccaccttccatttctcgcacacgcatggacaccaccagcacgtgtcaa

SEQ ID NO: 60930 - DNA, 855 bp, Heterodera glycines
  misc_feature (81)..(81): n is a, c, g, or t
  misc_feature (148)..(148): n is a, c, g, or t
  Genomic contig location: Contig_ID=SeqID_30518; Location=1..855; Strand=+
  SCN-specific regions: Sequence locations=1-150,172-723,752-855
gtgcaaaacgacatttacaatgactggacgcatatttgtcaaaaagtgagcctctgaaaagcctttgctttatccgtcgtntaagctcaaactgaccttctacaattacaagtcgtctattgagaaatacaacagagaaacttttccnggtaattgctttttattttgttatatcaattaattaggtcattaagttctaatttcatttctatttttgacagacatacggcggtgaaaattctatttgcgaactttcaacggcaagcgatggcaactttttggaggttctcaatatttccatgaacagtttcctggcgtaccattctgaccgccgatttgaaaccaccgggcaacaggtaaccaacgaaccaatcgatttgtcgctattatacaatacaccgaccaaattttgaattatttacatgtcgaattaattttaagattattttcttgaccccgggcagcggtgtttttaacgtggacagggaaatggtgaatttgaccaaacaacggatcattgacatgggtaacactttgggttactttctttttttaaattttggttcatttccgtcggttcctttttcagggatttccctggacatcgtatgcctcggggaacagcccctccacgccgttccgttgttcgtcttcaaacacaaatcgccccaacaaagcgacgactatttcataccgtaccaattggatttacttgctttctcctttaatttatcttttttattattaatttcagtcattggatgaactattcctatttcaatatgccccgaaattcgtccatttcgtccaaattcaaaactcgcattaattttccagaagacattgttaaggtgc

SEQ ID NO: 60931 - DNA, 673 bp, Heterodera glycines
  Genomic contig location: Contig_ID=SeqID_30519; Location=19..691; Strand=-
  SCN-specific regions: Sequence locations=1-102,128-226,255-388,442-673
atgatcaaagcgggtgagacagttgaattcggcttgtattctctgtgttccattgtgattagaattctcaaaaaacgggaaaaaagtgccgagaagtaatgccaattttatgtttttatttattagtaaaatatgaatgttttttttttttgtttttagtctgtgcccaccgatcagcagtttgccagacgaccaatttaatgttgaaattggtgagaaaaaggtgaaaaaataagtaaaatttaattttaaatgatcaggaaatcttaacaattagattttattaatagggttttacatatgaaacttagatacaaaatttagctgataaatttttttgtcaataatattaacataactttattaaaaaaacaaaaaattgtcgatgttataaaaagaaaattattattttcaaaaataaaagacattattttattaaatgtaacttgtaaaaaagaaaaaaagttttttaaacttttcagatcgatctgtcctcccattttcttatgtccgtttcgccggtgatcaatcgaatgctcagcatggagatgaaggaaaagcagcagcgaacgctcactttggacgagttgggcatcgacatggagcagttcatggaatttgtggaggccatctcaaccacagctatccacaagccaattctaccaaatcgtaa

SEQ ID NO: 60932 - DNA, 144 bp, Heterodera glycines
  Genomic contig location: Contig_ID=SeqID_30521; Location=32..175; Strand=-
  SCN-specific regions: Sequence locations=1-78,111-144
atggctatctctttttttgagaaattttctatgcaacaaacgctctcgaacatgaacgaagtgcggtgcgccatggccattttattttttcaataatttttatattaatagatattccagaaaaatggctatctctttttttga

SEQ ID NO: 60933 - DNA, 146 bp, Heterodera glycines; identical to SEQ ID NO: 56264
  Genomic contig location: Contig_ID=SeqID_30521; Location=282..427; Strand=-
  SCN-specific regions: Sequence locations=1-79,113-146

SEQ ID NO: 60934 - DNA, 146 bp, Heterodera glycines; identical to SEQ ID NO: 56264
  Genomic contig location: Contig_ID=SeqID_30521; Location=534..679; Strand=-
  SCN-specific regions: Sequence locations=1-79,113-146

SEQ ID NO: 60935 - DNA, 146 bp, Heterodera glycines; identical to SEQ ID NO: 56264
  Genomic contig location: Contig_ID=SeqID_30521; Location=786..931; Strand=-
  SCN-specific regions: Sequence locations=1-79,113-146

SEQ ID NO: 60936 - DNA, 1431 bp, Heterodera glycines
  Genomic contig location: Contig_ID=SeqID_771; Location=3432..4862; Strand=-
  SCN-specific regions: Sequence locations=1-281,303-337,362-712,737 -1331,1353-1431
  Gene Ontology: Cellular component=nucleoplasm; Biological process =mRNA splicing
aggtgctccagctggagccagacacaaatgtggaggatgcgcgcaagaagtacaagaagttgtccctgctgatccatccggacaaaaatccgaactgtcgggagagggcggaacgcgcatttgacgcactgaaaaaggtacgcaccaaatccttccatctgacatttctcgcaatcagaaaaatgactcatggagatggattgggttgtttcctggctcccaatactctccaagtaccaccaattaagttgtatgtgggcaaagttcctttcatactttatcagcatttctaagacaattattgatattcaattattactaatttataagtgattggagaattaatggataaaacaaaccaaaaactctaaatcgtattcatttttcttaatctctgttccctttcccaattattcagtcattgcattttgccttatttgttagcaaagtttaattggttaaggatgaaaggagttgtttttctccaatcccctatataatttcaacaaaaaagtaaaaaattcggaaatgattttacaagtttcggtgaaattcttttcgttctataggcaatcgccaccgtcgaagacccggacgaattgtcacgctgccgagacatgtacgaggaggccaaagcgcggctggcagtgcaaatcagcgagaagaagcgcaaaatgcgaaaggtttcccatttttatctcaaaaatcgaaattccatttaaaatgtattcatttttaggatggaaaagctgacgccattgaagaagaaacaccacagggctacgcacgtgcactttggatcaccgtgacaaaggttttttctcatttttaactatattgtgggtcaattgaaatgttcaaaaacccagtatatcgtttgacccaaaaaaggctttgggatgagcaaaaaattgccaaaaaatgaccatttctatcctatcgaaaccacgaatatgacatccatttcggtaaattcgaaccacggtacccgaattcaaacaagaaatcgaagatttaaaattgaaggtttaacttaatgtttgaattcgggcacggggttcgaaatttgtcgaaatgggtgtcgtatcggattgctttgtcaattatttgaaattgcgatatacaaaatgccagaatcagatttcattttttatttgaaaagggatacaccacattttgcaggtgtttgccgaccgggagaagaagcgacggacgctggaggagcgggccaacgaggagaagcggcggttggccgagtcggtgcaggaggcggcggagaagcgcaagttggaggaggagtacaagaagaactatgaggagagccgggacgagcggcgcggctcgtggcgcgactttgtgaagaaaaaggagcgcaaattggagcccttccgtggcgccaacttcaaaccgcccgcccccaggttggagacg

SEQ ID NO: 60937 - DNA, 306 bp, Heterodera glycines
  Genomic contig location: Contig_ID=SeqID_773; Location=2086..2391; Strand=-
  SCN-specific regions: Sequence locations=1-25,48-222,244-306
aaaattttatcttttaaattaatgctaataaaattgaatggaaagagacatttattccatccagggattttgctgacgtcctcaaaaatttcggcaatcgggattccaagcctaaaaatgtcggaatctgaaatcggcattctggcatttttttttattcttcgatttggcgcagtttatgaaaaaggttttgatttgatgttcctgctgatttcgacgttggatttgcttcaaaataaaaaagtttttaacacgaatgttttcaaagaaatagtacataaaattgccattagagaaacaaaggaa

SEQ ID NO: 60938 - DNA, 294 bp, Heterodera glycines
  misc_feature (259)..(259): n is a, c, g, or t
  Genomic contig location: Contig_ID=SeqID_774; Location=4..297; Strand=-
  SCN-specific regions: Sequence locations=1-83,108-134,156-294
atgtcggagcacaaaaaatgtgccgccgccaccattttggcacttttcttatttttggcgttttgttcatattcaacgacggcacaacaacagcaacaacatcaaaagcagacaccgccggctgaagccgaagcagcggaagaggaggatgaaaatgccgctgccgcttcctacgacgcgccggtagtgacagtggagcgggaagagtcgctgcccaagccaccaccggtcgcgcacagtaacgacgacggcacgccgngcaccgtacactcactggacggtagagtacagtaa

SEQ ID NO: 60939 - DNA, 3975 bp, Heterodera glycines
  Genomic contig location: Contig_ID=SeqID_6264; Location=560..4534; Strand=+
  SCN-specific regions: Sequence locations=1-164,210-960,982-1276,1298 -1345,1384-1893,1915-1933,2006-2012,2034-2322,2348-2619,2642 -2828,2888-2963,2985-3329,3354-3571,3595-3749,3847-3891,3943-3975
atgagtcatgcattccgtgtgccaccgccccatcgcccacagtgagaatttctccccattcattagggaatcattttgaagattttgtttatctttttcagagcaaagaggcatatcttctgtactacaaactgaccaactcaactaactcacaggccaagtgatattaatattattaatttattattattattatcattattattatttgtacctgtgttctgttcccgataccatccgattgtttctttaaaattaattacccatagttttttttaacctttttttagtcgccagtaatatttaaagacagcgccccctaatgatattaaaacaaaattttgttcaaataaccacttcttaaatgaaatgacaaaaatcttctttaaaatgtgatgaatttaattgagtgactcaaaaattgcattatttctttaaaattgcagaaacgaaggccagggcggcaaaaacgacgatgacgacgaagatcaatctgagatggaaatctttaacagacaaatcaccgatatttgccaaatgttgcttgctcatcatcacaatgaagttgagaaagttggccggctttgcgcacaaatgggcgaagcaattcgccaagtattggccatccaacaacaaatcccaaatcccgacgaagttgaacaacaacatggggaggacaatggcagggacaacagaaacaattgttctttcgacgaagatgaaagtgatggcgaaagtgatgaccccacggtggagcatccgttgccagccgctcgtcgtgtgcttcgtcgtctcaaattgcccacaattcttgacattagtgccgcaaccgaagcagatgtgcaagaatatggcacaaaattaagtgacaccattaaacaaatcaccaaattacgcgttcaaaacggcggagcactgacaagcgaattggaattgcggagcaaacagaaacaagcacaaaatctgctgcaacaaattggcaatttaatgccacaattggtcgttgaagaagaggaagtggcggaaatactcaatttggccgaacaaagcgccgatcgcttttccattggatttctgaacaaggaacagaaaaagcaattcgaagaagcaattcgacaagcaaaaaaggtgtgcaacacaggggaatcaacgtcgggagggagcagtttgacccccccccccccccctcttaaatttccttggctcccggacaatccatcaatggtaaatctctcagcgcaataattattttgtctggtaaatcttaagaaatatttaaataaaaaagtattgagtagctaaaaaagatgaaaaaatccttggaagatttttttaataaagtatttccttataatgtcattctaaaatatttttatcaattgtctgaaaaaaaatttttaccgacggattgaccactgagcgattgtccgaatacctttcttccttcaccatcagtcgagttaagcattttgaaaatgtagaaatccattgatcggctgagtcattaagtttaacaaataataatttgtcaaccaccacctgtaggctttcgagattctgttgaagcataatttggacagtttggtggacaaattttatgaggactgttacaaaaaactgcttcatgttggcaatgaaatattaaaacgagcaaaattgacgaaagagtttgaggccaatatgctaagtgcgcggatcattggactaaacatgcggatggagatggtgagttgagaagacatagatatagcttaacaaacaaaaaaatccaatgaatttttgccggtaatttatgaacatttcacttttttgggtgtgggaaattaacaaggcatgtgaaatggtaccttagacatatttaaacaataagccaaatgtgtggttttcaaagacccgggttttcttggaaaagtattaaaattagaagttcaacttttattaatattttttagttttcttttatttttttaaataatgaataaaaatattttttaaaattatttttgttcgctactgttatttttgggcctttaactttgagaaatgcaggacatgaacagctaaattgcctattcatttgacaggcgtcagaaactgcccacgctttgctgcagacactctcccacaaaacacgtgcggtccggcatttggtacatgaagcacagaaacagcttcacgacattatcactaatgaggcggcaaaagccaaagacgcggacgaaaagcccacgcaatcggcagacaccaccaacatggtgcttattatttagagaccggtgtaataaaaatttattttcgtggaaaaaattatactaaaatggcattattttttaaaaaatttaattttgcaatttacaggagaattccctggcaaaaattcaaccaccatatgcagaaaatgaggacttggcagcactttttgactttgattctcatgtcaaaaatgcatttttgggttttggattgtttaaatgtttggaattggataagtccgagttacgaaatgcctatgaatggctaacagaaaacagaaacaaaatcggaagtcgtcagcacattttgacgttgcaaaatgagtttgaagcaaaaatgttgaagtttcgtatgaacaaattgttgtggaaaatgaaaaggtgggtgatggaagaaagaattgttaaataatttgcaaaatttaaattcctttaaaaatttaaatgtaagaatttaaaatttcacatttttatggcttactttgccctacaatttttcttaacgaatttttcgtcggtttctatccacttttgattagtgattttcggattgtcatttttcgaaagtttgatttgaaaatttattaagatagaatttaaaaaatgataactaatttgaaaaatttaaaaaaaatgaattgaagtttgtctattcttttacgcttaaattgttgggaaaacattacaaaatactaaattaataatttgtacagggttgaaaatggtgaacatgacttttgcaagttggcagaaaaactggcgaatgatcggattcagacggaaaggaatttgaaagtcgaagcagaattgacaaagaaagcagcgatctctgcgcagaatttgggtctgccggttgttgaacacataaacggatatatcgacgcaattaatcgttcacaacaggtgaaaaaaagaaccgaaaaatgttgtgttcatgtactgtatgtattatgatgtacatacagtatgataacacaagagaactcaagaaaactcctgccttaacgatacaatttattagcgaacattagtggttttctttcatttgcgtttaaagaacctgaaaaattctggaaaaccctgtttctatttaaaaaacaggacagggctaaaaaactgctgattaattgaattgatcactaataaaactgtgcccccccccctctcctctctagagcttcgagcgtttgatgggaaaagaagtggtcagtgatgctgatcagttatcatttgaacaactcgtggacaaaatcatgaacgacggcggtttctatgccaccaccgaatgcatgggtaaaacaaatgatgatcaaaaagccaaattaattttaaaataattaatcgaattaaagggggatttttagcacataaaaaatattttttttttgaattttcgccataattttgtgtgttgccaaaattgttaagaaaaatgtataagcgtaaaaatgaaaaatttagtcggacataaaaaatcttttcttcgcgagatcacacaaatttttaatatttttacaattttttactttcaaaaatttatcgcaaaattatataaataattaaaaaaattttaaattttattctaaaaaatttacttttagaaatgtatgaaatttggctcttaaattaaacaaataccaaataattaattattttttaatcattctttatcgtttaaattattttaaatcccaacatttaatttaagaaagggaaaagctga

SEQ ID NO: 60940 - DNA, 244 bp, Heterodera glycines
  Genomic contig location: Contig_ID=SeqID_6264; Location=4905..5148; Strand=+
  SCN-specific regions: Sequence locations=1-244
atgcgcggtttgatgttgcaagtgtcgaccggcgaaggcaaatcatggattgtcgcgatgttagcagtgattctgcatacgtttggcaagaaggagccactggctgatcagcaggaaggggctcagagtgatcaggaaaaggaaaagcatggtcatggtgaaacaagcactgatcagacggagaaggaacctgcccatggtgcatcagacattgataaaacgaaggcggaagagtcccctcatg

SEQ ID NO: 60941 - DNA, 984 bp, Heterodera glycines
  Genomic contig location: Contig_ID=SeqID_30522; Location=566..1549; Strand=+
  SCN-specific regions: Sequence locations=1-904,926-984
tcaattcacttttgtgcatcagcaatttggaggcacatttgtgcaaattttcactggtcatcgactcaatgcttttgctcagaattctcatgcacaaattgtcctggtcggcttttcactttgtgccctttctctgctttccgctgttaattcgttgtttgccccagggacctttgtttggtgccaaaaaaacggctgctcggctccggcttggccgtcaccggtgcccccgggggtccgtcgaccgaccccagccgaagggcccattcgagctgttctttgggcagttcgttcaagtgaatagcccggaggggagagagagagctcagcattgtttgctttcagaagggatggccaaaacagtacgaagaatagcagcagcaaacactttcttcgcgttgactacggcggctcttcgcgactgtccaaaagagtgcacatccgtcgctcgaggcacgaattggctaataaaggctggcttactcactgggccgttgattgatcgctcctctgatcagtcgaacgaatgcttttcctttgtttagctcagttgaaataccgcggccgaaacgatttagcagcggcgcgaaggaattgaggaaagaacggaacagaaaaaggtacgaaagtcatcggttgggcaatggcatttcgccgcttcagactcggcactgacacgagcagtgggtcctccaagtcgaagaagaccaactcctcctccacgtccagcgtccagaaacacttgcccaaatacatcaccaatcttttccgcgggcgcatgggcaccggtaggaggagaaatacgcttttctaccaaaagcactcattaacgatccgtgcaaacgacacgcccgaggcagtcgcgagtcgagcccagaaagtccgaccagcgggtcggaggcggttttggaattcacaaagaaattacaaaatgcgccgccaacgcgtcgcgaaacaatgcgaatggcgtacaaacagtcgggc

SEQ ID NO: 60942 - DNA, 660 bp, Heterodera glycines
  Genomic contig location: Contig_ID=SeqID_30523; Location=70..729; Strand=-
  SCN-specific regions: Sequence locations=1-133,155-189,211-399,428 -531,553-568,590-660
atggccttaaatctgacctatcttttaaccctgagcttgtactgctccaactccatgcatgaagttggagctgtacaggtttgttgagaacccagagaccaaatctaaagccatattcggactcagcgtggtcaatttatttagtttaattaaattcggaatttccaaaaccacttttaaaacattttgttatttgatggtcttgaaaaatgccgtttttggagaccatttttagactcggccctccaataattcatttttgaagtaataaaatttttttacaatcatttattgcctaactttgctaatttcttgcagatttaaagctatccattgcctgccggttctcggcacagcaaagcactaatagggtgtttgattcacttcaaaaaataattcattacccaaaagttttttacaaccacttattgccaatctaatttcttgcagatttaaagccatccattgcctgccggttctcggcacagcaaagcactaatacggtgtttgactcacttcaaaaaataattcattacccaaaagttttttacaaccacatattgccaatctaatttcttgcagattgaaagccatccattgcataccggttctcggcacagcaaagcactaatagggtgtttgattcacttcaaaaaataa

SEQ ID NO: 60943 - DNA, 392 bp, Heterodera glycines
  Genomic contig location: Contig_ID=SeqID_30524; Location=483..874; Strand=+
  SCN-specific regions: Sequence locations=1-264,286-307,329-392
atggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaa

SEQ ID NO: 60944 - DNA, 155 bp, Heterodera glycines; identical to SEQ ID NO: 51421
  Genomic contig location: Contig_ID=SeqID_30524; Location=610..764; Strand=-
  SCN-specific regions: Sequence locations=1-155

SEQ ID NO: 60945 - DNA, 268 bp, Heterodera glycines
  Genomic contig location: Contig_ID=SeqID_30527; Location=668..935; Strand=-
  SCN-specific regions: Sequence locations=1-268
tatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctagaattatcagagtgccgaaaatcgcatgtgatctaagcctagcaaaaaatggtgtaagtaaaaatcgtaattacgctcaaaaagcttctcaaa

SEQ ID NO: 60946 - DNA, 105 bp, Heterodera glycines
  Genomic contig location: Contig_ID=SeqID_30529; Location=1306..1410; Strand=-
  SCN-specific regions: Sequence locations=1-14,36-105
gaaaaccgcaaattttggcttttttgtggataaatctgttaacaaattgcattaaaaaagcaaaaattgtccgggcggcgcctatcggcaccgccggcccccctt

SEQ ID NO: 60947 - DNA, 85 bp, Heterodera glycines
  Genomic contig location: Contig_ID=SeqID_30531; Location=1187..1271; Strand=-
  SCN-specific regions: Sequence locations=1-85
atttctagtgacgaaaaatgacgcccaaatgaaaaaattttaacgcagaaatgcgtttttagagctcctttcttcaaaacaattg

SEQ ID NO: 60948 - DNA, 278 bp, Heterodera glycines
  Genomic contig location: Contig_ID=SeqID_6266; Location=2287..2564; Strand=-
  SCN-specific regions: Sequence locations=1-278
atggagccagtcggagaacgggcaccaacagagccgcagcagttgtcgtcactcatgatgaaaacagcacaaaatgaagaaaaaattgtcaatgaggtaaggaaacaaaaactgctaaaaatggcaatatttcagattatagagtacaaacaaaaattccgccctcaaaaacatggactcaataaagtatgctttgaaaagaaaaatgctatgtatagtatgcacatttaatggctgctctgtcttttgcttgaatcggtcgctacgcgacgaataaa

SEQ ID NO: 60949 - DNA, 1946 bp, Heterodera glycines
  Genomic contig location: Contig_ID=SeqID_6266; Location=2623..4568; Strand=+
  SCN-specific regions: Sequence locations=1-62,85-304,326-784,806 -1896,1919-1946
atggccatcaagaaacgtcgtcacttgctcgaggacaagcagcgcgactaccaacgggagctgctccactcgcacctcatccagaacttgtgtaagttcctcggtgaaggtcgagcgcgagtgaggcgacaccgccgcagttcatcgcggcgtaagttggtgagacgtcgtcgttgggacgacgacacgagtggaaacggtgacgagaggggccagcaagtggtccctgacgatagccgatcgccttcctcttcccccaatccatcggggattgtgtttgagtcgacggttcagagcgatgccaattttggtggtgatggtggaggccggggcccacggtggctcaacaaacgctcttctcactctgacgacgatggacctccgatgaaacgaaaccgggcggactcttccgaggatgggctcacgttcattgatctcaaccaaccttgtgaggttgggaagttcgatggtgagttaattcattttccttttgcatattttttctcattgttttcctttctttttaggagaatttgcagatggtggacggatattctgatcggaatggcatggtcgtcatgatatgattacagtttctttccttttttctacgtgtatttttttttaccgcagataaataatttatagatcacagcgagcaaaataatcactggaaggtcttttgtgtgtagagcatttatgcgttctctcatactggcaagttgaacgtataatttaaacgatcaatggtgatttgtcatttatccaacgttactttttctagttttaattgcagaaaatcgcaactttgcgcggagttttaagtaatgagtagtttctatcaaatctgtttatatcatttctttgaatagttttgtaaacgaattggtgtctcatcgttaagaaatgctcaaacattgcacccaaattcgttcatttgccacccaccaaagcattttctacgacgtggtcattgtcggtggtgggttggtcgggagtgcgatggcctgctccatcggtttgtgcttggcattgcaaaaagcattgggggcggcttttcaggcacaaattcggctttgggtccatccacgagggtgctcctgttggagagtggacgactgcacagcgtcaagcagtcaaaagaagccgaaaccaaacacacttatagcaaccgcgtttccgcggtcagcccatcctccgttgaaatgttcaaaagtaatcctgagtctctcaaccaagtgctttatccgagaatatccaaattcttacctatattgttgattctgccaatccaattccatcctcttcccttaaaattagccattccttttttattcagaattcggtgtttgggatgagatttgctcgaagcgagttcatccaatttctgcgctttacgttcgtattatttttctggttcaacccattaaaattagtgaagaaaagaaacgaaaaatcaggttgaggatggctgtgccaaatccaaaatccatttcaaacaattggataagcgttcaccgattgctcacatcgtcgagaatgagctcatcgtcgccgcactgcagcaatgcattcgggaccgatgtgccaatgtggaagtgcgccaaggcgcggttgttgaccaaaatttgaggtttgaccctcaacgaattgcggcatcaaagtttcattttatgtcttaaattggtttatggatgcatcaaaattatttttgactcggtggttattaagagcttttaaatcgaaacccaaagactgttgtgctttcgaacgttgaataacaatttgtgtcgggtcggatagtttcatttctcgcattttttcttctatgttcacttgcatttctgtgtttttaaggacattcattcatattttcagtgttcctgacaatctcggccaaaatgtcaccattcagttcgaagatggcacaattgaagcttcattga

SEQ ID NO: 60950 - DNA, 704 bp, Heterodera glycines
  Genomic contig location: Contig_ID=SeqID_30532; Location=412..1115; Strand=+
  SCN-specific regions: Sequence locations=1-268,290-597,619-704
gttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaatt

SEQ ID NO: 60951 - DNA, 501 bp, Heterodera glycines
  Genomic contig location: Contig_ID=SeqID_30533; Location=247..747; Strand=-
  SCN-specific regions: Sequence locations=1-501
atgcgccagcacccggacaaactccgccaagttgtgggcgccaactttgaattcctcaacaatgtccaaaagctgttggcaattcaggtaagcaatgggaaaagtgcatcaaagtgaccgagacattacttcgctaccagttttttcgaaattttgtccaattaatcatggaacggctaattgtcttaaaaacccaatatttttatattttattactgttttccagccgtcaaacatcagctcgaacacctacttggcgctgctaaaatcgctgcgctacatttgctcgcagtatttttttttgaaattcactccaaaacaaaaccgaacgtggatttgatgctgcggccgccgcaacagttgcgcgagatcatcagcctggttgagtaaggacagcgaagagagacaaaacagagcaaaaatggacaaaagacacgaaatcaaaacctataacattttccggctatgaattgggctcgagtattccttcctcccaataaa

SEQ ID NO: 60952 - DNA, 780 bp, Heterodera glycines
  Genomic contig location: Contig_ID=SeqID_30534; Location=189..968; Strand=-
  SCN-specific regions: Sequence locations=1-524,546-603,625-746
atgggccaatatttgaagaccgagctgagctcggaccagttggagttgcacttggccgacggcacggccagtgtccaaggcgtcatgctcaacacggagtacatcaatgagacgttggaagcatcgggtgggtgtgggggagaaaaatggacaaatttttacgcatttttgccaattttttgtgccatttttgcaacatttccctgcttttttttagaaaccatccccaaaaaatatgtgaatgcaatcattagagttgattggaaccgggtttggtatcaaaaattggcgttttcttcgaccctatcgcaaatttttcaaccagttcgacctgacttttctaaatggcacatttatgggcccaactcaactccaaatctaaagttaactgctttttaacccacttttttaggtgttcgaatcctttcactgaaggatggatatgtggaggaactgaccgtttgtgtgccatggaaacggctgttgctcgactcgacaattgtcaaaagtatgatttgccaactcagttttttcatacaaattaggcgttggaatggaaatatttattaaatgtaagcctctgggaccttgaaaaaatgtcgttaaattttcaaaaattttgatcgacgcacccctccatttttcattgaaattttcaaaatttgcacttgctttctcccttgagaggagggcctaattatctgtaaattccaaacatttaaagctattatgcttgttttatttaacagttgagagggaaaaaagttttatggcaataaa

SEQ ID NO: 60953 - DNA, 142 bp, Heterodera glycines
  Genomic contig location: Contig_ID=SeqID_30535; Location=419..560; Strand=+
  SCN-specific regions: Sequence locations=1-142
attgtcttcgaagatcttttcaccaaagggtcgacgcgtcgcactgcggcacagaaattctacgcacttttggagctgaaaaaatggcaagccattgaagtggaacagcgcgatgctttcgacaccattgaaatttcggccg

SEQ ID NO: 60954 - DNA, 917 bp, Heterodera glycines
  Genomic contig location: Contig_ID=SeqID_30538; Location=295..1211; Strand=-
  SCN-specific regions: Sequence locations=1-569,592-705,772-841,908-917
atggcctttttcagctccgtttgcgctgcctatttgttcttcacccatttggcgtatcacaagtcgtggatgttcgactggtcaccgaaacgccttcaaatggcgtggacaattagtgggttaattgttaattaggaaagaaagtgccatttacgcaggagaaattacaaaatccatccaatgaataatttataaaattgccctaaggcaatagaaatttaataattgttatattaatcgctccctcattcgctgatcagatttggtcctttgtgtgctcacttttgtcggcatggccatttgtttgcttttggccgccctttggggccaatctttgacccgcgaagggctccaaggcgaaaatctttggatcggcgccgtttggttttggatgacttcgaaggcacggacaatcacaaagaatagaaagttaattttctcactgttttagtggactttggcttcatgcatttacacgagacattacgccaaagaggtgaaactgacggagcctttgctcgccttctcctccgaatatggcacaaaatttggcaccaaatttgaccgggggaatgggaagatggtggagaagggcacacagacggagtagcggaagaagacggcgaatactttgccaaaaaaacaaacaaacaatgatttaaaattgacctttagcgaccgatggtttctctgtccctccgatcattttccttttttagttttaccattcatttgatttttttttgttatttttatttattttatttttttgtaaaaacggcaaacactttcagatcaacaaacaaagcgtcgatttgcctgcccaccagcaaaggcaataaaggaaggaaggaagaagaaaatgaggagaaggagcagaggacggggagaaaaaggaagcaaaaaataaaattaaa

SEQ ID NO: 60955 - DNA, 876 bp, Heterodera glycines
  misc_feature (8)..(8): n is a, c, g, or t
  Genomic contig location: Contig_ID=SeqID_30540; Location=407..1282; Strand=-
  SCN-specific regions: Sequence locations=1-41,70-416,438-525,547 -554,580-599,633-687,709-876
atggaacnaaaagatgaagcgatagcattcactgagaaagtaataaaacaaatgttttaaatatatttattagtttttattgtttgagtacgaacattttattgtcatcgaatgcaaaggctcaagtcacaacgtggacaaattctgcgattttgtcggaaaaaggctgcgctacgaactgcttgaatttgtggagaaccccttggccatttgggtggacttttgccacgtccgcccaaaaatgatcggcccaacggaatgcccttctgccgacttggagaaaaatgggtaaaaaaagactaatttaaattcgaaattcaaatttggacagaaactcaattggcctgaggcattggctggtgggcattcaaatggcggcagaacaaaaggcaaacagcgcatttaagcgcaaattgagggacaatctgaggaagaagttggacgtgaagatcaaggaggactttgagaagggcagctttcacaatgtgcagctgaaatcggaatttgcagagagagaaaatctgcgaaaatggtaaaaatcaaaacgaaaattgaaaaataattaaaataattttaaatgtttaggcattttcattctcaaaaattaaaatgaaaattaaaataatttaaatgtttaggcacttccacactcaaatttaaacgcagaagcgaaagacaaaagttaacgacaaatgtttacatttattctttctttattttatctcattttatgaacttcgatcacattattaaatttatgacagacaattaattcaattcaactctgacttttgactttacagttgttcgaattgaaatgtcttttgttgcgaaaacggatttaattctttaaattgggccctctcggccaataaa

SEQ ID NO: 60956 - DNA, 835 bp, Heterodera glycines
  Genomic contig location: Contig_ID=SeqID_6267; Location=226..1060; Strand=-
  SCN-specific regions: Sequence locations=1-78,100-149,190-311,341 -494,516-721,761-835
atgtatcaaataaagttgggaaatttgttttttagagatttttggctgatgtcacagaataaattatccgaattgccaaaaacatttggattggactgcactccaaaattatatttcccacacaaatataactcagaaaaaaattatggtaaaaaaataattattaattaaatatttttatgttttaaaggtaaaataaacccaacactaccccccatggaagattattacccggactcaatgaaaaaagatgaattcgaaaaatttcaaaaatggtataaagaaaataacgatacgccttttttattaggtaaaaaagttttattattttttaaataaacaatttcagaggagcaattgaaaatttattgtggtcaggataccgaaattttgctaaaggcagtcttagcaatgcgtaaaatttttatagaaataacaagggatgaacttagtcctaatggtttcgacgtgtttaaggttagaaaacaaatttcatttttaaaatagaatttagacttcgaccacaattgcgggggcggccataaaaatttatcgggcgaaatttttaaaggcgaaacacatagcaatagtccctgaggggggggtttgaaaaaaagaacaatcaaagttttattgccataaaatatttcgagtggtttatgtttaaaaatggggttaacgcgagacatgcgggaaacgggggagaagtaaatatcggaggttaattaattttaaaaaaacttattcattatatttttaaggatttaatgtcgattttatatgtgggaaatacaaaacgattatagaatttcaggtactaaaaaattaaaataaa

SEQ ID NO: 60957 - DNA, 825 bp, Heterodera glycines
  Genomic contig location: Contig_ID=SeqID_6267; Location=1845..2669; Strand=-
  SCN-specific regions: Sequence locations=1-206,237-266,290-546,573 -731,753-825
atggcaaataaaaaaatttcttacgacctttactgtgaggcattaaccgacccattaattatccccccaagggatttggtccagaataatgtggatgtggtgctggaatcattttacctcattcaacaaagctttagtgaggtcgatcttttaaatgagcaaatatcaataataataaccacatacgcaatcccgagtggcacaagtaattaaaaaaaaattaattttttatttatgtttttagggaatcaattaaattcaacgaattattttaaaataaaagaaaatgtgagaatttcagttgcaaatgacgataattattgtctcttttacgcgatcatactaagcagattttatcaaataatcggagccaatgagtctttcgagatctcatatgatcagtttcggagaatttacaaaaacaaaaaacgacaaaaaaaccatgttttgcaactaatccaagagacaagaattgatccaaatagaacaaactatggcatagatgatcttttgactgtccaagagtattacgaccaagaatttccagggaaatttcttattgtggcgttttcaaaggttaaaaaagaaaaatcttaactttatatgtatgatttaggaatggagtttaaaacccatgtttaagggtcagggaccaaaaaaatatataatttgtatttttctcgaaaacggacattgggacggtaaatttcttcaatataatttcagttccaaaaattttttaggtttaaaaagtgttaaacagttttttgatataaaacattattactgcgtttattgtgaacaaacatttcgtgaaaaaataaa

SEQ ID NO: 60958 - DNA, 716 bp, Heterodera glycines
  Genomic contig location: Contig_ID=SeqID_6267; Location=3099..3814; Strand=-
  SCN-specific regions: Sequence locations=1-331,360-596,620-716
atggtaagggttatcaatagcactgggacgtcaatgcagcgccaccatatcacaacgaatttcagtattatctgcagcactgagacttcaacgatacgcggcggtatcacaatgactttgagtagagccaacgggaaggggttatccgcagcactggggtgtcaatgctacgcggcggtttcacaactgctttcagtagagctaaagggaaggcgtcatctgcatcactaggatgtcaatgctgagcggcgatgtcaaacgactttcagtagaactaaagggaaagagttatcatatttcagcccaatcatcaatttcaaggaccatttggtcctccgccgttgccgccgccaccaccagcattgatcggaccccaagtggccccacctttgaacccgccgccaagagggaatggcgatcgaatgccacgcaacggcggtcgttaccgtccacccacacccggaggtataaaattttttgaaatcggccaaataaaaataattatttgaattgctttacgtgaccctaggctacaaaaacgaagacgtcagcttttggaaattgatcccgaagaatttggtcaaaattcatttttcatatttataataaaaaaataaatctcagttgcccgactgcctccgccacctgtgccacccgttttacgacgatggcacgatcgtcatgatgatccacccccgccgggtgttggtgcataa

SEQ ID NO: 60959 - DNA, 1271 bp, Heterodera glycines
  misc_feature (31)..(31): n is a, c, g, or t
  Genomic contig location: Contig_ID=SeqID_30542; Location=83..1353; Strand=+
  SCN-specific regions: Sequence locations=1-234,257-277,321-373,395 -763,786-1140,1165-1232,1256-1271
atggcctcaaagacgacaactactcctgacncacacttcaatcccaatgaccgtgcctttgtctctacctgcacccatcttgagttaaacgcagcattggaggccggctacaccgtccgcaaagtcttccatgtcctacaatacgaccaatggagcgacaacatcttcaaatcttacgttagcgaaatgatggccctgaaaatccatgccaccggcttcccttcatggtgcagcagcgaagaggagaagaaggaatacattgaggagaaccgtcagcgatttgggattctgttggacaaggaaaagatgaaagctgaaccagggaagcggtacatcgccaaactttgcctcaactcactctggggccgcttctccatgcggaacctcctctccaaagcaataatcaacaacgacgaaagcctgattcgccaatataccgacgacaagaaaatcgaattagtggacttggaaatgatggatgaggacaacgatgtttttatgctgacttaccgaccaaaagaagaatttgtcgacgaaaataaatactccaatgtcgtcatctccctcttcacgacatctgcagctcgcctctacctctacgaagctcttaaaaaagtagccgacacccccgactgcgaaatcctttattacgacaccgatagcgttatttacgtgcaccccgaggaaaacgacccactaccaacaggaaagggacaccttggagaactaacagacgaaaaccccgaccacgatatcctggagttcattagtgctggctgcaagaattatgggatgaagctgcaacgcaaggacaccggtgaaatagaacatgatttgaaaataagagggttcacccttgatgcacaaactgttcaaaaaattcattacgatactgttaaggaccaaatcttacgttatgggtccgatgaccccgctgaccctatcattgtaacttacccccattttattcgccctaatctaatccaaggtaaagtgtatactcattccctcacaaaacattatcaacccatattcacaaaaggtattattaatgattcattccaagtcctcgaatttggttatcgcaaatgataagtatgcattctcaattaaattttctgtatattagttttcttattgttcccttcttttctttctctctgtttatatcactcatgtgggacggaatgacccctggttgatcctctccaacactccaggccatccatctgagatgaaggtggacgagctgttcattattgtaacttata

SEQ ID NO: 60960 - DNA, 80 bp, Heterodera glycines; identical to SEQ ID NO: 51817
  Genomic contig location: Contig_ID=SeqID_30542; Location=1545..1624; Strand=+
  SCN-specific regions: Sequence locations=69-80

SEQ ID NO: 60961 - DNA, 328 bp, Heterodera glycines
  Genomic contig location: Contig_ID=SeqID_30544; Location=835..1162; Strand=-
  SCN-specific regions: Sequence locations=1-328
atgaaagaaaaaggaagatggacgaacgacagaagtagaaaaatggtggaggagaggggggggggagtacgaattgccaatttacgtagtcgatgtgagaaaagcgaacaaaatgataagcgaaaattgaagcaatgccccgaagggccaattcgaagcaaagagaagtgtccgatgatcaaagacaatcgttcaaatacagtgaaccacggagcggagaattgtgagaatagagcaaacgccgaaaagagcgatgactcatcattcggtgatcaaagagtgccgacaaagggcaattagctggtcaatttaaccacgacaaattaaa

SEQ ID NO: 60962 - DNA, 386 bp, Heterodera glycines
  misc_feature (321)..(321): n is a, c, g, or t
  misc_feature (362)..(362): n is a, c, g, or t
  Genomic contig location: Contig_ID=SeqID_30544; Location=1..386; Strand=-
  SCN-specific regions: Sequence locations=1-135,159-386
  Gene Ontology: Mol. function=actin binding; Cellular component=actin cytoskeleton; Biological process=mRNA processing
ctccgcctccgccgtctgcgccgcttgccgagtgcacccggcaacagccctggcgacgaaccgtccggcaaaaagccgccaaggccaagccccgtgggcagaccgaacccaccaagtccaccagttccaagtccaccagctccaagtcctccagttccaagtccacccaaagtgctcagtcccccgccaagtccaccgagtccacctgaaagaattgtaaaaatgaaaacccattggtaaaagcataggaaaagcattgatatgtaccaaggccaaaaccgccgccagtggccaatccgggcgggcaaagacccccaaggncgccgagtccgccgccaaggccaccgacacccaacccctgntgggcataagcctccaactgctgc

SEQ ID NO: 60963 - DNA, 621 bp, Heterodera glycines
  Genomic contig location: Contig_ID=SeqID_30545; Location=815..1435; Strand=-
  SCN-specific regions: Sequence locations=1-111,191-256,278-621
atggcaactttcactttctggcctatctcagagctgacgaacatcgacgttgtttttaaggtctaccacgactgtgacgatgggattaaggtgaaaacattgctttttgagttaattttttattatttaattaaatttaaatatattatttaaataatattttaatattgctgaaaatttttaatatattctacatagctttgttttagaataatattcgcaattgttaaataaaaatttgaagtacttaatgccagttattagttttaaatattaacttcttaataaatctcaaatgccgaagaaataattggatttttttaagcccggctcgcgcaagttgaagttcaaaattccgaattcctatgtcacggacagtgcgacgccaaagaaaacgtttgacatcggtgtgctcaacttggagactgtgttcaaggacgaggaacgcgagctgatcgtgaccatgaagaagaagcggagaagccaccgttaccaagactttttggacattttgccatgaaaaagtttcgagaaaatgacaaattgccaagaaaattattttcaatttaaaatggaagcggtatttaaaatggaaatattgattattaaagttagaataaa

SEQ ID NO: 60964 - DNA, 610 bp, Heterodera glycines
  misc_feature (610)..(610): n is a, c, g, or t
  Genomic contig location: Contig_ID=SeqID_30548; Location=89..698; Strand=-
  SCN-specific regions: Sequence locations=1-405,429-610
  Gene Ontology: Mol. function=pyruvate kinase activity; Cellular component=cytosol; Biological process=glycolysis
atggagaaatatccggcccgcaacaatctcgagcaccttgcgatgctcaagtgtacggaggaaccgcacattgtgcgcaagacgggaatcatttgcacgataggtaaagccagaaaatggattaatctcttcgataaggcatgcctctgaactgttttccctgttcagggcccgtttgtcgttcggtggaaatgttggttcaaatgatcgaaaatgggatggacgtcgcccggatgaacttcagtcacggggaccacgaagtgagttttatcactaaattttgagaatttgaactttttattttaaagagtcgtgaaaatagttttcctggagtctagcgtcgctgatcataaatatggcatttatttttgcccatttcgaatcccaaattcgagcgagaagtcgaaaattaatttttttttaaatttcgacttcttgttcgagtccgggattcagaataggccaaaaattaatttctacgaaattgcagtatcacggcggtaccatcaaaaatgtgcgtgaagcagctgccaaatgcaccaagaaacgcaacgtggcgattgcactggacacaaaagggcccgagattaggacgggacttttggcaggn

SEQ ID NO: 60965 - DNA, 1049 bp, Heterodera glycines
  Genomic contig location: Contig_ID=SeqID_30549; Location=458..1506; Strand=-
  SCN-specific regions: Sequence locations=1-201,223-253,278-296,323 -323,345-364,405-459,532-839,861-957,1001-1023
atgacaacagcaacaacatcattaccaagcccaggagatgaggaggaacacacagaagaggcaaatgaagtgccagaaattacgacggatgtgccgagaccaatttcggcatcatcgtcggggggacgacgagtgccaacctcgaataggtaatattaaacaattttaaatggcattaataatcataaagtgccaagcaacacaaatatttcaaaattttctatacatacttctattccttaagaaatttcagtttattttttattttaaaatttatctgaaaaatattcggcacttttattaaaagaaattaaaattttcactcttttattgattgtagttttttatggaaaggtttgtttggttttttataaaaaaatatttattttttttagattaaaaaaggctttttattttatcgttaaaatttcttagatgtttagcttgtttttattcttcaaaaatttataagtttttttttaaatcgcttttattaaaaaaattagataaaaaacttgttatatttattaactctaataaagacaaaattaaacaaagaaaattgaaagattttgaattaaaaaaagtgaaaattatttattttttgacacgaatttcagaaggcgccaaaaactcgcaaaggcacatcaaccccaacatggtgaagagcaacattacgcgccaccgcgtcgcgtttttcccttacgacgtggccaagtgccatcattagcaattggacaagtaggcggtttattgccagatgaggagaccgatgcttcaccatttgacgctgaaagagcggaacatttgtggcatccgaaacaggcaaaaattgcattaaaaaatactatttttatttgaatcttgaaaattacgaagatttaaataagattttgtcctaaaaagtagatgaaaaataattggacgacaggcagcgccgtcaggaaaaaactattgaaaatatttatgaaattttaataagaaaaaaaattcattttttggaatttttctatgagggcagacaaattttaataatttataaaaataaa

SEQ ID NO: 60966 - DNA, 837 bp, Heterodera glycines
  Genomic contig location: Contig_ID=SeqID_30551; Location=67..903; Strand=+
  SCN-specific regions: Sequence locations=1-151,173-269,293-837
atggcagtcaactcgggtttgactgaaacttgtaattataataaaaaaaacccaaaaaataaattatcatattttttcagtcccaccaaccccactcagctctcatgggcaaaacagtgctccattgcgtcagagtgcgtttaaaacaaattaagtgagagaaatctgtttaatttaattttcagatgccgctggtgctggtcccagcacgggaattgcagatgggggcgctgaaagcggcggtaagaacatttttctttctttaagtcattataatggaaatatattttaggtcagtggttcaggcccacgattgaaaaccacatgaaccgatcacgacttcgacttgtgcgcgaggaaatggcacaccgaacgatgcagcaacaggtggaacatcagcatcagcaattgcttgaacgggcggaaagagtgcgacaggccaatgttgaacaacagatggaggaagcagacgttctacaagaacagctgcagccgcaggacgaagaaaacgacgagaaccgcgacccagaaatggagcagcgacgactagttcaggtcgctcgacaggcacaatacgagcgacttgtccgcttgcaattgcgggaagctcgccgttttcacaacggagtcgcttcttcggttgtggtccctcctcccttgttttgggaggaggaatgcgttatttgcaccaacgcccgtgcaaatttttataatcgtcagtgcgggcatgtttgcctttgcgcggagtgcgcagtcactgcggtaatccaaaaactcactgtctgtatgatgtgccgtgccccagttaacggatatacccatatgttcgttaactga

SEQ ID NO: 60967 - DNA, 3030 bp, Heterodera glycines
  Genomic contig location: Contig_ID=SeqID_6269; Location=272..3301; Strand=+
  SCN-specific regions: Sequence locations=1-17,39-328,350-511,533 -766,788-869,891-959,985-1028,1050-1561,1583-1608,1652-1828,1860 -2693,2723-2884,2929-3030
caaaggaaacagttcacagatttgccatttgatcagcaggagaaggctttgttcgaagattttctgtccgtttgtcgcgtgggtccatttgccattggcaaaacaatcgtttaatttttgtttctttttagggcatcaatgggccattcattcaatgcgaacaattagacaataacgaaatcatttgggtatggacggcggagaattggaaacagaggacggataatcagaacattgagcggtggatgaacgtctgtttcagcaaggcaccactctttttgacttgcttttgtgcatcggacgtacgcctttttccggggggggggacgtttatttgggtacttttttgggcttacacctcaaaatttaaaaaaagtttcacattcaataatttaaacgcaaaactcctttatcgctactttaatttatgctatgttaatggtacgcaattgtcccttaagcgtgccctttttgacattttttaaaattttgaggtgtaggcccaaaacggaaaaataccattaattatttgttgggtgttcttgaaaattataaatgtttcgcttgacactttgtccttgtctaaatttggttttaattcattttaattgcctcctcttcttgccttttcccctttcgttttagaacttcgtgccgactccacccgtggccccacagtttacgctttttgttcgcttgtgctgaagcatttggagcggaaagtgtacgctgaactgcacgagttggacaaattggaggtgccaacttttggaattttgagggaaaaccgcccatttaaggtaaaaaatctgatgacattgcgaaatgtgtccaacgaactgagacatcgccatttgctccctttgctgacaattgcccgggaaattttgctggtgggaaaacgaatttttaattggccattttgatcggttgcttcccatacaatcaatccgactgttcccccaaaaattttaaaccaattctaaaaggcggatggtttgtcttgaaaatgggcctctttttagttaatttttcattttgtttctcctcaaatttcggttgtcttttcccttctcatttcgctgtttctttaggctgacaaagttggcggtgaactgatcaattttctgttcgaccaaaaggagcggacggaatgttatcacatcgtttcccttttggacgagatcatttccgtcactttgctccgctacaatcagaccgttttcgaatggatttcgcagtgttcgctgagcctggacatgggccatgaggtgggacagacaaagccatttcggtgccaaatgatttcattttgtggcacacgatgactaattaattgacttttcgtcattttcctttcttttaatgcccccccccccccaattctcagttttttatttgggacttgcgcaaacaaagcgtagtcaaacgatccgatttcaattcgccggccctggacaatttcggctttgaccacacttacgtgtccattcctgaactgcttcccaaagtgtatgagtcggtggccgacgaactgctcaatttgggccgctttttgttcacaatgaaaaatcaaaatgccggtgagtgcgctttttggtgagacaatcaaatttttattctttttcagacattgagcatctgtccactcattacgaattggaccaaaaccttttcaaaaacaaaacattgcgcgagttttgtgccgcgattcacagtttctacggaaaatgctccaccaacattctcgatctcttcaaaaagcgattcaacattttgcaatttgcgaggttcgctgtgcccattagtcagaatcggctgggcgaccaaatattatctatttttaaaaattaaattttgctttttattttggcaggcatttgccccatttctttgtcggcctcaattcagcatggatttacgaattcgttgtgctgctcgaaactaccggattaaatggccctattttggacaacgatttcgaaatggacgacaacgatcgattcattgtgaacacgcaactgcaacttttgttgcaggaggcgttccgcgtcagttggcttcagaacagcccattccatgacaaaattgggtaagttttggccataaaaatgctgtttttttcaattttggctttttcagcgtctcactgatgcgtctttctcccacgagtgacgaccgactggcggaacacgagaaaagacttgaacaccgacttaagaacccaccgaagctggagctgaacatcgtcgtccccaaggataatgcgtcgaacaagaacaaggatttggcactgagtttggcatttcccccagtcgtcgtttggtcgtaccgccaaatgttttaccatttgttgttgctgaaccgggccaaacattggatgtaccggtgagagaagcaaaggatttaataagcaaaatgggaatatatttggtcctaaacgacttttgaattatttgagtaaaagcaaacttttcggggtttggatttgctaaatttgtctctgcaaatttcagaaaatattttgcgctgaaagggacgaattgccgccgcgaagaatttgccactgtccatcagtttctgcgcgtgctcaacgtgtacattgagtacctttgcggcatcgcatcggccgcttatcccaatttctccaagcaattggattccgtaacatttttatgttttaatctcataaataacgaattgtttgtttgttttgggtttgcactttggaccaactcgtcgatgctcagatgaaatacactcaccaactgatgggacagatgatgttggaccaaggctttaagcagctcaaggaattgctggtccaattggccaccaaattctgcgaatacgcccgggattcaattgtgagtcattttgtcagtttttaaatttaaaaagtaaaacaattgttgttgttgtttttcaggatttccacactttgaacagagaggcgtctcccctcgtcggagaaatcaaaaaaattctgctccaaaatcgggacggaggccccaccggcctcagagacat

SEQ ID NO: 60968 - DNA, 991 bp, Heterodera glycines
  Genomic contig location: Contig_ID=SeqID_30552; Location=120..1110; Strand=-
  SCN-specific regions: Sequence locations=1-88,111-132,154-186,215 -232,255-556,579-676,701-991
atgaatcacagaactcggttggattggctcttcttttggaatgcattgtggagaatgggtagtagtcaaagttttaggttatgaaaccgaaataaataaatatttacaattagacccttggctgttgactactgaaaaaatttcaccaaagagtacgctgatgtttatccccggcgcaggtttcggttatttattttctttactttttaaattgtaaggatgggctatggccaccaatgcttttcttttcctcaaccggaatttcgccttcgatcggtctcgcattgaccgaatgatcagttactattctcaaacctcacggaattaccaagtgacagatcgaattgaacccttttaactgttttgttccattttcagttgctccttttccctgaaggaactgtaagttgcactttttaccattttttttcttctttggtcactaacgatttaattaaaggacaaatgcccaatagccacaaaacgaagtgagcaatttgcagaaaagaacggattggtcaaatacaaatatttgcttcatccgcgcaccgttggatttgtccacattttgaagagaatgcgcaaaggtaatttgcatatactaatggattaaaactgaaaaaacatcatcaaaataggatataaaaccctgaatcggattaaacttttgttctaacaataagcttaatttaataagctttactataatatatgcacaattaattcatcgttccattcagaaaaatatgtcgactttatctacgatgtctctgtggcgtacggtggccgtattattcagtcggaattcgatttggtaatcaccattcttttttcctcgcaaattactctttttgagcttctccttggccttacgcctgcccatgtgcattttttggtacagaaaattccaatttcattaattccggaggaagacgaacaattggagcaatggctgaacaacaaatgggcggaaaagggtgctcatttttaa

SEQ ID NO: 60969 - DNA, 737 bp, Heterodera glycines
  Genomic contig location: Contig_ID=SeqID_30553; Location=1..737; Strand=+
  SCN-specific regions: Sequence locations=1-200,222-224,283-392,414 -420,442-484,506-656,679-737
atggaaaggttagcgaagaataatcatgaatttatctttttatccctttttatcatttgcatatattttatcggtgtaaccacggcacaaaaaatgaaatattttatgtaaatattttcaaaaaactttcctttccctcaaaaacggacaaatccttatcattttttgccattgcatctgttttatctgagtcatcgctgctcaaaaaataaaacatttttacgtaaaataatattaaaaattttcatatttcttaacgaaataaataaataattaattattcgataaagttttagctgggcaattgagttctctgactgtccgttttttctaagtgttgtcaagatttgtcctattttatggagcctgcgtggagtggggtgcggtaactgtgccaatgccaatttgaaaccatggatttcatttaaattttattctgacgttggagaaaaggcgtattttcggggagggactttgggatttgctggggtttgggttgagattctggggtcaaggaaagatttacttaattttcaacaccactttactgacaaggaattagagaataagggaaattgcaattaggaactcaaacaacagtaccaattaagcctttgggcgtttgttgttgctgaatgaaagtccacggggaaaagcaccaaattttgtagttttattacaataattcaaaagcacaaaatatataaaaaaaaacttgagagaacacgaagacaaca

SEQ ID NO: 60970 - DNA, 286 bp, Heterodera glycines
  Genomic contig location: Contig_ID=SeqID_30554; Location=27..312; Strand=-
  SCN-specific regions: Sequence locations=1-126,149-157,180-204,226-286
atggacgcggcggaaccaatcaaacaaaaaaggatttacaaaaagcaaccaaaaacaccaaaaaaatgtttaatttgtggacgaggtgcagcgttcaaatattacaatgtgcaaagttgcaatggtaagaataaaaatgaactttcaagcatttcactaaaatataattattaattaatgagtaaacaatttgttgcttaaggatgtaaacaattttttcgccgtatagtaaatagtcagcgaacgttcacttgcacagaaacaaattcgtgtattttaagtgatg

SEQ ID NO: 60971 - DNA, 462 bp, Heterodera glycines
  Genomic contig location: Contig_ID=SeqID_30557; Location=476..937; Strand=+
  SCN-specific regions: Sequence locations=1-462
atggctcttgaactcctggcaaaactccaatcatttgccgtcgctgatttgctttctgctgatcaaatcgccgatttccgcgccaccgctgaccaattccgtgtccacatgttggagcactttcgccgccactgttcaactacaaaattccatcacctggtccatcatgcacccgaatttgctgaaaaacatggattttggggccttctcagtgagcagcccgtggagaaatttcacgcgttgttcaatgacgatctcgcgcgcaaagcaaacaccaaagatctccacgatattttaatgttctgcgctagagaatctgccattcgaaacgccatttttgatgccaatgaactctgatcactcttttgtagttttttgatgtgtttattatgttttttgttcttattatatgcaattttctcaattttttatatttaatagataatttgctgtcaaattata

SEQ ID NO: 60972 - DNA, 703 bp, Heterodera glycines
  Genomic contig location: Contig_ID=SeqID_30558; Location=82..784; Strand=-
  SCN-specific regions: Sequence locations=1-116,189-451,473-544,597-703
atgagcaaggtccgtgtagcagatgtggcattagaacgagaacaactggcattttttaccaaattcggcatcagcacatccgacagtgtgcagcaagagaaatcatgcgatttaagtaaaaattttgttttttttcattaatttatttaaatattttttaatttttgagtaaaatgaattaatttaatgattttgtttttcaggcaatgctacaaaagtttttgcctgggatggcctatcaaaatgggaattttttcgtgacaaatttgtgttggagccgagccgggattactattaccgatggcttggcattgttacgttggcatactgttacaatttgcttgtacgtttttttaattggattttccttcttaattttttttgttttgtttggatttagttaattgtttaccgttgcgttttcattgacagccaatcagtgtcattcgcatgcctgatgatttttatttttcttgatataatatttgacataatttatgtcattgattcattcgttcgtgcaagaacaggcaataatcagaagattaattaaatatagtaaattcgtaatattaattcaataattattttttttagaaccaagtatagaaagaaatttttgtttcaaattgttcttattaaattttaattcgaagtttatttatttattaattgatctttctaagttaagattttgaataaa

SEQ ID NO: 60973 - DNA, 430 bp, Heterodera glycines
  Genomic contig location: Contig_ID=SeqID_30559; Location=619..1048; Strand=+
  SCN-specific regions: Sequence locations=1-35,64-430
  Gene Ontology: Mol. function=protein binding; Biological process =regulation of protein activity, epigenetic
atggtgctgaccaggcccagccgcttctccgtaggcccctgctcttcttcctcctcccccggaccttccaacagttcgttggatttcggcgtcaaagtcgtgggcgggcgcagtccgttgacgggtcgcttcggtgcttttgtgtcgcgggtacggcccggctcagtggccgaatcggtgggccaactgaagacgggtgacgaagtgttggagtggaacggacactcgctgcaaaacgttacgcccgaggtcggtcggccgcttctccgtccgtccgatcacttccccccccctccgcctcaggccgtttacaaaatcgtccaggcaaccaaaggcgacgttcgccttgaactgatcgtttcccgttctttgatcagcgggggcgatgattttctgaatcttggccaaattcacgagcagtatggcctcg

SEQ ID NO: 60974 - DNA, 968 bp, Heterodera glycines
  Genomic contig location: Contig_ID=SeqID_6271; Location=68..1035; Strand=+
  SCN-specific regions: Sequence locations=1-545,568-607,629-730,809-944
atgaacgggactcaacccactaccattctaatcactgggactcaattcatcagcattgcaatgaacgggactcaacccactaccattctaatcactgggactcaattcattagcattgaaatgaacgggactcaacccactaccattctaatcactgggactcaattcatcagcattgcaatgaacgggactcaacccactaccattctaatcactgggactcaattcatcagcattgcaatgaacgggactcaacccactaccattctaatcactgggactcaattcatcagcattgcattgaacgggactcaaccctccggtgtgccgatcaccgggacttaacctcaacaatttttcggcatcccaatcactggaactcagtcctcaagcattcgaatcaccgacactcaatttcaccaattcttgggcatcccaatcactgggactaatttagcaaatactcaacattttctttttgggtgtcaggattttcaccgggcgggggaaggctcggccgcttcgcggcctcacacccggcacaacatttattagcattttactcttctttttggcattttcttatggccaaccagcggcactcattctccatttttagcatttccatctttgtaggcttaatcacaataatcttcggcataccaatcactgggactcgattctccggcattccaaaacaaaatcaaaaacacaccactctttaactaactaattcttttctctttaacaataacaaatcttagtaaaataacaaattttttttctaaaacaaaaattattaaaaaaagaaagtttttttgtaacaaaaaatgaatacgaattagtaaaaaaaaaattcacgaaaatgaaaaacgcgtataaaaaatcaaatctaaaaaagataaatttcaaagtgcactaaatgattcaaaacaatcatttcctttcttttaaaaatttttaaacaa

SEQ ID NO: 60975 - DNA, 548 bp, Heterodera glycines
  Genomic contig location: Contig_ID=SeqID_6272; Location=1883..2430; Strand=+
  SCN-specific regions: Sequence locations=1-98,121-548
atgctgctatggtgggcctttttacttttcttccatcgtgttatctttcgcccagtcgattgtgggagtgagttgaagatttcggtttgtagttcatgtaaaaatttttagagtttgaagacgccaaggatattctgagcagctttaagtcggttgtggatgtgcccttatcaaatgacttcaaaaaaagccaccaattcattgcattaagcatgagcttaatgaaaagaaccgttccatttgcagagctgtttgcaacggctttgaaagttggtcttgaggtaattttattcaggtcatgccaagtcttctaaacatcatacaaaaccgaatcatacatacttaactcataaatatcaactcatacacatactcaattcctccgtgttcaactcatccactgcacgatgcagatcgtattcgtggcatttctagcgttgtggtgtttcccgcaccaggggcactctagcatttattgcatttgcaatctgcattttgacctctcttatgcgtggatgaatttgattacgggtatggatgctggatga

SEQ ID NO: 60976 - DNA, 1737 bp, Heterodera glycines
  Genomic contig location: Contig_ID=SeqID_6272; Location=2505..4241; Strand=+
  SCN-specific regions: Sequence locations=1-450,476-689,714-1281,1304 -1445,1467-1670,1695-1737
atggtacaggaagatgaattgggcgcccttttaactcttacaaaaggcatcgatgccaaagtccgtgacatcgccagtcaacaaaaatacatagcgtcatctaatgtttatcgtgaccttttgcttgagtacgaagaggtaggttcttaatcaacatcatcattgtggtacgattattgaggctttgatatttgataattcccacttggagaccgacatccgaggattaccaaaaacgtgggtccgaaatttgtggacccaatctttcataacatgcagaacccacaaaaaatgaactacttttttcatcagaataaagaaagaatgcctttcccaatggcaaaagtcaggatggcattcggaggcccgaaaaattttcgaaaatcggaattccgactccaaaaaggtcgaataatcgggtcggaaatttttgaaaaaatagaaaagtactaaaattttttaaaatattttaataggatacattttaaaattcgtaaacaaaaaaatgtgaattcaaaaatattttgtatatttatctatctgcttgaaaaattattcaatgatttaatcaaagtctttttatatcattttacaatttagaacatttttggaaagggactgacaatttacaccttttttgcgacgctcttttccaaaaaaatgccttctctggtgtgactgattatcgaaaatttttatttggaatctaagtctcccatttttcaaaattattgtgcatgacgcggtatagcaaagtttgagacgaacaagaattccataatcataatttgggttctcaatctcgtaaaaaccttcaactacatttcgtatagacaaatatttatctgaatatttttcgttatcgaattcttttcatttctttgggtccaactcccattttcccagaagaattggacctttatgaatgtctttaattgccaagctctttttatttggagagaaaacttagtttcacttgtttaggaattgttttatcctaaaggtcgggtccacaaatgttggtcaatcctcaaacctcggtcataaaggtcgggtttaaattgccgagtccttaaaagtaaaaatcctcaaaagtaaagatagatagatatattaatacctaatttagaaggtggatgaaaaaatcacttctttgatccgacaaattcggatcatgtcaagaatgcgatttaaagttgagaaatcggtaatagatgcgtttgtttatgattgcaacggcggagcaaattctcccggaagtgttgcagatgtgagtatataaaatctcttaagaataaataaattacgtaattcctaagtcctgccttaacacccaccggcactttatttggcacttttttattaattacatgtcattatttttttagaaatttttagatcctggaattttaaattaccgagatcagagccatgactggaaaatggacctgggcggaacccctggatcggaactctcattttaccgggtcccaattattgggctaaggtcatgcaacgaactttttccccaccaactttttccgcgatttcctttagaaattaataaaccgaaattttatttattgatcaacagttatcttaacatataagtattgttcgaattttataaaccagattttttgggttttcataaaaattaattttatgcagtgcctgaaatcccgggaaattttcgttttcgtatttttagacctaaaatgaatatttagaaattta

SEQ ID NO: 60977 - DNA, 305 bp, Heterodera glycines
  Genomic contig location: Contig_ID=SeqID_30562; Location=350..654; Strand=+
  SCN-specific regions: Sequence locations=1-305
agttatcactgttctgaagaaagaagagcgaatcgcagccgataagctgcggcagtatgagttggacccaactcaagggataagaattcgagaacggaagaaaacataccgtgaaaacgatttggctatcagaaatttggttgaaggctttgatgccattgagaacccaaacgaagatgagattcttgctcatctcaaatcgttgcaatacagacttatgcgcaatgattttgagaattgggacgacccaaatggtgattaattctgttttcacatcccgttggcccttgggaaaggcacgttaa

SEQ ID NO: 60978 - DNA, 1227 bp, Heterodera glycines
  Genomic contig location: Contig_ID=SeqID_30563; Location=50..1276; Strand=+
  SCN-specific regions: Sequence locations=1-35,58-406,428-517,550 -651,673-921,943-1227
atgaaaccaaacccacggaatcaacagaacacatcttcctctccttttccatatacttctgcatttacaacgaaatcaaactcagtacgcctggcacagtttaaatcaaatccaacacaaactagaacccaaaataaaatattttgtcgcttttgcgaaagagaaaaccatgcaagtaaagaatgcaaaatttattcaactcccgagaaacgaaatgaacgtgtacgtgaactcaaactttgtctaaattgtctaaataagggacatatggccaatgaatgcaaatccacctatttatgttttaattgcaaatacaaacataatactctcctttgtacccgcaaacaaactcagtacaaaccgaaagagcaaaaaaccagagtgaatatggctaaaaattacgaaaatcatgaagagacacaaacattcatgacaatggattatgataaaaatttatctaattatgaggaagaagaattacttatgactgctgaagtaaactgcataaatcccgacaaacataaagtaaaaaaggaaataattttatttgataatgggtcacaaaaaagctatataaccgaagaatgtgctcaaactcttcaattaagcacaattgaggaaaaattattagcaatttccactttcaatcaaaataagccaaaaataattaaatcaagactagtcaaagttggcattaaaacattaaaaggtgaaatagagtacataacactacaaacagtggaaaaaattacagatgttacaaaaatggttaataaagaaactgttgatgtacttggaataaaaatctcgatcgctaatgcacgtcctcaaattctaattggaatcgactattactggcacttcatgttaccaaattcacaaattcaattacttccatcaggattttactcaataaatacaaaattaggaaaaatattatctggaaaaggaactattgaggacaccaattgtaactcagtgaccgaaaaaagaaaaaaggatgaaacaaaccaaatacttcagaaattttgggaattagaaaacattggaattatcgactcaccacatatgacggatgaagatgcagcaatgatacactttgataaaaatgttacatttaaaaataacagataccatgttcgatggccttataaaagaggaacccaaatttaccaacaaattttggattatgcatgggaagactaagaaatgttgttaaacaactaa

SEQ ID NO: 60979 - DNA, 663 bp, Heterodera glycines
  Genomic contig location: Contig_ID=SeqID_30564; Location=253..915; Strand=-
  SCN-specific regions: Sequence locations=1-134,165-177,209-663
atgcctgtcattaaggtactcaaatacccggaggagctaaacccattcgggtcggaggacgaagcggacgacgacgatggaaagaatcccttcggggacagtgcctcgtcatcgggcgaatccgaactggtgctcccaggggaagagaagaagcagcagaggaaaagcagcaatgccgaaaatgaggaggaggaggagccggaggaagtgcaaaatccgcaggaccgcgtacagacgtgcagcagtgccgcggacgaggaaagctccgcgtgtccgtcgcctgctcgtgcgccgccgatggtccaaattgtcactgccggcggcacttcgcccgccgaaacggaggaaaaaccatcgtctgccgaaggaaaacaaacggcaaatacttcgactgaaggaaatgacacaatgccaaagataacggaaaccccggaaaacaaaacgccaaacaaaacgcagcagagaaaactgagcacatgcgaacagcaggacaatcagtaccaatacgacgtcagtgggcgatcggagaagcggatgtttaaaatggtgatcagtccatttcagtacattcctccgctggcgccgatgcttttccgtgggggcggcgttcagcttcgcaaggttttgccattgcgcgtgccgtcgccttctccttgtctctga

SEQ ID NO: 60980 - DNA, 223 bp, Heterodera glycines
  Genomic contig location: Contig_ID=SeqID_30565; Location=178..400; Strand=-
  SCN-specific regions: Sequence locations=1-60,128-223
atgatccttaaatcccccatagtaggtcttgcaacagaggtaattgaacattttgagtacatttaatatattgaaaaataaaattttcagaaaattattcttgcaataatattaatttataaataaagctatatacatttttgcgccgattcaaagaccattcataaaattatttacgaaatgatgaagagtttagttgattagccatcatttttggaataaa

SEQ ID NO: 60981 - DNA, 351 bp, Heterodera glycines; identical to SEQ ID NO: 53910
  Genomic contig location: Contig_ID=SeqID_30566; Location=180..530; Strand=-
  SCN-specific regions: Sequence locations=1-20,51-351

SEQ ID NO: 60982 - DNA, 522 bp, Heterodera glycines
  Genomic contig location: Contig_ID=SeqID_30568; Location=120..641; Strand=+
  SCN-specific regions: Sequence locations=1-47,70-176,198-345,367-522
atggaggaccaggtaaattcgcaatttacgcaaaaatttatttacgtatatttttacccagaattttttcgttggaaaacccgaattgaaattgaccttcagacatatttaggaaattggtattattagggtccaatacacgcattcatccaagataacaaatacacacatttatttaaaaaattcaatacaaatttcccattggagcgtgtccctcgtgagaaaactgacccagttttgatggaccagttgctcaaattcaactctatgaaaccggatgagcgcatgcgacgcatttgggacagtgctcgtgcgctcgaattgttcaacgaccagaaccttgtgcttaaagcatttgggatctctgtggatcaaaagtcgaacctggtcagtatggtgctttgtgcacgcaaccgttttgacactgcccaacagtttgctgcggatcgtttgggtcgcatgggcaacgaaaagggcattccgattgcggagccggagattgtggctttcaacagcccggat

SEQ ID NO: 60983 - DNA, 745 bp, Heterodera glycines
  Genomic contig location: Contig_ID=SeqID_30571; Location=144..888; Strand=-
  SCN-specific regions: Sequence locations=1-465,491-505,527-577,600-745
atggaacggaaaactgtttcgaatgacaacaaccatggcttaaaatatgaagttattaaccaaaggcaggggtttgttgagaagtgtgacggctgcgattttaatgtttttcattctaatgtgcaggtttggatttttcaaacagttttatttattttggtttttatgttattaattttaaaatccagattggtgaaaatttaaatacacaaaaatccattatttttgtcttctaaggaattttatttatattttctatgttcagtttccaccgattgtgtggccaccacctgaaaatgcttctgaagatgttgtaagccaacatttgaaaccttttcatgacgtgctgcgcttcatttctgctaattgccttacaattgttcaacatcctgaattgtatgatcaagcgaaaaagactcttgatgcggttaacctgctcaatggtgtgttggatcagcatcgacgacagcaacaggggcaggggcaacagcagcagtacaccggaatgactgtgttgaaaaacagtcacaataaccgccgacaaactaataatggtgatgaagaaatctacatttctgatgctgatgacgatgatgatggcattccatttcttgtgcgtcgcttcttgaacgctaacattgctgatgaacaaactgtaacagcagcagagcaacctgattatgctgatggtgaaacatcaatgttttgtgatgacgttgcggaaatggagtgtcagcagaactag

SEQ ID NO: 60984 - DNA, 54 bp, Heterodera glycines; identical to SEQ ID NO: 55479
  Genomic contig location: Contig_ID=SeqID_30573; Location=199..252; Strand=-
  SCN-specific regions: Sequence locations=1-54

SEQ ID NO: 60985 - DNA, 67 bp, Heterodera glycines
  Genomic contig location: Contig_ID=SeqID_30576; Location=53..119; Strand=+
  SCN-specific regions: Sequence locations=1-67
atggctgcaaaggctgaccaaaattacccttttatacgagcagaaaatggcggagtcggcgcaggag

SEQ ID NO: 60986 - DNA, 659 bp, Heterodera glycines
  Genomic contig location: Contig_ID=SeqID_30577; Location=850..1508; Strand=-
  SCN-specific regions: Sequence locations=1-311,342-531,569-659
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 60987 - DNA, 932 bp, Heterodera glycines
  Genomic contig location: Contig_ID=SeqID_30581; Location=247..1178; Strand=-
  SCN-specific regions: Sequence locations=1-57,97-476,498-638,667 -692,714-797,838-932
atgccgaccattttgagtaccgttaccagttggaatgttgtctcaagaaatacggtgttttaattttttttttaagtttaaaatttttttttaattcaattgcattctatttgcccaactgtgattctctgattgtgttccattttttcagccgtccattgtgtgggaagaaaaaacgccagtgggtattactgtattgtgcttgaaaaactatttttaccatttactatttacatttgtgtttgtccccattttttaggtcgaatatctgtccgcttattttttcaaaacgcccgaatgcgacggtaaaatcttttgcgcctgccggcagccgtaccttgtaagcccgaaacgattcgttggaagatgctgcgacagcagcccaagttgtaaatgttgcctgaaggtaaatgtcaatctcttacatgttcggactggctcagttgggcccccccggcacgtttgggccccagcggttttttggttataacttttttctttgtcaaccaaatccaaaactgttggtatcactcaaaagctctaagttcatgaatctttcattgtttgatcagaattacactggcattgactgacataccataatcaaatacaaaacgaatatctagggatttttgaacaattaatttgattaaaaaaataaaaattggataataagaaataagttttgcaacataataatatgtatctaaatgttgaaacgggattttgataaaaatataaattcattttaggacccatcagtgctgaagccaacattggtatggaaatgctttttcaaaaatataaattaaaaatataataatttttatttatttagctaagcccaatacgaaacacggatgagtgtcttaagatgattgacggaatgccccactgttcatgcccgcttgaatttgaatgtgtatattgtg

SEQ ID NO: 60988 - DNA, 470 bp, Heterodera glycines
  Genomic contig location: Contig_ID=SeqID_6277; Location=1144..1613; Strand=-
  SCN-specific regions: Sequence locations=1-270,292-470
ttacatactagccattttttattttattgtgaccaagcatatctttcctcgtatttctgggatttttttcagaatgtggtcatagaataggtgggttgaattatttgtattttttatgagtattatgtaaggatattttcgactaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtattt

SEQ ID NO: 60989 - DNA, 275 bp, Heterodera glycines
  Genomic contig location: Contig_ID=SeqID_30582; Location=195..469; Strand=+
  SCN-specific regions: Sequence locations=1-275
gctcccgacaaaccccgccaccgagtcgtcagccgcccctttcaggctttcgaccattcatcactcctttctgccgccagccgaccctttaggctcccggcaactcaacccttcgctgtccgctgaccatcttaggcctccggcactcatcactcaactcaagtcgccagccgcccttttaggctcccgacaaaccctcaccgagtcgtcagccgcccatttcaggctttcgaccattcatcactcttctcccagccgccagccgccctttcagg

SEQ ID NO: 60990 - DNA, 473 bp, Heterodera glycines
  misc_feature (38)..(38): n is a, c, g, or t
  misc_feature (56)..(56): n is a, c, g, or t
  misc_feature (100)..(100): n is a, c, g, or t
  Genomic contig location: Contig_ID=SeqID_30583; Location=1219..1691; Strand=-
  SCN-specific regions: Sequence locations=1-121,150-167,189-249,299 -309,331-409,431-473
atgcacttaaataaaaaggaaatggaaatatttatatntaagtgtatccgttcacntcaatcaagattgctttggcttaagcctatgcttaggctttatnttctaaaatttgtaggcgccattgaaacttcaaattttaaaaaattcaaagtaacctggctaatgattttatttaatatgtagtaaattttaattattcttttattcgaaatacagcataccttttagaagaatgtgtatttaagcaccaatttattaaaattttaatatatttataattaaaaaattgataaaaaatcataggaaaaatcagattttgaaatttttgatctagcaccgctagagatgactcacgcttcaattgtttaataatgggtttgaccttttaaaacgccaagtatgagtcactatttttaatttttcacttttcttatagaaaattcttcatttatagatattgaatattaaataaa

SEQ ID NO: 60991 - DNA, 393 bp, Heterodera glycines
  Genomic contig location: Contig_ID=SeqID_30584; Location=403..795; Strand=-
  SCN-specific regions: Sequence locations=1-131,153-393
  Gene Ontology: Mol. function=guanyl-nucleotide exchange factor activity; Cellular component=actin cytoskeleton; Biological process =transmembrane receptor protein tyrosine phosphatase signaling pathway
ggcactttgttcatctccgacggtggcattgcgcagccatttaagggcaaagaacggcgggtgtttctgttcgagcagtcggtgataatcgccgagtgcattccgccgaggaaggagtacggcaacccgacgtacaacttcaaaaaccaaatcatggtaatccctcagaaccggcactttctttattcgtctttccaaaaaccaaattgcaattcattcgcttttcaggttaacaaaatgatgttggacgaaaaagtgcctgacgaaccgttgcgttttgtgctccaaagcagcgacccaaatcagcaggccacttacgtggcacaggcggcgtctgtcgacgacaaagagcaatggctggccaaattgtcggcacaattagaccagcaaaag

SEQ ID NO: 60992 - DNA, 1104 bp, Heterodera glycines
  Genomic contig location: Contig_ID=SeqID_30585; Location=74..1177; Strand=+
  SCN-specific regions: Sequence locations=1-864,886-1104
atgcaagagaaacggcaacgaccaagagacgaatggccagaggaaaacgaaacgctgctcagctacgttcaacgcatttacggaccggagaattggacgtcagcatggcaaagaggacgtgttctccgagaactccatgaactggaagatcaagggcgatggatgattcatcacaaatccgatcgcctactactcagcgtctcgcgaatgtatagaggaaaacgaccatttgccgagttccgcttcgtggaaggcagatactactcacacatggtgccagaagatgttgatcttcctccaagcagtaccaaccaaagaacagccggagatcataacaatcgacgacacaacggcaccggcaacaaatacggaacaaacgaagcacccaacaaaaccgcaacgaccacaatcgccaaaactcgaagaataccgcatggccgactccaaaccgaacacgcacagccaattcaacctgttcgagccatgcgacaacacgcacacaacttgcgccaaaacagcgacttacggttccaccgcgggcaaccgatttcaaatggaagaattccaaaacttccgtgccaacaatttcttcgaggcattgctcttcaactggttaacacgcaacatgaacttgccagccgaagagatttgggcggcacacgaaggctacattcagtcagacacaacagtggaagaagtggcgcaaatgttctaccaacaacaagttgcagacaacggacgacaaatcgcacgagaccagcatttgaccgaggtcatcaatgtctggcgtaactcctgtgaccgatttggcgaactttacaatcaaccggcacacaagcaagtgaagtttcggccaatcacgacggaaaacgaacaacaaagcaactatggagaatggatcgaacggctcaacaatcgtacggcggaaatcttctccaaagctcggaccaaggcacaacatccaacgtacctgaactacaactgcacaacaattctgatcggagacaacgttgcagaagtattcaaaccgctcttctacgacgccaaatggttcacacatttcccggcggacgaattccgactcatccccggaccgaaggttaa

SEQ ID NO: 60993 - DNA, 173 bp, Heterodera glycines
  Genomic contig location: Contig_ID=SeqID_30586; Location=643..815; Strand=-
  SCN-specific regions: Sequence locations=1-173
ccagtgcaaatccgttcgacatggaggacatgctgatcgccccattggaggacggtggtgagacggacttgctctaccccgacatggcctcggcagcggggtccgaccatctgcacgtggttgcaccaccggccgacctgaacgatttggacgagtacccaccgcttgcttga

SEQ ID NO: 60994 - DNA, 846 bp, Heterodera glycines
  Genomic contig location: Contig_ID=SeqID_6279; Location=1031..1876; Strand=+
  SCN-specific regions: Sequence locations=1-102,124-176,199-710,733-846
atgacacccattggagcattgggaataattctttttgcctacgggcttactatcctgctcggacattgctcaggtaatcaacaaaacattatcttatttaataagcataaatttaattttaaattgaaaggattgaagtgcaaatccggcgaggatatggacgagacggactattcaccatacataaatgccacaactaaagagtgcatatttgatcagcgatattgtttgactgtctactgttttactggtgaatgaatgactcgggatatgcacagtagagatcggataaagggccggagacccatccatttatacgggttttcatgggcttgtaacccgtcgtttttagccaataggctttttaggaggtatggcttttttcgcccgtaacccttggtgtcaaacgaaaaaccctcttatccgtggcattttttatgcggtcttggtcgtggcatttttgcattgagcggtctgcttcgtgccattttttgtgcatggatgagtatggtatatggataagttgggtataaatgagttgggtttacgtccacttaccccttactcatccataaaaattccgatctctattgcacagtgtgtttatattggaataaggaccccccaccttccattttttgtgtgacttttatcagagtttgccatgagccgacctagctaaaattttggctcccggaaaatgtttcagtaatacagtatttctaaaataagtactgtaacattaagtattgaattacaaaaggtcgttctgaattttttttttcttttttttttgtattaacattttaaagaggttttaaaataattttatccaaatacccaaaa

SEQ ID NO: 60995 - DNA, 509 bp, Heterodera glycines
  Genomic contig location: Contig_ID=SeqID_6280; Location=567..1075; Strand=+
  SCN-specific regions: Sequence locations=1-234,256-324,346-509
atggatatggcttggttaagaatggcacatgcaataaggaggacagttttgctttgtcgcacgttgtgcatcggtctccaactgtacaggtaaaacaatggtttacggtaaaatgccgaacatactactgtatgtgtattcaattgtatcttgtaagcaattttatttccctgtcacggcattcggtaccaccgctaatttcatcagtcggcaatcttaaactaattacaaaaatttctttatataattactttttccctcctaaaaatactttcaacagacatttcgttctttcaacattctaattacctaactagctaaataacaactccatattcttctagcaagaaaagtatgatggtttggagttgcgcgagaagcattcccggcgataaatacttgtgccaatgccaatttggtgagcagggcgtcaactttggcaacgaaaagcggcgcctgcccttagcgatgtataatatgtacaaataattaaaataactttataatta

SEQ ID NO: 60996 - DNA, 606 bp, Heterodera glycines
  Genomic contig location: Contig_ID=SeqID_6282; Location=29..634; Strand=+
  SCN-specific regions: Sequence locations=1-81,104-158,204-302,330 -400,424-570,592-606
acaaatgttcgacgaggacgaaaccgacaggtatttttgcgaaccccggacccgaattcgaactattaccgtaataatttcccgctcacatttaaggtgttcaagctgaaaggcaatgttgaaatgaatgaagctgatcgaacagccaacgaagtgggttttattgaaatttttaaaaattcaaaattaaaatttttttttaaggaattggacaatgagatcaacaacagtgtcaatgccaatgccaacaatgggacaaatgccgaaacggtaagcaattgtaattaaattttcaaattttaatcatttccccattttgatttaaggtggcggcagcggggatgagcgacagcggtgccaatgccaacaatgggacaaatgccgaaacggtaagcaattgtaaataaaattttaaaatttaatcattttcccattttgatctaaggcggcgacgatgaccgagcccggcggaacaaacggtgccaatgccaacaatgcccatcagcagctgagaaagagggtcagttttggacaaatgatgttgaagtgtgggcccatgttggcccaccattggtttttggggtcctgattgggctcacccctgag

SEQ ID NO: 60997 - DNA, 982 bp, Heterodera glycines
  Genomic contig location: Contig_ID=SeqID_30595; Location=335..1316; Strand=-
  SCN-specific regions: Sequence locations=1-299,328-982
atgccaacggactttcagcaatccgagaagctgaaacgcattttggctctttgggaccgtggcgagggagtgatttcgcaacaattgttctgcaacattcactcggctgaggcgcatgtgcgcgaaggtgcaattatcgacgccatcggtggtaaaaataggagggctaattaactaatcaaacaaacgcgttttaggggttttaaaatgcaaatcgacacccatttagacaatccaaattacgagattgtccccgaatatcggggacggaaatgtcgggtaccaaatccctggcatggcatgtatttttaaaaatcaattacaattctgaaattgccattattgatgtcgccccgtaaaaggtgttgccaatctgaccaacgtggtgcgtggctcgtttcctgggctcgcctcgcgctggtcgcgcaaacaaatctccgagttcggtgcctttctggtgcgcgaggcgctctccattttccaacacgagcgctgccggcccatccgcgagacggacttggaggactgagccagcggaaggatggagacgaacactcaaaacgattttgacgacaattaattattaattaatgactctttttgatatttgttttttgcatttcgctttttaagattattatcgcttatgtttatttgtttgtgtttaatgtgctaaaaatgcatttcattttaatgcaacgacaaaaccttcacaggacaatcaattcccattcattcttttgtttctgcgtctgtctttttttgttactgccatttaatgtttctttttttaaatctcacgctgacaacaaataaatttaatcatttgtttttgtaaatttatgctttattaaagtcaataaaattttaacaaatctcctttaattgcattcaaccaattttaataaattttcaggtgttaaatgagtggcttttattaattttttagtcttactatcctaataatttttcaggtattaaa

SEQ ID NO: 60998 - DNA, 733 bp, Heterodera glycines
  Genomic contig location: Contig_ID=SeqID_30596; Location=1..733; Strand=+
  SCN-specific regions: Sequence locations=1-281,303-311,333-543,565-733
  Gene Ontology: Mol. function=structural constituent of ribosome; Cellular component=cytosolic ribosome (sensu Eukarya); Biological process=protein biosynthesis
gtttgttcctaattcatggcacaaatgtctccatatcactcaaaataaaatttcaagtcgagttttcgctagcacctgcttaggtttatccaattggcaggggtttgatagtagtaatcggcacatttaaaccatttgacaaagaattaaatggttagtgaaggggcatactccttcaataaagattatcagaaagttctcaaagtttaagcttcagtttgataattattgattcattgcaaatatttgtttaggtcggtatgcgaaactttcatgtgcgaaagaaccattactactctccaagcatcaatttggacaaactgtggactctgtgcacagaacggacgcgcaaacaatatgcagaagtgaaggacaaagcgccggtgatcgacgtggtccgggccggctatcacaaagtgttgggcaaagggttgttgccgaaacagccgctgattgtaaaggtaagtgcaaatatggcagcattggagaaaattttgaaaaatggacaaacaaaacatttacacatatttgagggttgacctggaaaactgtttttactgcacttagaagggcttgactaagaacgaaggagggttgggggatgcgttctatattggaaaagctgtgatttcttacgaatattctattcctccctaacttcaaggccaaatgcttctcgcactctgccgaggaaaagattcggaaagtgggcggcgcatgtgttctggtcaca

SEQ ID NO: 60999 - DNA, 70 bp, Heterodera glycines
  Genomic contig location: Contig_ID=SeqID_30596; Location=1017..1086; Strand=+
  SCN-specific regions: Sequence locations=1-70
gttttcagcgcgcaaatctaaaaatggcatctacccaggaattggcggtcatttacgctattttggcact

SEQ ID NO: 61000 - DNA, 702 bp, Heterodera glycines
  Genomic contig location: Contig_ID=SeqID_30597; Location=331..1032; Strand=+
  SCN-specific regions: Sequence locations=1-3,25-140,162-314,337 -514,536-702
atgaaatttgcaaagaaaatgttaatgattcccgaggcggaatatttggctctgaggagtgcgataaatagtggtgattctctccaaaatgaaaaagcgagtttagacgcaaaaatatctcagaatttacaaggacccggcataatcgatgacctcaaggcgaagagacacgattggctctataaagaaagacgtacagtaaaggggatacttgaaaatagaccacagaaggtggtgattgagaatcatgtacccggtccgaatgttgcaccatatctgggcatcaataaccaattcaatccacaagagaccgaagaaccacggaaaataattattcctaggaaaagacttaaagagcaaactccggattcagattcagataatgatacacttgaggagataacaccggaatcccaaactgtgggatcctcaccaacattaaaaacacccgttccgaacaaaacatctattatacacccaacccttttaaacggtctttttaggtatgtaaaagaaaacaaagatttatttaaaattactgcggctggaaaggttcagtcgaatatgaatttgccgattgaaaacagtaattatagagatgttttgttgtatctcgcggggaagaaagatgaaacgccgcgcggtgcaaaatttctcaaagatcggttactgaaggatccaacagtaaaagatatgggttaa

SEQ ID NO: 61001 - DNA, 287 bp, Heterodera glycines
  Genomic contig location: Contig_ID=SeqID_30599; Location=554..840; Strand=+
  SCN-specific regions: Sequence locations=1-27,67-111,199-287
atggagagcgtctctctcgatcctggtgaggagttccaggaggaattgacggaagaattagaagaggagttgctaggaaaagaagagaagtgggtcacggcccaaaattctgaaaatgaggtggaaggagaggaaaaggagaaggatgagggtgaagaagttgagttaaatgaggacgctgagaagaagaaaaaggagtgggctacggcccagaactctacgaacaatgaaaaggaagttgagaagagtggagagatagaggttgaaaagagtgaaaagaaaatgaa

SEQ ID NO: 61002 - DNA, 1102 bp, Heterodera glycines
  Genomic contig location: Contig_ID=SeqID_30600; Location=663..1764; Strand=+
  SCN-specific regions: Sequence locations=1-200,225-269,453-489,530 -790,813-1102
atggaaaagtacaccaacacattcaatttggacatggccactgatcagcattcattttgctctacggcccaccaagccgtggtggaaataaaaaacgaactaatcaatccaacaatgccggattgtgaaagtccagcgggtggtggcactaaaatggtgcaacaaattgacacacatttgtatgctagtaatcgaaaaggtaaattaattaattttaaaaaattcttaaactatcaataattgggctgcgaattttatagtcaaatgacttttttttttacttttttggactacgcttttttctttttgggatttttttttgacttttgtgcatttttttttgcgttttatggatttttatggtctttttggctaatttacattacttttttgcatttatttatgccttttatcttttttttttcaatttttgtcgatttttatttacttttaaaataaggataaaaaagatttaatgaatttgggaccaaaaaataaatattaaaatcaattttgataaatttaaattcttcgctttatttgattttgaagccaatgatgaagagtgcgcgtacagtgtcggctttattagtgccatgttcgaatttgcctctgcagcttcggcccatgctgatcaatcaatatctgatttgaaggagctaactttgaaatttgatcagcaaattggcatcattggcgaactgtgcaattgccttaataccgacattggcattgtgctcttccgaatgccacgccagggcaaaacagacggtttgaaaattactaaaaaacagagggggagaaccagggctgcacgcaattacggattacgggaatcctgaggtttcccagaaatgacgggttacaaattattgggacatgtagggttcgaatcccacccccgcacccggggacaggacaggttttttggcctcacccccgcccccgtgacttagacccccgcaatcccgcccccgcgaccttcatccccgcgggggcgcggggatgaaaacgcacccctaagaatggcattttctgggaaaaatgcaaaaaatttgtacaattttgaatttttttaaccattttgacaaatttttatgga

SEQ ID NO: 61003 - DNA, 1879 bp, Heterodera glycines
  Genomic contig location: Contig_ID=SeqID_6284; Location=210..2088; Strand=+
  SCN-specific regions: Sequence locations=1-18,42-410,435-572,601 -980,1006-1016,1053-1096,1124-1152,1175-1464,1486-1642,1664-1879
atgacaaattctacccattttgtggttaaaatttcaaaaattaaggtaaaatgaaggtccggcgttgccgataagcgccgccggaaaattttttggaattgtaataaaatatggtaggaaaagttgcaaaattttcaaaaaaattactgtttttttaaaaaaataaatcgcaaaaaaggcaaaaaaatgcaccaaaaagttcaagataaaagcttcaaactaagttaaaaactcgttttcgtgcatattaggctatagcaagttagcaaaaaggtaattattagagttgcacgggaccgggaattttgacaaaaaccgggaccgggacttaccgggaccagaaaagtcgggaccgggacctcgattttcgtccgggactgggaccaaccgggataatttttgaaaaaaaatttgaaaatttgagtgcactttgttacgaaaaattgcctatattcaaaaatgtacccataaaattttttaattctcgtttgtggggagaaattcgaagaatttttccattatgcaattttgagtgtaatatgttaacagaaaataataaactgaagcattcgttttaaaaattaaattttcaaatatattcatttcttaggggtggaaatttcgcatttcgcgccaaaaagcgaaatgcgaaaagcgaaacctcggccatccctggtatttaccatttctttttaatcttttgtaaaactttctgctccgttttttatctttgtcttttctcttctgacttttttatttcaatgcgttttcattttgctttcatttatctctgaagaaatttgagccgttccgtcggtggccggcgggcgacaaatacaaattggaccggcaaaatggaaaatggggggggggcaattaaaatttaatcaacaaatatatttttgtaaaaagcaaattgaccattttgtttgaatttggcaggtgtcaatctgtgatgccgaaggtgtcccgaaagcagcgaacaaaaacagaaataaaaataacaacaacgacagggaggaggaggaggaggaacagaagttggaggaggacggaaatgagaagttgggcagcgaactgttcaacgatgaggacattgtgaacaacaacaacaacagccaaaagaacacggcaaatttagggggtatttgaaaaaggaaaattggtaaaatttgggggaaaataattaaatttaagtcaccgaagcggaggacgacggaatgctgacggagcaggacaaacagttgcgcaaggtgttgtccgacatggaccgaaagcaactgacgttggcacaacgccgtcaaagcaacatggacgtaaggggaaagcgaaattgtgtaattaggcattagcggcatttttagtgctattgtgaaatgttttgcattaattaatttatcacggagcgaaagagtcattaaaatgtttaaatttgcattaatttaaataccgttaattgccctcacgtcatcgtcattctctgtgcttatgccctcttttcacaggttgtccatcaggcgagcggtcgtcgcacttcgacaacgctaattccgttgaccagcgcccaaatccatctgatcagatcactgtggagacaagtaaaaaatggggaaaataattaaatgctaattaattagttttaatgatttcaaaattgaaaaatgctttccgtttgtttttgtcaggtgtatctgagcaaaggcccaacggtgatcggctcacagatcagtcatcggctgttcttcaaggaacccgagatgcgcgagatgttccgacgctgcgcattgccacaacagttcgccaaccatgacagtttttccaaggtacaaacagcaaaaataagttaattatgccgtgaattgactatttagtgctctaa

SEQ ID NO: 61004 - DNA, 802 bp, Heterodera glycines
  Genomic contig location: Contig_ID=SeqID_6284; Location=4293..5094; Strand=-
  SCN-specific regions: Sequence locations=1-680,702-802
atgccgtcctcattaatggcgggcgattcgccgcgcgaaaatggggcggaggaacacgcggacatctacgcgacctcgtccaatttgatgaaaagtcaacgccaactgttgttcatcacccgtaatagccacccatttaattaatgttttttcatttatttaatcactcgtaatagccaattaattgctttttaattaattttcagcggctattggcttcgcctccgccctttgcattttgttgtcgttgtgcgtcttcctgctgtacattcagcgtcgtccggacggtgtctacaaaacgcatgagcacaacgcttttgtgccggttggaagcggtacggtaagcgacggtgacgaccaccacaagcagcagcagtacggtaacggcgacgaattcggcaccgcccgcggcaatgtccgtttcgcgggcgtaccaacgctaatgcacacgcgactgcttagtgctgcagcaggtggtgatcagcaacaacaacaacaacagcaggagaaacggcattatcggcacgtgcctgatgatgagacaactaaacgcgagtacttttgctgatcagtggacatagaaaatggccaaattcgattgcatgaattaggaaatggataaatgccatggcatcgccaaaattcaattattcccgctgaaaggcatggcaataagaaactctcacttctgctatctctgattatagtgattgatatctgctgatagtatttgatcattccgatcaactcaaacatttctcttctcatttatgcctttatttttttaaataatgaaaataaa

SEQ ID NO: 61005 - DNA, 436 bp, Heterodera glycines
  Genomic contig location: Contig_ID=SeqID_30606; Location=264..699; Strand=+
  SCN-specific regions: Sequence locations=1-338,360-436
atgaaaatgcaggatggagatgaagaagatgcatacattttgtaccaccgagccatggccatttaccgtttgataagcgactcaatgactgatgcgttcaaacggagccgggtaattatatttttgttttcctaaacagaccacgaaaccttttgttgcaggatggtcgtattttctacgagacttctggtcgcctgctttcggatcttgaaaaggttgccgagagtttgaagcaacggttcggacagcgtcaaataactgggtccacacttgggagttctaaatcgttttctgatgagacgaaagttgaaggctcattgtcatctcaatcaagtccgtttcaaattttctttaaatttaagcttggaattaggattgaccaaaaaaaaccataatgttcagcatctttgataatctactggttatacagtatgga

SEQ ID NO: 61006 - DNA, 54 bp, Heterodera glycines
  Genomic contig location: Contig_ID=SeqID_30607; Location=379..432; Strand=+
  SCN-specific regions: Sequence locations=22-54
atggacaaaaaagagaaagggatttcgatccctttcaacgttcctctttggaac

SEQ ID NO: 61007 - DNA, 812 bp, Heterodera glycines
  Genomic contig location: Contig_ID=SeqID_30609; Location=22..833; Strand=-
  SCN-specific regions: Sequence locations=1-386,460-812
atgctaagtaaactaaatttactgttcgacattttattcattggcatttcttttggccttgcgacagatcaaaatgccgggaatgatttgaagcaacttggacagtcgaccattaatgttttagcgagtgctgcaaatttgggcatcagagcagtgacaacattagccccagttgtacggtatggattacgatagattaatagacgttaagacttttttttttgtaaactaccaaagcgaaaagatcttgactagttgtattagccttttttatccatttattaatttttttgtttatgacgaaaattctttaaataaagcaaaaaacttgaatttttctataaaaatttttgaatttttccagaaatataaaatttgtcatccgctaaaattattttaaaacaaaaatttaaaataattaaaataatctttttttaacattttaaattctatttttaagtgaccaagtgattcctggtgcagtgaactgtacaaagacagttgtcagtgcgcttcctacggttgccaacgctaccaaaaacatggtcaataattatgccgcacctgccgccacaaatgccgcgcctgtaattgctggcgctgcggttgccgtaaaagaaaatgtggtcaagccgatctacaatcatggagtacgtccaacatttgggatggctggtattgcaatggccaatttgccggaatggcaaaatcagcgaaaggcgggggaaaattcatcaagacggaacagtaccggaagcagcgggaagaaaagtggttgcatgttggcatgctttggcaaaggagacccatag

SEQ ID NO: 61008 - DNA, 354 bp, Heterodera glycines
  Genomic contig location: Contig_ID=SeqID_30611; Location=579..932; Strand=-
  SCN-specific regions: Sequence locations=1-4,248-265
  Gene Ontology: Biological process=N-linked glycosylation
atgaaaaggaaaggaaaggccaaggaaaaggaaaggaaaagccaaggaaaaggaaaggaaaaaccaaggaaaaggaaaggaaaggccaaggaaaaggaaaggaaaagccaaggaaaaggaaaggaaaagccaaggaaaaggaaaggaaaggccaaggaaaaggaaaggaaaaaccaaggaaaaggaaaggaaaaaccaaggaaaaggaaaggaaaagccaaggaaaaggaaaggaaaaggaaaggaatgatttgggaaaacaaacagaaaagagatggtaaagaatggaagggaaagagaaatggaaaggaaaaggaggcgaaattggggggggggggagaagaagagcagtga

SEQ ID NO: 61009 - DNA, 693 bp, Heterodera glycines
  Genomic contig location: Contig_ID=SeqID_6286; Location=214..906; Strand=+
  SCN-specific regions: Sequence locations=1-113,150-177,244-619,641-693
atgtacaatgtgagcaaaatatcgaataatgtcaaaaaatctcttaattagtttcaagcttcaaaccaaattcatgaaaaataataaaaagtacgtttgcttttttctttgtcaattataatacttaaattctttttaaaaataaaaaacattttcatttttggatggagggaatcctaaaatttttttttagtaatttaaataattttgggaaaatttctaaataaattattaataaaaattcaagtggcggataaattgagacatcgtttgaccagtgtcttctttttatacagcaatctttgccggtgattgtcgcgtcaatgttgccctgctattggctctaccgcgaagtggccaaatggatgttggcagaacgccaaaaagccggcggcacaaacaccgtaacacagtaccacgaatggattgacatgtactgtagtgaagagtatgccgaggcggtggacgaaatgttggcacttgcggatgaattagcgcaagaagcggatcagcggacacgcgcgaaaatggccaccgtttttgagcgcggcttccaactggaatggatgttctggaagtccgcctatcaaatgtgccaatgggaaatttgattttcactaatagctggcaaaaatggctaatgcctaattactgttgggtttaatttgtgtgattagagcatggaaaaacaaa

SEQ ID NO: 61010 - DNA, 1693 bp, Heterodera glycines
  Genomic contig location: Contig_ID=SeqID_6286; Location=3679..5371; Strand=+
  SCN-specific regions: Sequence locations=1-48,76-394,416-583,605 -835,857-1022,1079-1175,1197-1276,1314-1456,1518-1693
  Gene Ontology: Mol. function=serine protease inhibitor activity; Cellular component=cytoplasm; Biological process=regulation of proteolysis and peptidolysis
atgattaggctagcccaggagtatatgataggaatattttcagtaatcattttaaaatataaaataaattattatcggcagggaagtagggtaattaggggggcgggggcggggtagtttaatcgaatttatacaatatcaacaataaaatattttgcattaagttgcgcttgagtcggaagtgcacaaatatttcggcgatttactcacatcaatcaaaagtgggcacaacaattacagcttggagctggccaacaaagtgtacatcaaggacggctttaaagtgttggatgcgttcaaagcgcaaattatggaacattacgggggacagtttgaggcggtggactttggggacaaagaagggactgcgaaggtcggaaaatatttgaagaattcttgagcaattcttgacagattctgtacaatttaccaacgaattttcagcaatatttcgatgggcaaaagttttgtcaaaattaaatttgaagagtttaaatttcttgtaaaccatcaacctccattaatttactcaaaatgtgaaaaaacaagagataaaatgtaaaaataaaacacaaaatttcggagttaaagattttttggtttattagcagctgcattttttttatgaaacgtgtaaaaatccttcagaaaatgatttagcagaaaaacccccaataattgataccccccattatttaattgcagaaaatcaacgactttgtggaagaagctacacacgggaagatctatgatctgatcgagccgaaccttcttggcgaaatgactcggtgtgctctttttttcttgataatctattgattattttccgattttccataaaaataaaattgaaaatttgtatttattgacactatcaataagttaattaatgttttaatttcagtttggtgttgatcaacgcagtttactttaagggcaactgggcgaacaagttcaacccgaaccttaccaaaaagaaaacatttcatgtggacgaaataaacaccaaagaggtggggaggaaaaaaataatttttttttatagtaattaaaaaatattttaaatttattttttataccattgagaaggtattttcgtatctaaatttattggccaaataatctatttttaaacattatgaaaattgtagtaaaattcaggcttatagagaatataatttaaatgtacaaatttagtaattttggcaactttctgtatgaataagtagggccacaaaattatacttttttcgttacagcatgtttgtgttttatgaatttaatgttatgtcaaaattttatttaaattcaaaaagttttcaaaaaaaatcgaatatcaatgactaattttccattgatttattttcatgccgggctcttaaaaattgtctctttattagctggacatgatgcacaagaaagccgatttcatttatttcgaagatgaacaggtgccatatttttaataattttttacttaaaattaaaaaaaaatgtttttcttattttttttatttgaatttgtgcatagctccaactgctcggcatgccttaccaaggtggtgaagtattcatgtttgtgctgttgccgaaggaccgctttgggttggccaaattgttggccgatttggacggcaaaaagttgctggaattaaccaaagaacggcgcaaaagcgaagtgcaagtaaataca

SEQ ID NO: 61011 - DNA, 306 bp, Heterodera glycines
  Genomic contig location: Contig_ID=SeqID_30612; Location=553..858; Strand=-
  SCN-specific regions: Sequence locations=1-31,53-126,155-306
caaaagttttttacaaccacatattgccaatctaatttcttgcagattgaaagccatccattgcctgccggttctcggcacagcaaagcactaatacggtgtttgactaacttcaaaaaataattcattacccaaaagttttttacaaccacttattgccaatataatttcttgcagatttaaagctatccattgcctgccggtctcggcacagcaaagcactaatagggtgtttgactcacttcaaaaaataattccatacccaaaagttttttacaaccacatattgccaatctaatttcttgc

SEQ ID NO: 61012 - DNA, 1007 bp, Heterodera glycines
  Genomic contig location: Contig_ID=SeqID_30614; Location=984..1990; Strand=+
  SCN-specific regions: Sequence locations=1-563,585-976
atggcctacaactttgccagcaaaagttttttgatcagaccaaaggcctggtctggaaaaatggcagatcgaggcctactcattttggacacttcagtaccagctgaatgccgcgccagggtttgctcggaacgggtagtcgccagcggactttttgtagagctttcaaagggctatcgaaccatgtttaaaaatttcgaaaattttcaaaaattttcgagctaggcctaaaaaacgattttttggtttttgaattttatgattttttaacgaattttcccagaaaaacggagaccactttcaagcaaccgtttttcgagctctatcgattggtgacatttttagaaaattttcgatttttttccggaaatagaaaaaatttttggcctgagcgggacatttgagtcccgggcccataactcgtcgggggttgattttagcgaaaaattgtcttagaacttttttgtagagcattttaaatgctatcgaatggtatactatatgaagggaaattttcaaaaattttcgagctaggccccctagaaattttcaaattttttttggtgggccaaaatgggggtgaaaaatttttttctggggtattttgaggtgctgagcacgaatatgatatttgttgtttgtttcagattttttggaattttttaaaaattctttattttttgggaaatttttggccctcaggattttgtataatattggaaaattcataactcagtgatggtttcatcgatttaactataataatgctttaaaaatagagaaaattcaggagaattttataggatttatttggaatttctatctctaaaaataaaaaagatattccagaatatctggaaaaattcgaaatttcagaaaaaaattcagaactcggttctgaaaagtcactcgtgaaaagtaaaatactacaaaaatccgcaatgtttttctctataggataaattttatttcaagtttttagaaggttttttaaaaaagatacaaaa

SEQ ID NO: 61013 - DNA, 359 bp, Heterodera glycines
  Genomic contig location: Contig_ID=SeqID_30616; Location=50..408; Strand=-
  SCN-specific regions: Sequence locations=1-289,347-359
atgcacattgcgccattggagttacatccattggcacgcctggttcagggtcgttaccataaaatgcactgcttgtgcgttgcttcgtgggatcatgtacttgtacgtgttcttacgttacttgctcggctcggctgtggaggttttggtgtgcaggcgcgaacttgtggttctaattcgcgttttacggaccgtaactcgggcgcaccaatgcttcgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcga

SEQ ID NO: 61014 - DNA, 365 bp, Heterodera glycines
  Genomic contig location: Contig_ID=SeqID_30616; Location=970..1334; Strand=+
  SCN-specific regions: Sequence locations=1-274,310-365
atgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataa

SEQ ID NO: 61015 - DNA, 267 bp, Heterodera glycines
  misc_feature (12)..(12): n is a, c, g, or t
  misc_feature (72)..(72): n is a, c, g, or t
  Genomic contig location: Contig_ID=SeqID_30617; Location=1236..1502; Strand=-
  SCN-specific regions: Sequence locations=1-267
tccctagatgtntagaagatatttataagctatttctcagtgattaatcagctctcaaaaaagttgtcagtntaaaaccgcaaaaaaggcagaattttcaaattttttatttctatctttttttatagttcgaaattttctgtaatttttagtaggctaatagagcctgtgaagagctttcgaatgatatcaagattgtttgattcggtcaataacttcaagagttatattgactcaagttggctcagacggagttggcccgttccg

SEQ ID NO: 61016 - DNA, 519 bp, Heterodera glycines
  Genomic contig location: Contig_ID=SeqID_30620; Location=362..880; Strand=-
  SCN-specific regions: Sequence locations=1-47,69-258,282-300,322-519
atgcagaaaatgatggaaaacctttttatgtttcaccgtttgtatgccaacatgaaaagtcttagaaaaggggtaagccaacctggtggattttttaaaactcaattagaaaaattcacaaaagttttgagcaaaaaggcattcaaaactttaaattttagaaaagtacaaaatctatcgtcccaacaaaaattactattgtttttactaaaattagttgtaatttatgaaagtttttcgcataaaaagcttttagctaaaaaactgcacaaaatttttagccttctattgaacaaactctataaaaatatttattttattgcattcttatgtgagcctatttaattctttttacaccaaaaagttgagaggttttaataatttttaaagatttatccaacttcttatctgccctcattttacatcaaccaattatgtgcgattgaatgccatatggtcaccattgcaactggatttggcttccctctcaatgaaatttttgcaaattattcactttga

SEQ ID NO: 61017 - DNA, 243 bp, Heterodera glycines
  Genomic contig location: Contig_ID=SeqID_30621; Location=385..627; Strand=-
  SCN-specific regions: Sequence locations=1-193,217-243
atgcctgctgttgattgtttgaatggatatcgcagttacattaatgatcgcaatgcagagttaattatgggagatccgttggacccaaacatggaaacggatttcgattttgctggaaatttggcgctttttgacaaggctgttagtaattacaatagtaataggatacttatgcagttttaagattaaagctaacctttaaaaaataattttaagtgcaattattacgctgtcattgcatga

SEQ ID NO: 61018 - DNA, 258 bp, Heterodera glycines
  Genomic contig location: Contig_ID=SeqID_777; Location=688..945; Strand=-
  SCN-specific regions: Sequence locations=1-19,41-131,153-258
atgaatttacatgaaatggtcacttcaacaccaacaccaaattatgtgccaattttggaaaaatcattttccaaaaatgagacggagacggcaacaattattgaaaaaacttattccgatgaaaacacaaacagtggtataaaatattattttgtctttcataaaaagtgattttttagacaataacagctgttctgcatttggtttcggaatgccaatgataatttgtacaattttgttttttttcaattaaataaa

SEQ ID NO: 61019 - DNA, 1606 bp, Heterodera glycines
  Genomic contig location: Contig_ID=SeqID_778; Location=586..2191; Strand=-
  SCN-specific regions: Sequence locations=1-145,167-421,443-912,941 -1116,1163-1367,1389-1479,1501-1606
atgcgaaaagcgaaatgcgaaacgccaaaaaatgcgaataatgcgaaaggcgaaatgcgaaaagcgaaacctcagcccatccctggtatggaacatgtgacttaattactattaaatacagagcctacaactctgttcatcattatactatactgaaaaatttatacaatttgacattcgaacccgtatcagttaatatgtatataaaattaggattattctctccggtcttaggggcaaaaatgccgggattccaggaacaaatcccttagactaaattttttttaggatgattcgacaattttgtggatggcatttttagctcgtcataattcactttatcaaatattttaaggaaatgaatggcttacgcattatgggtgtgccaaaagcccggagaaaggtgcatgtagcgacaatgttgagaaggagatgaaagatttgtatggccttgctgtgagctgttcattttgtacaattggacgcaaaatggacgacatgagcaacaagaatttcccgctgtacaatacaaccaatgttgtaatgccgccatcaggaggaggtgaaacatttaattaattaatatagttagtagagcctggaaatttctaatttgcggatcgagttgcgggatttgaactaaaaatcttttgtctggaggggatcctgcgggattaattccgcatttcgcaaatccactatgctctacacggtaaaggttgttttaatctgatttggcagacaccgttcgggatatcccttgtaagctatcggggcgcattacccatctctgtaaaggattttttgggtgctaggtcgttttgtaaaactgccaaacttacacatttttcgttactttttttaaacacaaccaaattaaaaatctacatattacgatagctctgggcttgctctattagcataaaatttcagaaaatttcattgagttttcagaaagtactaaccaaaaagcaatctatgcgctagcgtgtgataccaagagtatttaattggttgtttttatgaaaagttgacggatttatctcgaaaaatctgtaaattgtcaaatgtattacattagtccatttaacatttaatttagtcaaaaaaaaatctgaaaagaagcaaaactcagtgattcataattattagtgaatttgaaagggcgtataatcaagaatcaattataattatatgtattttgactaattttttgagttctgccaataaaaaagtatttaaaccaaacattttagcagatggagacgatttttcatttatgtcgacaacccaacaactaacaacatcatataatttatctgaaatcgctacgattgtgccaaaaaaaatgaatttacatgaaatggtcacttcaacaccaacaccaaattatgtgccaattttggaaaaatcattttccaaaaatgagacggagacggcaacaattattgaaaaaacttattccgatgaaaacacaaacagtggtataaaatattattttgtctttcataaaaagtgattttttagacaataacagctgttctgcatttggtttcggaatgccaatgataatttgtacaattttgttttttttcaattaaataaa

SEQ ID NO: 61020 - DNA, 324 bp, Heterodera glycines
  Genomic contig location: Contig_ID=SeqID_778; Location=2549..2872; Strand=-
  SCN-specific regions: Sequence locations=1-6,28-155,220-265,287-324
caggcatggaccaaattgaaaaataaaaagcgaaatgcgacaagcgaaatttgcgaaactgaaaaatgcgaaatgaaaaaaaagcgaaatgcgaaaagccaaaatatgcgaaaatgcgaaaagcgaaatgcgaaaagcgaaattttttctacaactttttaatagttaaaatcataaagcaaaaatcattttttaaaattttattccaactttaaaaatcaataaaacgcttttttgaggcgcgctttttccaaaaaaactttttgggaagagggagggggcaggcggcaccggcaggcgtcgccggcaggcgccgccgggaaa

SEQ ID NO: 61021 - DNA, 364 bp, Heterodera glycines
  Genomic contig location: Contig_ID=SeqID_779; Location=195..558; Strand=-
  SCN-specific regions: Sequence locations=1-95,118-364
atgcagaagggatacggtagggacaataaacggtgttggcttgaagatgaacttttccgaagaagaatgcgagtcaacatatttctggcaatcggcatacaaatattgttatgcttcgcattgtttaagaggtatgactttggttaaataagaccaattaaacgaattgaaaagggtaattataatgatgaatgttaattaattttaaagtttgacggttccctggagcacgactcaatttaaaacccaaatatgggtcaaggagtttaattactacttaaatactgagttcacaactctgttcttatttatatcccacaaatatggatttaaagttcaacctaatgcttcaagtcttatctaa

SEQ ID NO: 61022 - DNA, 341 bp, Heterodera glycines
  Genomic contig location: Contig_ID=SeqID_779; Location=1097..1437; Strand=+
  SCN-specific regions: Sequence locations=1-159,184-226,248-297,319-341
atgaaaaaagaaatgaatttaaataaaaataaaatgatgaaaaagagtttttatgaacagaaaaagaaagaattcattgaaagatttgatgaatttaaaagtttatattgccaaggaaaacagaaagaatttgtgaaggtattgggcatttctgagttgacatttagaaaacggaaaaaagaattagcgccaaaatatcacaaaattaagacgattttaatagttattttgtttaattttcattttaaggacggtattccaatgaggacaattgagaaagatgaagcaatatttcaaaattaaagaaaacaatcccaaaactagtgacaaaataattgcca

SEQ ID NO: 61023 - DNA, 672 bp, Heterodera glycines
  Genomic contig location: Contig_ID=SeqID_779; Location=2050..2721; Strand=+
  SCN-specific regions: Sequence locations=1-9,32-94,119-334,391-672
atgcatttcatatttttaataattttcattgcttttaaaattgaatccggaaaaatccaaccaaattttggcgaaatattcggcaacgcatgggacaataataaaagagaagaaaaagcgatcaaaattgaacaaaatgagcaaaatgataactcagcgacagttgatcaaatgggtgagggaaatggaacgtacccaaatgatcaaaagaaaagtgaaatcattagcaaatttgatgcaattaaacaaaagttaagagaaaaagaaaattttcacgaaaagaacagaaataaaattgagaagaaaattgctagattattaggcgcaaatcgccataaaatatataaatggaaaaaagaattatatttaaataaaaataaaattttttatgagaagaaaaagagagaattcattgaacgatttgatgaatttaaaagtttatatggccaaggaaaacagaaagaatttgtgaaggaattgggcatttcttatgacacatttcgcaaatggaaaaaagaattggtgccaaaatacaataaaagtaagataatttgtttttctttttttagagaaatttgagtgaatttattattctccaccttgcgcagcgggtttcaaaatttaatcgacttttgccgggttcaattttaaaatcaatgaaaattactaaaa

SEQ ID NO: 61024 - DNA, 497 bp, Heterodera glycines
  Genomic contig location: Contig_ID=SeqID_779; Location=3372..3868; Strand=+
  SCN-specific regions: Sequence locations=1-102,125-147,169-497
atgacccagggacggtcccacaatttcggctccggcagtgtgcaaataggcgatgctgggaaaattttcgaaaattttctcattggtttaggattttacgaataattatttttaatgaaaaatttgggagagggaaacttgtaaaggaaagaaaccaatatggaaaatcaaaaaaaaattcacaaattttagcaaagagctaaaagtcatctaaaataaattataattagttggtgaaccttcaaaactcgaataaaattcttaaattattcaatttttctgaagttttagcctaattatccataaatggcataataatgccctttcccacacattttttgattggcgagaatttcgaggcggagaatttctcgggcttttgctactaggctcttagtaggtttttttttgaaatttctcaggtactactttcacggggctcatttatcgaatgtgattctcgataaaaaagcttctttttttgcaaccccatatga

SEQ ID NO: 61025 - DNA, 374 bp, Heterodera glycines
  Genomic contig location: Contig_ID=SeqID_780; Location=506..879; Strand=+
  SCN-specific regions: Sequence locations=1-107,132-164,186-229,252-374
atggcaccacgacgcaaaagaaaggcggctcaattggtcgggcaggacgaagcggtggtgaacggaccgagcgcacaggtgaattgtgttcaccatcaaattttcacatttaaatttcatatgctttttattttcacagttgccaacgaatgacggacaacaattggcgtcagcagcaccagtgacaaacaatggcaccgtccaacaagcggagaacgacggaactgatgcggtggcggcagcagcagcaattgatgacaccggcggacaagtacaatttttgtattttcgttagctaagggcgggcgcttttggtttaaaaattcaccggatggtataattgaggatgtaaggcacacaaatgcaccttttta

SEQ ID NO: 61026 - DNA, 411 bp, Heterodera glycines
  Genomic contig location: Contig_ID=SeqID_780; Location=1913..2323; Strand=-
  SCN-specific regions: Sequence locations=1-411
atgaaaagacgcattgctcctcttactactgctactgctcctgctgagcaacataaaataattggtcccgagtcgcccaagccacatgaagagacggccaaaaatgttgagccgaaggatgagttggcaacgaagaaacgcaaagtggacgaccgagagttgtggaaattggcaaaaggcaaatttttgctgaccacctatttgtgccatggtaataattaataacaatttcatcaaattttaatttgaatccataaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtga

SEQ ID NO: 61027 - DNA, 1781 bp, Heterodera glycines
  Genomic contig location: Contig_ID=SeqID_6287; Location=671..2451; Strand=+
  SCN-specific regions: Sequence locations=1-12,49-353,385-427,451 -546,576-600,623-712,755-960,982-1222,1244-1261,1289-1392,1435 -1523,1550-1711,1749-1781
atgaatttatggaatttaaatatatattatatatttttttttataattgaatccgacaaaatacgaccaaattttgataaaatatttggagatggatatgacaaaatgtaattgaagtaaaagtgataaacacggaacaaaatgacgaaaatgaaaatgcactgatagatcaaatagatggagaaaatgaatcggtccaaatgatcaccaaaaaaagagaaaggattttaaaatttagagcaattcaagaaaaattaaaaaaaaatatccatggcaattcagttccaaaattgatacaaaaattgcaaaattcttaggcgcaactcggaaattaataccaaaatggaaaaatcaattaaatttaaattaaaacaaaattaaaaagcgattttatgagcacaaaaagcgcaaatttattgaacgatttgatgaattaaaacattttttagcaaacagaaagaatttgtgaaagaattgggcatttctgaagcaacattttggaaatggaaaaaagaattggttcaaaagcaccaaaaaagtgagttgatatttttttaataaaaactaattttaaacacaataataccaatgaagatatttagaaaaggtgaagcaatattttgaaattaaggaaaaaacgcaaaaattagcgacaaaaaaattgcagagaaattgggaattggattggcaactctgaaaaggtgaaaaaggatttttcttcaatttcaattttgaaaaatgaaatgcataaaatcaattcaagttatgtgatttatataggttaatgtattattcccattgtgattaagcctgaaaaatcattgcgtacataaagtaaaattcatatgaacattctgaatgctgaagttcggacccgaattcgaggaaaaatcaaaattccaaattttcgaaattaatgtttttgattaaaaatcggtttaaatacacggaaacaaactgaaatccatcaatccttcaataagagatcattcacgccgttttaattccaatcaatcaatcattgaaacgcaaaagcgtgacgccgaaaataaagaaacaatatcaaataaaaattacgtcactttttgagatggggtggcaaggaaatcaacaaatttaaatcagattttacaagaaacttgacgaattcatttgaatttaataattacgtctctttaggaaaatggctacatgtatagatgagaggttcgaataaagaacgaattttggaaaaacaaaaaggattcgttgtttgtttttgtaaatatattttaatttaaaataatttcggggaaaagttttaagtctattttaacctacaactcacaagcgattcttgattataaattattaacaattcagcataattagattgtgacaaatgaatgattgttaattttttaattgaataaaatttgaaacataaatttttttcagcagatcacacgggacaattaaatccagtaatttcgtcaatccattctttgtccagcggagtgtataaggatacaatgcctgttgagaaaaaaataaattaaatttttaaaatgaaaaacgaaaattgtctaatttgtaacaaactttggtttgaattggtgttgcatatcccagaagaaagcaccccaatttggacaaaagctgtgccattggaagccaaaagtgcgctgccactgtcaccctattaaatttgaaaaaacatcataattattggaaaaaaatttttataaattgaaaacaaaatttaaaaagtggcaatttttagttatttgttttttttgcaa

SEQ ID NO: 61028 - DNA, 299 bp, Heterodera glycines
  misc_feature (14)..(14): n is a, c, g, or t
  misc_feature (57)..(57): n is a, c, g, or t
  misc_feature (113)..(113): n is a, c, g, or t
  misc_feature (131)..(131): n is a, c, g, or t
  Genomic contig location: Contig_ID=SeqID_6287; Location=2754..3052; Strand=-
  SCN-specific regions: Sequence locations=1-126,169-299
gaatttgaatgcancggatgcaaagcagagaatcactgaacatcgacaagacagacnaaatgtattcattcatccaaattataattacaaaacatttgaatccgatttggctntaattaaggtttgttttntaataaaatttaattttttaatttttatttttttaaagttgagccgtcctttgatagctccgctatttcaaccaatttgcatccattgcggtgcagctaacaaattcctaaatggaactgtatttgttgcgggatggggataattagagggtaatttcaaggaataaa

SEQ ID NO: 61029 - DNA, 1172 bp, Heterodera glycines
  Genomic contig location: Contig_ID=SeqID_6288; Location=850..2021; Strand=-
  SCN-specific regions: Sequence locations=1-110,147-290,363-1172
atgactaaacgccgcaagtgtcagcgccaaaatgtctccgccgcaagtgtcggcgccgtaagtttcgccttgactgggcgccgcaagtgtcagccaatcaaaaagtcatgaaaaaaagtttaattttaatttatttttattatttagcttgaccatcagcgtttgaaaagatgttaaaggcctgtcggttcttttcattttcgtcactttcgcccgcaaaacttttcccatttaaagttgattatcaaaatcaaatatattactttcatattcgagtattaaaaaaaagctaaatatttaaattattatcataaatagtaaaacaaaaattttataataaaataaaaatgaaataatatttacatgggaaatgttacgtatgcatagaaaatctataattgattggaagcaaataaaattatgcatctctattaactaatctaatgatgtaaatggcatttggcaataaaaggtaaataaaatgggtaaattcgggaataaatttaggaatttcggtcttttcctttcggtccggcacattcccaatatttcttgaaaaataatgtgattcttttcaatccttcattttcggctgcaaaaattttcccatttaaagttgtgattatcaaaattaaatatattactttcattttcgtcgggccaggccgttttcgtacgaatatatgtttttggactttaatttttttatttgtaaaccaaacccaacattgttggtattgtttgatagcccttctgatactctattagcctgcagaattccaaaaaatttcgttcggtttaaaaaaaagtttgagccaaaaaagttggaaaatttggttttttgaatttttctggccataacttttttgaactatttttcgcaattttgcaggctaatagaggacacatagagctatcgaatgataccaaaagtgttggatttggttaataaagaaaaaagttatagccaaaaacttgggctcgtacgaaaacggcccgtacgaaaacgaccctgaccgcattttcgtgtattaaaaactaaatattgaatttattagattagatcgtaaaaaacgcgattaaattgcttttccatcggctcgtttctgatcaaagggctgagtttttgctcgcagcaaatccaatgttgttcgagattttcgaagaataaa

SEQ ID NO: 61030 - DNA, 1038 bp, Heterodera glycines
  misc_feature (11)..(11): n is a, c, g, or t
  Genomic contig location: Contig_ID=SeqID_6288; Location=1..1038; Strand=+
  SCN-specific regions: Sequence locations=1-59,81-109,266-267,289 -314,336-365,388-511,533-1038
tccctaagtanatcccttgaatgataaaaaaacctttgaccattggtgccattatgcttcaaattgataattggatcaattaatttggatattttcaaaaacaatttactaaaattaaaaaaaaataaaagttgagtttaaatttaaattacaatattaagttttaataatctcaatatttttcttcttttatattttaaataaattattctcattaagaaattccataatttactaaatttatttttttttattttgaaaaatacctcttttcttcccatccattaacaatttttgctccggtaatgagaataacaaataatgaaaaataatatttggacttcattttattgaaaagtattgggaatttgacaaaatgaatgaatttgtttagcacttttcatttttcagaatgaataatttgttatcgaacgaatgaatcaccctgagaaatttataatttttcaatgtgtgctgaatgcgaataagtataaattttcattttatcattaaaaaaggataaatttatttttgcggagccgacacttgaggaccctccaaattacttagcagaactaaatgccggaaactgttgtcaccgataatggcacacagtttagctccaacggtttcaaataattcgttaaagaaaatggaataaaccacctcttctcagcgccatacaatctcgagtcaaaaggacaagcggagcgctttgtcgacacctttaagtgaacatgtcggaaacagaagaaggagggtgcacaaaatgtagtgaatacatttttgacatcgtgtcgaacgtcgccggatgattccttgcacgacggaaaaaatcctaccgaactttttattcttcgaaaatctcgaacaacattggatttgctgcgagcaaaaactcagccctttgatcagaaacgagccgatggaaaagcaatttaatcgcgttttttacgatctaatctaataaattcaatatttagtttttaatacacgaaaatgcggtcagggtcgttttcgtacgggccgttttcgtac

SEQ ID NO: 61031 - DNA, 980 bp, Heterodera glycines
  Genomic contig location: Contig_ID=SeqID_30622; Location=368..1347; Strand=-
  SCN-specific regions: Sequence locations=1-244,266-431,453-725,759-980
atgccgaagaaggggtggaaccgggccgggttccgtcgctttgctaggctggaattccgcggtttccacagttttttttgggcctccggagtcacgcagcggtacgcacccgcacacaaagttcgtgcgtccggaggtcgggcgtccgccagacggggaaagtgccggtgaaccatccgtccaacagagtgccgttgcccaagtgccgcgcgtgtttcacatacgcattctcacgcaccttatttgttaggcattatttgtaaaatacgagttgccatttgtacgagttgccattgctctgctcaaaaaaggaaaagtgtcttgggccgccgtggagtttcttcggtacgtaaatttaatggatggatagagagatataatcctttggtcctcaagaattccctttttacaaagtgagagaaaatgccaagtttttaatgtagtagaaaataatactttggcattttttcacggcatttggtctcactttatgcaaaaaaaggggaagcgcttcttaagaatcaaaggatgctttctctatccagccacaaaaaaattttagtaacagcttaaaaatatttggagctttggaacaatgccgacctatggttgttgttgtcttttggccagcagttttccccgtcatcaattaattgccctcggggcccttgtcctcaaacatttcaccaaatgcatttaaaactgtttttttatcgttccacaaccattcaatcattcaatcattcattattcattcacttggtagtcgatgaacacagtgacgggcaacgcaacggcggaccattgctcgtccaatctgatcagataacgaacagcttcacggtttttcatcctttaaaaatggtggttttgtaaaagagattaagccttgtttttttaacttcacacgcaattggaggagtcgttgaagccaagagagttcactggaaaaagggaaaaaagaaaaataattcaataaa

SEQ ID NO: 61032 - DNA, 303 bp, Heterodera glycines
  Genomic contig location: Contig_ID=SeqID_30623; Location=211..513; Strand=-
  SCN-specific regions: Sequence locations=1-303
aaaattccctcagaaataaaatgactattgtgcaccgccctccctctcatactcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 61033 - DNA, 304 bp, Heterodera glycines; identical to SEQ ID NO: 51570
  Genomic contig location: Contig_ID=SeqID_30623; Location=590..893; Strand=-
  SCN-specific regions: Sequence locations=1-304

SEQ ID NO: 61034 - DNA, 767 bp, Heterodera glycines
  Genomic contig location: Contig_ID=SeqID_30626; Location=28..794; Strand=+
  SCN-specific regions: Sequence locations=1-485,507-530,554-658,687-767
  Gene Ontology: Mol. function=structural constituent of ribosome; Cellular component=eukaryotic 48S initiation complex; Biological process=protein biosynthesis
atgctggacaagctgggcggcgtttttgcgcctcgtccaatgtgcggtccgcacaaattgcgcgagtcgttgccgctcattctcttcctgcgcaaccgtctcaaatacgcccagtcgtacaacgaggcgcgcatgatttgcaaacaacggctgatcaaggtggacggcaaagtgcgcactgaaatgcgcttcccatgcggaatcatgggtatgtgtgtcaatggaatgaaatttgaaaaattgggatggatcaaattggcaataacgaaaacggatcaacattggtataattgccttgaatagcttgttcatccagtagaaaaatgcgggagtttgattcatacaaatggtttataatacaaagtctaccaagcattttcgaaaaatgagttggggtaaatcacggaagatttagaaaattggccgggatcgaaacctattttgtattgggatttacatttccggtttaacatttacaaaatttccccctctgatttacccattgcaaatgtgccgtttatattcagtaccatacatacatacattatttttcctcatgttcagatgttatctcaattgaaaagaccaacgaaacttttcgtttgttgtacgatgtgaagggacgatttgtcatccaccgaatccaaagtcgtgaaggccagtacaaactgtgcaaggtgaagaagcaggcggtcggtgacaagcaagtgccgtacattgtcacgcacgacgcacgcaccattcgctacccggacccgcacatcaag

SEQ ID NO: 61035 - DNA, 642 bp, Heterodera glycines
  Genomic contig location: Contig_ID=SeqID_30627; Location=392..1033; Strand=+
  SCN-specific regions: Sequence locations=1-642
  Gene Ontology: Mol. function=signal transducer activity; Cellular component=intracellular; Biological process=proteolysis and peptidolysis
ttgatttcttaattcaggtgatccccgaggccgatcgacaggaatgggccccgagcaacacttaccgcggcattttccaattttgcttttggcgctttggccgttgggtcgacgtaatcatcgacgaccttttgcccaccaaaaacggacaattgctcttcgcccgttcaaaaacgcccaacgaattttggagcgctcttttggagaaagcttttgccaagtgagcgcagagacaaaacggcacttcagaaaataaacggaaaatgaaacgatttctgctaattatccatttcgaaaatttgatctttttcaaaaggcatttcacaaatttgaaataccctcacaattagagagtttttaagcattcctcctgaaagggctgtttgtttttcttacgccttcttaagattgtacggctgttacgagacgcttgtcggtggccaattagcggacgcactcatcgaactgtcgggaggcgtggcggagacactaaacgtgcgaaagtttttgcacatccataagcaacaaatccaacaacaacagcagccgatgttttccgcgtcgttcaatgcctgcggaataccgtacttggcatgggacttttctcagtctgccagatacgtagcggagtcgaatggcgcc

SEQ ID NO: 61036 - DNA, 929 bp, Heterodera glycines
  Genomic contig location: Contig_ID=SeqID_30631; Location=72..1000; Strand=-
  SCN-specific regions: Sequence locations=1-135,157-271,295-452,474 -571,594-643,666-929
  Gene Ontology: Mol. function=signal transducer activity; Cellular component=plasma membrane; Biological process=cell proliferation
atgtatcagattaccccgacaatcaaccgaacaaatatagggtacgtcttccaaaacctctacattttagtgggtcgtgggtttgtgggctgcatagcatcagctatccctactcatggcactctacaattggtacattggatgaccaatggattgacattcatttcaccaatctccattccgttgatgaggaccgacagcgtgtcatcagagtacctgtcccacaggcgtcgcacaaaaaagttgagcaactcagggattttttacaagcaacattgaagagtcaagaaaaagttagacttaagccgcttgcgcatgaagaagggtacttcgataaaccggtagtgctcggctcgcctccacacgccaagcgcctcaagagatcaacaattgatgatctctcttcactgccctctcccccgagatatgatgagacagatgagcaacaatcacagcagcagcagcctcagtctccccccagattcgatgagacaaagaaagaggatgacaaagtcaaagaaacaacccctccttctgccgctaagcaaccgataccgccggctccaacacttgctcctccttcacatcctccaactgaagcgccaaaggcaccaaaacaggcagctccaaaatctgctacagtacctccccaaaagccaagtgtgacatctactattactgctgccaaaacaaccccgcctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccacctctggcagctaaaccaaaggagccaaatgtcgcaaagaagtccactgtaccaactacc

SEQ ID NO: 61037 - DNA, 694 bp, Heterodera glycines
  Genomic contig location: Contig_ID=SeqID_6289; Location=714..1407; Strand=+
  SCN-specific regions: Sequence locations=1-615,637-652,675-694
atgggagatgaaaaggtgaataaagttagcaataaattcaaaattatctataccagaaaacttatgattgcaactgtgttggatcccaattacaaaatggatttttttgaccgggaaatgcgcgatatgtataaacggtggattattgatgagctatcacaggacctcgatctcagccaaaattttgacaattctcagcttgtgaacgaaattgctgaatgttcaagccaagactcgaacccagtaaaaagtctattggatgaatttgttcaggtccaaaaaaaaaataaaatcacaatcttttacatatttaggaaaattctttcgggaataatgaaaatttgtatttggatgtaaacgagacagaattgatcaaacacgaagtgaatgcgtatctgaacaagcctcgcatcaactcaaatattttcaattattggtcgataaattccgaaaaatggccaagactgacaaacttatttaggttacaaataaagtaaacccatataaaattcattaattaaggcgcttcaactcggctcctgttggttctcaggaatctgaacgacttttttcaattgccggaataacacttactgatttaagaaatcggttaactgcagaaaatttggagaagcttctttttttgcatcggaatttaccaatttataatttttcttattgatttttaaacaaa

SEQ ID NO: 61038 - DNA, 596 bp, Heterodera glycines
  Genomic contig location: Contig_ID=SeqID_6289; Location=1..596; Strand=-
  SCN-specific regions: Sequence locations=1-265,287-596
cgcttttccagttcttttgttatgtgataaataggtttgagttggtcaacaagtgtacgaatcaattcccaatcagtttcttaaaaaaatgtgtgaaaaaataaaatgacaaacaacccgaaaacggctcaatattaatattagaatttccaataaacagtccaatagccgtcttgttttcataaaatctctcacacatttgataaacagagttccatctttaaaatgaatttaagaatttttatcaaagacatttaactgacctcacttcagttgatttaattaaaacatgatttggtaaatccatttcctgttgcagtttttgaaaatattctctttgaactgatgatttccttattttcctaatgacttttttgattttttcagaaagcggtaaaaaatccgagtaaattttaataccatcaccgattgacttaatttttcatttttaactagaagaaaacacagacttacaagttgcattttatgtaaaaaacaatcctgggaatcacatccaaggatgtttgtgccaagcttcatcgccgactgagcatcacgtaaaacaagatgtattttgaaatgtcaatgccaaattt

SEQ ID NO: 61039 - DNA, 1091 bp, Heterodera glycines
  Genomic contig location: Contig_ID=SeqID_6291; Location=1887..2977; Strand=+
  SCN-specific regions: Sequence locations=1-58,98-192,290-361,456 -472,495-529,582-624,679-866,892-897,919-977,999-1091
  Gene Ontology: Mol. function=ATP binding; Cellular component=membrane fraction; Biological process=G-protein signaling, coupled to cGMP nucleotide second messenger
atggcttcagcaaaattgagttggaagaacgaaaaagcatcgttttttcaaatacaggttaaaaataataattttatgtaaaaaaaaagtaattattcattcattttgctcatttgtcagttcgaagtatgtacgagcttatacaaataatgaatgaattgagcatacgatttaatgactcagcgctggaggtaattattattattatatccaattaatttattattcttatttttaattgttaaattattttatgatatttatttatttggatttaataatttttaaacatcgaactttaatccaattaaatatttttttttcattgtgaatagtcaaattatactatgacattttcaactattaatttattttatttttaaacattcttaatataacaaccaactattattgaattaatatttatttattcattttaatttaatatttttaaaccatttataatttagcgattattaaaagattcaaatatattttattgatagattaaagctatcacatttagatgttaaaaaaatctatttatcttctattaattgttatattaaaattaaaaaaatccttgagtttgtaaaataaaaggctggggatgcatcacattaaaattaattagttaattaattaattatttttaaatataatttttaattaaataaagaatgaagtcaatatcatacggttacatgtcgagaatggtcttgaatacactgagatcacgtcatcagtgaaattggcaatccaaaggctatggaaagattcggcaatcattgcggcagcgactcacaaaacaaattatcatgtcattgatagcgcatcatagtaattaatttgctaattaccgacagataaataaatattaattttttaattggggtcaattaatatatttttatattacagctttttcgaaaacattgaaagattaacagaaaagaactatttgccaacaaatcaggacattttgatgaccagaatgccaacaaccggagttgtaaagcttgtatttacgctcaaaaacatcgaatttaagtaataaaaaattgcgtaaaaattcaatacgaatttttgaa

SEQ ID NO: 61040 - DNA, 1580 bp, Heterodera glycines
  Genomic contig location: Contig_ID=SeqID_6292; Location=145..1724; Strand=+
  SCN-specific regions: Sequence locations=1-438,460-894,916-950,972 -1194,1216-1326,1348-1580
atggatatgacaaatgtaagggtggatggagtgcccgaatctgacaatttcgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaaacaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagaagtaatgaagaactagagaaaatgttttttatgaatcccaatcatagtaggttcagtttgcaagttgaaacgtatgtcggcattttaccctgaaaatttttaattttagagaatcaaaaaagagaggaaaacgaatttcaacattttttgaaaaatttgttggatgaaagattgaaatttatgggcgtaaaggttaattttttggtactggcacctccgactgatttaactgcagtactattgaggaataaaaaattggcagaagcggttggggaaatactcatcacgggcgaatgtaaaaattgccaagatttacaaccaccgacaccgcttagcctgaacaaatttttgtgggaattaccaagggaacacaccaagccaacaacctacaatgttagaatggacgcattggcagctctgtatcttttcgaaatggcctcaaatggtgaagtgaatgtcctactagtttcttcacgtttacttgctgaaaagttcggtgctggggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatataacaaatgtaagggtggatggagttcccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacatttattcttgataaaagcaacaaacaatggaattacaaaatttcgtccgaaaaacaaaaggtataggacaaattagaaaaaaattgttctcagatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatga

SEQ ID NO: 61041 - DNA, 1381 bp, Heterodera glycines
  Genomic contig location: Contig_ID=SeqID_30632; Location=285..1665; Strand=+
  SCN-specific regions: Sequence locations=1-1381
atgccttcaaaacaagaagttaaaagaaagaaggaacaagagcggtaccaacggcagatggagaaatctgtcagccctggtcgctcacccgtcccagacgggggtgcagatgagaatggggtggcatcgccccggggcttcaacaccccaaatttaagtgctttgcaattaagcaccccggcttcttcaattggaagtaaaagaaggggaagacccccgaaagccggagcggagtcaatcacgccttcgcaaaataatgtgtcttcagttgacacacaatttacatcggccactcaaaatgttgagtcgccgcctagcaaaatatggaaggtcgacgaagttgaccgacccatgtctgctattgaagcaattgcttcaacgcctatttccacgcaaagaagccgtggagggcggccggccaaaaaaagaggcggtccaggcaggagcaaagcaaatgattccatgagcgagcgctcgttaatggaccatagctctgaagctaccacatcagtggcccttttgccaactgtgcctgaaaagataaacttcagcacagtgcaaattaatttcgctacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcaggttggatccgcaactgacggataaaattaaaaatatcatttcggatattttgccgtcaacagtgttgaccggtattgttaatgccataaatctgacggtccaacacgatggaaatagctgcgggtactttgtgtgcctgtatgccgaatcctggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacagggca

SEQ ID NO: 61042 - DNA, 303 bp, Heterodera glycines
  Genomic contig location: Contig_ID=SeqID_30634; Location=169..471; Strand=-
  SCN-specific regions: Sequence locations=1-50,72-148,171-203,228-303
atgtctgagatttggaagtttttcaacaaaaatttgaccgatggagcaatttgtaagctatgtggaaaaagaacggcacgaaccgatgggtcgacaaaaggaatgtggaagcatttggagtttaagcataaacatgaattttctcaactcaaaaacaaggaaaatctgagccaaaaggacgtggtaaaggtttaattaatcacaaatatttttaaaaatttattttaggatcaaaagcaaattgacaattttatggtgatcaaaaaaaacgcattggaagaggccgaagaatgtattacatga

SEQ ID NO: 61043 - DNA, 58 bp, Heterodera glycines; identical to SEQ ID NO: 51629
  Genomic contig location: Contig_ID=SeqID_30634; Location=734..791; Strand=+
  SCN-specific regions: Sequence locations=49-58

SEQ ID NO: 61044 - DNA, 897 bp, Heterodera glycines
  misc_feature (800)..(800): n is a, c, g, or t
  misc_feature (829)..(829): n is a, c, g, or t
  Genomic contig location: Contig_ID=SeqID_30636; Location=45..941; Strand=-
  SCN-specific regions: Sequence locations=1-155,193-223,264-264,300 -548,572-790,852-897
atgtcaaacgctctttcgaccgccaatggaataccgtcgtcacaatttgtgcaaaatccaagcatcatgcaacaaatggcgatgaacaaccatccgattaacaacaaatttgacattggcaccaattcacttggaggtaatggcaaaaatggcggaatatatttttttgaatttttttaaatttcaaatttagtaaatcagcatcaatcagtagcagaagcaccagaagcagcacatcagcagaaaaagtgagaaaacaaattgttaaaaagaaaattaaaattaaaaacttataatttgatttagaaacaaccgaaaaaataatcgacatggaaaagggggaggtcaacataaaatgtaagttattgcatttattgaaaaaccttcccccctccccccccccctgctgaattagcctgaaaagcccactttttgaaaggggttgaaatataaagcccctggggcgggggctcaatttcaagaaaaacggcaattaaattatgtctttaaagcccctggtgagggggctcaatttcaagaaaaacagcaattaaaattatatttttaaattgaaaaaactgaattaagacatgtttcacaaaatggacacaaaacaacaaacaaagggataaagctgaaggaaaagcgaaaactcagaattaagagtagcaaagatatgggaggaatgagaagcaaagttaaaaaattgatcatgtaagttggcgcgggggagcaatggtgggtgagcactgatcaggagaaattttgatcagttctcgtttgagccatgatttttttanaacaaaaagtaaaacaaattattttttcnaattattaaaaaatttttttttgcactttatttaaattttatgttgaaaaaaagcatagaaaaataaa

SEQ ID NO: 61045 - DNA, 209 bp, Heterodera glycines
  Genomic contig location: Contig_ID=SeqID_30637; Location=505..713; Strand=+
  SCN-specific regions: Sequence locations=1-146,168-178
atgtgtgattgtgtgatgatgacctgctcgaagatgacgagtaagtcatggtccaaaatttgttgcagacactcctcaaaaatggacaaaacgcgtgccaatccgcacgcgcggaaagcggcttccaaataggcgaaaaagcacagcgtttcactcttcaacgcctccacattgccttttaattggttaattaattaattaataattaa

SEQ ID NO: 61046 - DNA, 1107 bp, Heterodera glycines
  Genomic contig location: Contig_ID=SeqID_30638; Location=140..1246; Strand=-
  SCN-specific regions: Sequence locations=1-319,341-491,514-902,935 -1052,1074-1107
atgtgcgcgtttcatgtgaagcaagcgataaatcgccgacctcaatcaatgggatttatgcaaatgtacagctcaaaagaaccaaatggacttcagtttcagcgccttgttcgcaaaattggggctctacaattctgtcctcccaactatttagcccgttcgcttcaactcatgcgccatctcatcacacactctccattggaaactttacaacagggcgcattgagtgaacttctcgattactgcgtaaataaatgtaaaactacttagacaacaccaaatatacagaacaacacatggatcaacaacagaatagggctgcacttttttgcactttttgacgttgttcggcatcgaaccatcaaccatgctgagtcttaccacggacgacagcaacgcttttaccagcctggtttcttgctcggccggtggatagcgagttttcaggtacttgtttgtctctaacttttgtatcgtaaatgataggaactaagtcatgctgaagaagaaaccgcagtggccgttgatgaaggaagacaattgccagctcgcccgcttgaattaactcttgaattggacagaggaattgcctcagcgaaggcggacattttggcttctttgaacacggattacggcaatgatgaatttgttgaagccatgtctaattattatggaagaattggacatttggttggcttcaatccgccgtcaaaccgtaatgaagctgaagaaatgataattgaagaagatgcaaagcttttgcttgaacaaagtttggatgaaaatgggctgcttgttgatcaatactttgaagaaatgggtttgaatgaagtgcaagatgaaaactcgcatgatgttaattcagaggatggagaagtggatatcatgaattaattcatatgaatttttatatttttatttaacttttatatttgaagatgcttaaattttacattgttattaaaatacatgaaaattgggtcagaatcatttagactgcaattcattagcgctgagtcttgttttattaagcggtagcgtgtaatacataaaaattttcattgaaaatgaagtttttaaacaaaaaaaacgaatcgggataataaa

SEQ ID NO: 61047 - DNA, 1147 bp, Heterodera glycines
  Genomic contig location: Contig_ID=SeqID_30639; Location=74..1220; Strand=+
  SCN-specific regions: Sequence locations=1-5,28-93,115-290,312 -412,435-533,555-704,879-891,975-1003,1025-1063,1086-1147
  Gene Ontology: Mol. function=protein binding; Cellular component =axoneme; Biological process=N-linked glycosylation
aattcggccacagtgcaatggcacaataaaacggagacattggaattggaagcggaggaggggggagagggggaggacagcgacgaggaaatgtgaggagaaaatgggcaaaaaatacaaaagcattgctttcacttaagcatcgcccagcacagcgcacttgtgcccctgcgcaagtccaagtcggcttttgccgactttctccgtccgtcccaaattggcaattccaaacaatcggccgccttcgcctgcccaataatcattaagaaattgggccccgaaaaagaggacgaacagcaacaaaaggagcatagcgaagggatcgaagaactgatcgatttggcccgtggcgatgtcctccgttttcgaatgtcccatcacttgaaaagctgcgcctcgccaagtcgaagctgctgctcctcctccgcttcttcgctgtctttggacggacgcacaatcagtcgatggtcggcacccgcggcaaactcagagaaagagacggagacggacgatgaaatgtgcgagtgggaggaaggagaagcggaagcggaggaagaaggtgcggatgaaaaggaaataatattgaaaaagggaaattcaggacgaaaaagatcgagttttgggatgtacggaaaaaggagcggtggaagttggtcagcaccaagcggactaagcaaagggagaggaggaaatggaggacaaaaaagggaaaggaggaagagagaggcggagagggaagaaggaaatgagagaaaggagaaaaaggaaaaacggagggaaaaagagaaatggaagaatgagaagaaaaaggaagaggaggaagaagcacagagaaacaggaaaagggaggaagaagagaaatggaaggaagaggagaacagagaagtgactgaggaaaagcataaagaaccaagggaagaggaagaggagaaagaagaagatgaacagggacaatccgacggagaagcggaagagaacgcaagcgaatgggacaaaattggaggacaacaccaaaacatgaagcatttggaaatcgatgcgaatggatggcatttgcatggaaaagcggacggagcggaggaaatgatgtcgacatcgacggatgaagaagaatataacgacgacgaagagaatgaaaaaaggattg

SEQ ID NO: 61048 - DNA, 1032 bp, Heterodera glycines
  Genomic contig location: Contig_ID=SeqID_30640; Location=127..1158; Strand=-
  SCN-specific regions: Sequence locations=1-232,254-448,470-476,498 -534,556-731,753-1032
atggaaagccccgtttactacgcgagcagtccatccaagcaaatcactgtgatcgatgtgtacgacttggccgagtcgataaaccgcgactttgaaaaactggtggaacagtttggaaacgaaccgtttgattcggtcgtgagaaaggttcgaaattaatttggtctttttattttgtaaaaattctcttttccataggtaatttctgcgcttgaaactttggaagctctggccaaatacaatgacaaggaaagttccgaattggtggacctgcagaagaccattgaacggtttgaacaggaaaagcagcaacgacttcgggacaaagacaatttggagaaagtggggagaaaatgggaaaacattttccaattttgtttaaggatttcatggatttggaggagaattacaagcaagaaattgacgaattgtgcaaaattgtaagtttcgcttttttatatagagaaagcctgaacaaataaaagaaatccaaaattaaatttacattttcagaaaaataaattcttcctatcgctttttggtttttcacccccctcaaatctaaaatattacccaaattcagcgccatcaaattaaatagaatttgtctaaaaatttacaaaatttttagcctatctttaaagcaatgttttgggtccagaggtgccgccttggaaattctgaaaattcttgccctattttattaacagattcatcaaaaaatgacaatttttgagattttatgttcctttaatcaaaatgggtgtgatttcagttcggtgttgccatgagtaaaaagcgttttaaaagagtttcccattatttttataacttttttaggtacaaaagttgaaggcggaaaacaaaagaatgcatgagcaaatctcgacctcgccaagtgcaatttgcggcgattgctccgacccaatgggctgccaccaaagcgcggcggacgagcaaatccaagcgttggtggaactgcgaaaaatgacacaaagccaaaaggaacgaatcaaagaattgcaaagggac

SEQ ID NO: 61049 - DNA, 904 bp, Heterodera glycines
  Genomic contig location: Contig_ID=SeqID_6293; Location=507..1410; Strand=-
  SCN-specific regions: Sequence locations=1-353,375-453,491-755,786-904
atgtcggggtcgggccggggaatgtcgtgggtcggggtagggggctcggcgttggggcttttacccaaaataatatacaaaaaacccaaaaaatcataaaattctggaagggaactgaacatgggttgaagttttacaggaaaaaatatatctaaattcccctgctataatttacaatttattatttttttaggtaaacgatttatgcaaagatctagataaacctaatggttggcaattattgaaaaagtataaccatcgagaagtgccggatgagtataatgtggaattccccaaatggaaagacagctacaaaagcattaaaaagtttataaaatattgcaactatcttcagaaaaacgaaaaacccgtccaagaaaacggtaattattcatatacagtaaaattggcaaactgttgcaccttggctaagatgagcggggaatatagggcattaaattttatatttttaaacatttatagaaatttagaaaaacaaaaacacattagcttggagagagcggattaacaagtacaaatttgacctcaaattataatttatttcaagccattagccgttgcaagatttttggaatttatttaaactcaaatctttcggttgttattggagtatattttttggaaatatcaaaaaatcgattgtttttattgcaacaagatttttggaatttatttaaactgaaatctttcgatttttggagtaaatttttttggaaatatcaaaaagtcgattgttttttatttattttactataaaaatttatgcaaaattatgccctcttataatttataaccctaaatttgctcgtttatataggatcaattgtcgcctcatgctctattaatcggtgctatgaatttactcaaaaatgagcaaaataaa

SEQ ID NO: 61050 - DNA, 2373 bp, Heterodera glycines
  Genomic contig location: Contig_ID=SeqID_6294; Location=658..3030; Strand=+
  SCN-specific regions: Sequence locations=1-60,82-443,465-687,710 -1206,1228-1249,1272-1648,1670-1826,1848-2373
atgtctacatcagggggctcgtcaaatgagttcccatttggtacatcccaagccttcgggcaggaaacaaagatgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctacctgaatcgttccttgaaccaaaaagtcaattgggtgaaagatgtcgtggccaatacaaatgccaactttgagactctgaaagtccaattcgagaccttaaccgaaagagttgatatgttggaacaagacagtgatgggacgaattcaggtgggactgttagtattactaatctgaatagagcgtcgcgggcgccgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcaccagactcaaattggctctgagggacactcctcgggcactgtttaaggaattattgccagcacaaaccgacactcttgactcagcattgagtgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtatagagaaaatttgcgaggaattcttggacagattaaagccaaacataagctttcttattcgtctggtgggactgtcacgggcaaaagatttggacttggtaagagcacaggcagaggagctggaagctttactgctgatgaacaaaggtgatgaagcatcacgcctctctcaggcagtccatgcgctgagcaatcagtcaccacagtcgaattggtctacagaagcaaacccgaacaatgaccgtgctggacgatggtcgtcaggcaacaatgtacgtgggtttagacctttttctggatcaaatgcgacgagacaacaacaaagaggaagaggaggacgagaccgctctcgcaattggggaggaggccgccaggagcaatttagccaaagaaactggtcaagcaaccctcgatgccattattgtgaccgtgctggacattttgcgtacaattgccatcaacgccgtgccaatttcagaggaaattccaaccaatcgttccgtcaaggaagatggtcaaatcagcaacctcgccaatctcagggacaatggcaaaatcggcagaatcctgtcaacatgatggatgtgccaaactcttccaacacttcaccaggatttttcgagaacttggcccagtcgttactagacctcaaaattcaggacaatcgcaattacaaaaatgaggaaccaagatctggggcaatgaatgcgctcacacacatcaaacccaaaacaacaacaatggattgtcaggtcgaaaatgaattagcaaaaggatcctctagtgaatccccagcctgtgggcaggaaacaaagacaaacattcccaaaacgtcaaattgggaacggccaagcgtacgatcgaaagtcgcttctttaatgttcattacattaatgcttgttggaatgattttaccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggctgatgcttgggcttgccgaaaagtgagaaaatccgtgcgcaagtacacttcaatcactaatgttccgatccaagagactcttgaaccacttatgttgcaaatgactccgagtgaatgcaatcaaatggccgaaaatggaaagtgcagcttaggcttgctaattaatgactcgggactcttgcatatagacaataaattggatttctcaccccatatgtggctaattggctcttttagttggtcgactgtctcaactgaaaattgttatcattttaaaactaaaattatgtcaaaatacggaagctcggttatgcaaagtcccctcgggtcagtgaacaattgctaa

SEQ ID NO: 61051 - DNA, 127 bp, Heterodera glycines
  Genomic contig location: Contig_ID=SeqID_30642; Location=298..424; Strand=-
  SCN-specific regions: Sequence locations=1-127
atgtctccttacatttttttcgtgggctacgttgttttggcgactcttttgctcgacgccacaaaaacctgttttcatcaattccgtcttctttgcgcgaagaaattggaaacatacttctgcgtgg

SEQ ID NO: 61052 - DNA, 180 bp, Heterodera glycines
  Genomic contig location: Contig_ID=SeqID_30643; Location=21..200; Strand=+
  SCN-specific regions: Sequence locations=1-180
atgcgaaaagcaaaatgcgaaacgccaaaaaatgcgaataatgcgaaaggcgaaatgcgaaacctcggcccatccctgttatgtacgacatattatatgattaataattacgaagttggcgaccgaaaagacggcgcacaaactcaaacaaatacgttccttggaagcccgggcttgttg

SEQ ID NO: 61053 - DNA, 64 bp, Heterodera glycines; identical to SEQ ID NO: 51065
  Genomic contig location: Contig_ID=SeqID_30643; Location=462..525; Strand=-
  SCN-specific regions: Sequence locations=55-64

SEQ ID NO: 61054 - DNA, 1266 bp, Heterodera glycines
  Genomic contig location: Contig_ID=SeqID_30645; Location=233..1498; Strand=-
  SCN-specific regions: Sequence locations=1-206,229-670,757-881,931 -1060,1228-1238,1260-1266
atggtttgcgattttcgaattctgataaaggagcatgcagatttacatcttggcactcaaacgcggcatttttagcagattttcgcacacaattcgagaaccttatctaagaaatttgttgtgtttttttgactacagtccagcaggaatatttgtatagatgaattaaaatcgaaaaatcttttgacaaaagaatcatacaagtcttatttattattttatttaattcggaatttattattcaagttgtatattaatattaattcatacatatgtacaataatgcatatatgtagaaattaatttaaaagtactgtcgaaatcaactactgtcgaatccaatccctgtcgaaaatacctggtacggttttaccatggctaccgatccctgttttttcccacataaaatcgagccggattatcccgttaaaatcccgaagggccccgttccgtccacttttaagtaataatttttttcattattctacaggctcaacaatttcaaccccaacaagcacaaaatgggttcacatttgcgccacccatcaacggtggcagcgacggtggaggcaatggcggcataacgccagtcccatcgccaaatgcggcacagtttggcacaccgattcagccccaacagccgcaacaatattttggccaatacaacttgcaaccacaacaacaacagcagaacaataacaacaattttaatggacaattcaatggcaatggcaatggcaacaacaataataataatcagcatgaaacatttgtaaggataccaacaaatttatggcattaaatttttggcataaattcttggatcgaggcttttgtgtgacttaggaccagccatttttaagaaattctaataccctagcatataaacaaaataaaatttgataattttatatataaatatcaaaatttgttgtgttaggaaccgccaacgccagtgctccatgccgtgccaaatgttgccgatccgctacaacgaccacgtcaaatttatccaggagttcagcaagggccatcaggtccaggaaaattgatttgaatgatttttatattatacagattttttaataacattttaaatttttgtgatttttaatattttctaaattcattgggtaatcaatttttgtatttgaaattcaaaatttttgaaatacttatatttatttttatcttttttcatttcgttattaaaaaataatattttaacttgatttaggattttatataaaataatccttaaataaa

SEQ ID NO: 61055 - DNA, 1031 bp, Heterodera glycines
  Genomic contig location: Contig_ID=SeqID_30646; Location=528..1558; Strand=-
  SCN-specific regions: Sequence locations=1-200,225-239,263-263,286 -354,376-690,712-962,985-1031
atgccaaagttaatttcaatgttagaagcattgaaatttattgtaaatccactttttcacaaaaaataacactttcatcctctaaaagaacaccaagattaaataaatcatctgttctgtattaaccaaaatcgatcacttttcagcgagttggccaattgggcggtggaaaaagaatgcgaaacaattcaaagtttggacaaatatttacaaaatgacaaaattgatgaatactctgaggaaatgaaaaagtttggccaaattgttttgcaaatttgtaaacaaaaggaagtgacaaatgcccaactgattcgaatgacagagacacttggcccaaaaattttggcacaattggccatgttagagcagaaaattcagcaactaacaaattcaacaaattttccacaaaaagcggcaccccttgataattttggcaccgaaatgatggaattagccaaagaaatgccggatcaaatgcccatcaaacaattgaaagcattgaaaacccatttaccgttgccaagtgatttcttccaacttctgctcaccagcctgagtttggtgaacagtgaaaattccatcaagcatgaaaatgccaaagaaagtttggcgctttctgattatttaattaatacaaatgcccctgttttggcacagcgccgacacagacgtggaattccatcaaaactcgtcaaattaggactgattttagcgctgtttgcaattggcacgaagaccgaaagtccgaaaatagtaatgcttgcttgctatcttggatgcatttactcactatattttttgtatggcatttggaagtggtataaggaagtgatggaaaaaattgattagaaaggatggaagaaattgatgtttttcaaaaattagactagatgtgattgataaaaatttgatcttgttctgatttattatttgtaatgttgatttgtaaacaatatttgtacaaaaaaattaattaattaatttgttggcataagacattccgctaaactatttcaggggaggtgaataaa

SEQ ID NO: 61056 - DNA, 86 bp, Heterodera glycines
  Genomic contig location: Contig_ID=SeqID_30648; Location=1531..1616; Strand=+
  SCN-specific regions: Sequence locations=1-86
atgaataaatcacgaatcattcggatgaaaggcgacggttcgccaacgccgccgcgcaaatgcccccgggcgttgtcagccgaatg

SEQ ID NO: 61057 - DNA, 804 bp, Heterodera glycines
  Genomic contig location: Contig_ID=SeqID_30650; Location=38..841; Strand=-
  SCN-specific regions: Sequence locations=1-48,75-506,528-804
cagagaccaccgacaagcagaggtggagagattcgttttgagccaagacaaataacagcagcagcagaagaagaccaagaggaacagcccggaacatcgggcacaataaaaatgggcaccaatgggcggcacagttcaatgaccacgaggtgtgtgtggtgtttagtcgtgttaaacacattctcaaaatggatccaaaagcatgccaattcctgcttaataataaaccaaatagaaagggtgtactcaattttttcagctgcggcgcctatttatactgccggcccctaaaaaccttatttctataaaaaaaattggctcaaattcgcaaaaacaggtcatttttggacaaaatttactaacaaattgcattaaaaattaaaaaatcgcggcagcgtctatcgacaccgcagctaaatctttttttttttgttgaaaatgcgcgccgcaaaaaagcggtttcaaaaagcaaaaaaaggccttgatttacatggccggaccccttaataaattgaatggaattttttggtgtgactcaccgaaatcaattaggtatttatggatttttgtggtaaatgagctttttaagggtccgatttgtttcatttccaaaagttgtaacttctctcaaaatgtatgaaaaaagtgtggaattgtgcagaaaatataaaatcagataacatataaaatatttaagatgcaaaaatgacacagaaaaaagttcaacaaagagtttcacaggccaagacaagaaatggaaaacaattatctgataacacaatgattaattaattacctaataaa

SEQ ID NO: 61058 - DNA, 915 bp, Heterodera glycines
  Genomic contig location: Contig_ID=SeqID_30651; Location=431..1345; Strand=+
  SCN-specific regions: Sequence locations=1-752,774-777,802-915
atgtatgagatgaaggtacgcaagcagaagaggcgcaacccgaacatcgtcttccgtgactcattcaatttgatgccgtgtgcgctggcggcactcatcccctcctacggtctggacgtcgaggacaagcccttcttcccccatttggccaaccgacccgagaactacggccgtgagattcacccgacgcccgaagactacttggctagtggaatgatgcccagcaaaagacagaaatttgacgagtgttacgccgcgcatcgccatgagccctttaaattggatgaggcgttagcgaggtactgcaaaaatattttgctgtaacaataattttgttctcgattttcagttattgcaccaacgatgtggaaatattgatggcagctctggtcgcctttcgccgggaattcttcgaaattacacggcgccaagactacgttgatggtattgataacaaggagaaccacgacgggattgatgtgctgcgtgagtgcatgaccatcgcgggggcatgcatgcggcacttccgcaccaaccacctgcccgacgagcacttggccattgtgcccgagcgcggctatgacaacgcgcagaaccaaagcctgctcgccttacgcttcttccactggtacgccaaggagcatggagtgcaagtgcagacagcccacgcggctggaggagagaaacgcattgggccctactccttggatgggtggattgaggcggaacgacgcgcaattgaagtcaatggtaattgagttaattatttttcatcattattataaaatgggcaattttaaggctgcacgtggcacgggtgcaaaaggtgttaccccaacgacaacatgctgctccccaatgggaagactgcgggacaagtgcgcgaacgggatgccaagcggatggaatttctga

SEQ ID NO: 61059 - DNA, 1302 bp, Heterodera glycines
  Genomic contig location: Contig_ID=SeqID_6295; Location=854..2155; Strand=+
  SCN-specific regions: Sequence locations=1-357,379-457,479-655,700 -1302
  Gene Ontology: Mol. function=calcium ion binding; Cellular component =endoplasmic reticulum lumen
atgtatggatttcggctcggaataaatgagaccatttgcaagaaacagcttaatcttaaggagaaacagcttaatcttaaattaaatataggtaggtacatttgttagttcatcagatacatatactaaaaaaattgcctccggcaattctcgagcttctacgtagttttctgaaggaaaaaataagggcgagagcggaaacaatgtacatatcgatttcattaagatggagaaaaaatgagagaagcgatacatacaaatttgttattgaagtgaatagggagagagaaagagagggagaaaaggaagaaaattataaaatacctaaaaaagaaaagaatgaaaaaaggaggtcgaagaaaggcattatccataaaaattcagccacgtcttcttatgacatggaaaaggtgcccaaatgccttcataaaaatgtaatcatccgtcaaaatgcctttaaattttattcatttttaatcgaccattctctacagctgcagcgatgataatctttctatctgtatttgtacaacttctcatatttgcagtaagcgacaaagaagaattgcaccacgaaagggaaacttttgagcagaaacatatgaatatgggcaaacacaacatggaaatggaccacaaagccattttaggtaagttattttattagtaagaaatattttttttattattaattaattaggatcagaaaagaacacccacgaatttgatgaactccctacggaagaatctaagaaaaggctgagagtcttggcaaagagaatggacacggataaggtgaaaaaaggagagaatacaataatagtgattgatgtttgtcacccccatttttcgaaaatatttttggtttacaaaagtcgtgaaaacctatttacgaggctaaacaattcttactgttagaccaaaacgcgaaattcgaaaattgaaatttacattgttctaatttgggctccgggttcagaatctttttcgaaagatgagtacaaatagcagtatcgaaaatactatggctaattattataggacggctttatcacattggaggagctgactgattgggtcaaaaactcgctgatgacattggaccaagaagagacaaaggaacgatttgacgaaatagatgaaggttggatgctgaaggaatagcaaatgaaccacgtgaatttttaagacaaagatggggtcatcacctgggccgagtacactcaagaagcatttggcgttagcgactcggagggcgacccgcaaaaactgttgacggacccggacgatatgaaagtctga

SEQ ID NO: 61060 - DNA, 405 bp, Heterodera glycines
  Genomic contig location: Contig_ID=SeqID_6295; Location=65..469; Strand=-
  SCN-specific regions: Sequence locations=1-57,79-405
atgcgaaaggaattctttcgcgaacaacagcagcatcagtttcagtttgtcagatggccccaacctccaaggaaaaaacaaacggatatttctcaatttgtatgttttgttattagagaaaaacaaattaggtaatttaaatatcagcggaccacatttttcggttcgcttaatttgaatgatctgtcacccatttttggtttggatgcagtttaaacctcactttttaagttgttgccattcggaagtgtgcttggaacactatttttcattttcgtcgttgggtacttccttaaccatatgaatgtttcggagcaatcgaagagacggagacagccacaaaaccgcgcagaagaagctaatgaaatgggaggaggagacacgaatacagaggacaatgaaaaa

SEQ ID NO: 61061 - DNA, 1054 bp, Heterodera glycines
  Genomic contig location: Contig_ID=SeqID_6296; Location=259..1312; Strand=+
  SCN-specific regions: Sequence locations=1-252,274-309,331-734,756 -956,978-988,1010-1054
  Gene Ontology: Mol. function=calcium ion binding; Cellular component =endoplasmic reticulum lumen
atggctcatgagcagtcgcagtccgagtggtatcagacagaaaagacgcgcttcggggaggagtacgacaaggacggggacggctttttggatggcgacgaactgagggcgtggttggtccccgacttgagtcagacggcaaaacaggaggccgaacacctaaccgaaaatgctgacaccgacaaggtgaattcactacattcaactttagtttaagccgttgttcaaccgctagttaaaaaagacattttaatttctcatgaataaattgtttctttggacataaattttgtcccttgggattgacctacattttcatattattattttaggatgggaagttgagcatagatgaggtggtagaagcgtacaaaatcttcgttggatcagaagccaccaactacggagagcatttgaccagcattcgccatgacgaactctgattcttattcaatcgatggggaaaatccgattatgtaaagcgtagaagagacttcggattaagggtaaaggtaaagcatttgtgcagctcttccattccttcacttggaacaaatttttgagttacaaaaaaaaaatagtcataattaaattcaacagtttctgatttaaagaccaaattattttttcttcgaatatccattcagttccgtcttcaaattccttgtattgctaccccttttgtttccttgattaattttatcgctggcattgaatatattttcgtggaattttcttaagaagagatttttctattttttgaatctcgcgtttacgggtaagcgttaaatcattattctttacagtaatgccatattcatgattaaggaccctgtaaaccattggggacatgttttcgtgaccttttaaaaccgacaaaaaataagcgaattattccaataatgaaaaagtatcgaaaattccatatggcggcgatatgacacacatttctcagctttttctttgtttatttattccctattccatcaatttttaaaatgatttttaatggtattattcccacttcgatagctttatttatttggattaaaaa

SEQ ID NO: 61062 - DNA, 936 bp, Heterodera glycines
  Genomic contig location: Contig_ID=SeqID_6297; Location=1225..2160; Strand=+
  SCN-specific regions: Sequence locations=1-100,123-936
  Gene Ontology: Mol. function=phosphatidylinositol transporter activity; Cellular component=subrhabdomeral cisterna; Biological process=metabolism
atggacccggtggcagcggacagtacactttcaaaatctatcacatcggcaacagaataccgcgtatgtcttggaccaatgggaaaaatgctagcacaccaacaaattgtcagtttggatccgaaatgtgttgccatcgtctgccttggaagcgcatgaagaggcgtggaatgcttacccggcaagtcgggctattactaattgtaaggatgactgtcgatgagtcagtcctattgaaaatttaaagttaatgtttaaagtgagtgattcctgcggttggttttggaactagcaataagccaaatgagtctccaaataccgtagctttaatgtttgaattctcgtttttaatagggaacaaaaacaaaatcgttaaaatgttctgaagtaaatgagttgaaatatgttccccgcaatccaaaaactgccataataccataaatgatttttcaacttaataaattggaagatgaagggcacgctgaattttacaaatactttctcatttatccattcatttgcctaatttaattttcaacaaaaattttcagtacacacgaactcgctattcatgtccgttgatttcacacttcaatgttgaggttttaatgtacattattaaatatttccgaacacttttttctgttattcaggtggacacgaaatatttggacgatgccggaacatcggaaaatgtattcgaattgtctaatagcgaattgaaaaataggacagttggtaagccgttcgaatgaattccatcggaaattggagaaaatttcgcagatgtgctcgattttgttagtgatccaataccatcgcatgactatcttccggaggaggacccgaaattgttcagaagcacaaaaacacagcgggggcccttaagcgacaattgggtggccaattttgtgcgcgaagggaaaccgattatgt

SEQ ID NO: 61063 - DNA, 1954 bp, Heterodera glycines
  Genomic contig location: Contig_ID=SeqID_6298; Location=419..2372; Strand=+
  SCN-specific regions: Sequence locations=1-537,562-1458,1482 -1898,1921-1954
  Gene Ontology: Mol. function=phosphatidylinositol transporter activity; Cellular component=subrhabdomeral cisterna; Biological process=olfaction
atggataccgttgagttggacaagtcaccgcccatcacacccaaagtgtcatcctcccgctccctgctcatcctcgtgttccatggcgatcttttccccaaagtattcgcctcttttcatcagttaatcatcggttgactcatttcagacttcggccgactccaaaattacggacataaacaccttccgttccactctcgacactttgatagccatgcattgtccccaacttcgaggccaaatacacgtccaggtgtttttatgagccgtccatttggtccttatgcgttcctcttggaaatcctaaataatggggggggggttctaatttatttggttattaagccaaaactggtatcttgaggtttccattgtttcgatttatgagcacgaattttgaaaatcatttttttcaaattttaaaatttgtgattggagataaacgacaaacgacctattttacgacaaattgtctgtcgttatcgttcgtaattgtgattggccctgataccaatttaagtcaagttggaactaacattgtcttcctttttaagtgtgtgacctgtggggctgaactgctccaaacttcgcaagttctcagcggcgttttccccagcggattgggcacatttcacccaagttttgtgcctctgatggcagccgatgcgttgctcttcaatgatgttcgttccctttcctttggtccgtcgctaatcgattggctattttgaggctgtccaaaatgccactctgaatgctaatcgagtggtcaacagtttcatcgcttctcaagttgggaaatctgatgcctccgacttggaaatatttgtcgttggcgactttattggcggcattttgatgtacgaatcactggcaagaacggcactgacaatggccgaccagcagcagagagacggggacggctgtgccagtttgacttcaccggttgcggtcgaccagcaaaagtcgcccattccatcgctttccaaatcgcctgcatccacactttcttctccgttcatcactcagcgaccaaacaaagacaaagtaatgtcagtggagaaaactcattggggctgagttggccgagggcaatgcccccttaaataatgaaaaattgggtagttttgaaattgcgtgtaggctgtgtccggaaaataattaaaattctgtctttaaacttattacttttcaaaaatttataaaattcgaaagacttccgacaatgtagtgccgatttgtccccttttatccacttaataatttgttcgcttctcagaatccctcgcgctctctccagtcgctccctgccggcgttgaagttcccaaattcttcagcttcgatgaccagaaaaattcatttgctcattcggagtcgccctctccaatgccatcgtccgacttcaccaaaaacaagtgaatttctttttttctcgctcgtctttgggttgcttttcatttgccacattttcctctttccccctctcttccacacacttttccctttctcttgccaggtccgctcctccatgcgcatgtcgccaattgtccaattcttcggtacaatgagtgtttcccaatacatctaattttctgacttccaggattcctccctttctgccatcagaacaaatcgttctgcaaccgctgaatcgctttcattcaaaccgtccgctgcttttttgctcggatgtccactcgcgttgttgctaatgcaacgcaaattgaacgaaggtttattaaacattttagcaacaatctttttaattactcgctttgcttgcttgcttttcacacacttttctccccccccccttcagttgagcaacaactgtcgctgttctgtgggcagttgttcaatctgttctaccccctcgacctctgtgctgcccgtttggagcctgttctgaatccctctctaagtgctctccccgccctcaaagttccccggtga

SEQ ID NO: 61064 - DNA, 56 bp, Heterodera glycines; identical to SEQ ID NO: 52733
  Genomic contig location: Contig_ID=SeqID_30653; Location=707..762; Strand=+
  SCN-specific regions: Sequence locations=1-56

SEQ ID NO: 61065 - DNA, 440 bp, Heterodera glycines
  Genomic contig location: Contig_ID=SeqID_30655; Location=1304..1743; Strand=+
  SCN-specific regions: Sequence locations=1-45,67-440
atgaacaaaatgtaaagcaattataattttaataattccgaattcatttaatttatttaacaaaaaatagtttccacatttttagttggatttgcaacgacgtttggatggacattctcccatcttttgaccatgctcaactcggcctcaaaatggcactgatttctccacgttttgatgcgttggtggacaaacatttcgatggcaaaagcgaattgacaatttggagaccaatcacaatttgcaaagatgctgttgcagcagtgccgaacttagctgtgcttatcgaccaaggcattcagacaatttcgtgccatttccgttgccaaccattcgctgcccaaaaaattcgctttaacaaccttggattggagaatacaaacacaataaaaagcaattcttttgtcacttccttttcgggaacttggccctttctgtga

SEQ ID NO: 61066 - DNA, 872 bp, Heterodera glycines
  Genomic contig location: Contig_ID=SeqID_30658; Location=820..1691; Strand=-
  SCN-specific regions: Sequence locations=1-156,178-598,621-768,792-872
atgctcagacagaaaaaatacagagaaattgtatactcaaaaaagacacgcgttcgccggctgatcaaccactttgccaagcacgcgcggcgcaaagacggggtgaattgtgtttgttatgaaggcagagtgcatatgcatttcaattatcccacttgagaattttaaaaattggatcacttaaatacataactgtgcatgggggtctcttacaattagtcgatcgtaagaagttggtgggggggggggagtgaaaggaaaaaagtcagcgaaaatgtcgatcgtaaatatgaaaatatgtgaaatgtatacaaaaaattttccttagttcttaacaaaattccaaactttctacgatggactaatcctgatttgtgagaaaaaaattcgtcggtcgtaagaggagagaggtaaagaaaactccgaaattgtctttttcaaaaaagccaaaattaaaaattccaatcctgcgatcgacaccacactccgcctcttttttacagatcctgctttttcggttcatcgaaggtcattctggacccattgtcgcaagagagctgatgggcgaattgttcgaaacatacaaaaaggacatggtaataaataattaaaatctaaaattactgttgtttttctttttcattttttccatttattttgttttttgttcagcatgaagaggatgacgagcagccaagtgaagcggtcttggtcaacaaaaaggacggctcattggacaatgacccaaaaaaccgttaacaaattgcactttaaaaaattacaaattttttagtgttttcgcttaaaaaacttaaaaaaaatttactttttgctgaaaaatttggatttctgagttgttaaaaaataataaa

SEQ ID NO: 61067 - DNA, 511 bp, Heterodera glycines
  Genomic contig location: Contig_ID=SeqID_30660; Location=736..1246; Strand=-
  SCN-specific regions: Sequence locations=1-192,216-309,332-363,386-511
atgaatgaatgcgggagaaacgtgccaatgtcgtgtcgtccatgttgccctcccatttgggcactcgcagcacattctccgggttcagctggaatgcctgcgggtcccagtcgatgtaaatcactttggacaggtcgcggttaagtcgggaaagatcctaaaaattagagggcgggggaggttaaagattagaaaaatttaaaaaaaaattaaaagacatgagggcaggacaggacaggatctcccattgtcctggcacaggaaggggtgcacttcatttccccccgcatcgttcccccccccaccgagaaatttttttttaaaaaaaattgctaacttggaaaattttcaagaaaaaaaatcttagaaagttttttcataggaaaattctaagaaaaaaaattttttgagaaattttcagcgattttttggaaattttattgaaaaatctaaaatccgaacattttcagtgatgaccaagtatattgaagaaaaggcgaaaaaacggtga

SEQ ID NO: 61068 - DNA, 701 bp, Heterodera glycines
  Genomic contig location: Contig_ID=SeqID_30660; Location=525..1225; Strand=+
  SCN-specific regions: Sequence locations=1-337,360-391,414-507,531-701
atgggacatcgaagaaatgggacgaagaaaatgcaaattgtcaaatccgatgaaaatccattgccaatcccgcaaaatccgttgcccaacaaagtcatcggattcagacgcattcaaattttgtagaaattgattaacttggaatttttcgtctaaattttttgattttcagttacatcgatcaaaatgtcatcgcatttctccaccattttcaccgttttttcgccttttcttcaatatacttggtcatcactgaaaatgttcggattttagatttttcaataaaatttccaaaaaatcgctgaaaatttctcaaaaaattttttttcttagaattttcctatgaaaaaactttctaagattttttttcttgaaaattttccaagttagcaattttttttaaaaaaaaatttctcggtgggggggggaacgatgcggggggaaatgaagtgcaccccttcctgtgccaggacaatgggagatcctgtcctgtcctgccctcatgtcttttaatttttttttaaatttttctaatctttaacctcccccgccctctaatttttaggatctttcccgacttaaccgcgacctgtccaaagtgatttacatcgactgggacccgcaggcattccagctgaacccggagaatgtgctgcgagtgcccaaatgggagggcaacatggacgacacgacattggcac

SEQ ID NO: 61069 - DNA, 1425 bp, Heterodera glycines; identical to SEQ ID NO: 6299
  misc_feature (1362)..(1362): n is a, c, g, or t
  Genomic contig location: Contig_ID=SeqID_6299; Location=1..1425; Strand=+
  SCN-specific regions: Sequence locations=1-151,175-303,336-864,886 -973,999-1096,1120-1141,1172-1234,1279-1279,1302-1324,1347-1425
  Gene Ontology: Mol. function=RAN protein binding; Cellular component =cell cortex; Biological process=signal transduction

SEQ ID NO: 61070 - DNA, 2001 bp, Heterodera glycines
  misc_feature (1037)..(1037): n is a, c, g, or t
  Genomic contig location: Contig_ID=SeqID_6300; Location=1129..3129; Strand=+
  SCN-specific regions: Sequence locations=1-82,112-313,349-1164,1186 -1568,1590-1696,1718-2001
  Gene Ontology: Mol. function=RAN protein binding; Cellular component =nuclear pore; Biological process=signal transduction
atgtgtgaaaaaacattgaacgatgagggtgaggacggctgtgatgagagcacaaaggcacatgcggcaaaaatgctggaggtatttaaaaaactatttaaataattaaaagtatacagaaatgcacctaagtgagtaacataattcgtaatttagataacgagaaaaaaaattcatgtacttattttttaggtttttgtgctccaatgtcaaggacgtgcaagtcatttcatcccggacatattgcgtttggttttcaatcaattgcagaaagagtcggccgatttaaaattgggccaactgaagccacaactattaattgtaatatatatataattacttattattgtaattgcttttgtccctttatcagattttgatcgctgctttgtattccgattttcaattatgctccaatttgtttggtcagctgcaattcaaaacggagattggcactttcgaatggcttattcgtgagctctattcaaatcggaaggactttgagggtgtgcacgaccgcaaaatgctcatttggttgctctgtcgcattttggctgatggaaatttgcccgctttgttcattaatcagcctgaaaaggtggttttattctaaatgctgaagagataccaaattaatttggtttagtttatggaatggcttctgactctttttgaggaactccaacggtgcatcaaagaaatagccgaacggagggaggacgactcggactcagaggacgaggagtccagcgaggaggacgacgatcggatgaacggagagttgaaagactcagacgacgatgtggacgaaggtgagcacattgaggaaacccttagcaaaagaggaaacgtcaaatttcaagagaactcgcaatatctgatggcattggagcacgaacgaaatgagcgaaaagaacggaggacgcgaaggaagtcgagcaccaacaaaagcatggacgatcagacagagggcgcaccgggcgacatcctttcccttgcatcggaaaccaccgactcggaagagcaccaccattttngaggtgtgtttattcaacgcaaaaaaagcacagaaatatccttttcaattaattcggcattttaggaagagactgaccttgaggcattttctacaccactggacgaccaaggcgacaataagccatgtctgaatgtgtttgttttgttcaaacacacattggaaggtcctttgtcattctttgactgattgaaaactttaattaacaatttcagaaatgaatacccgcaattcgcctcttttggtcagcatttctgatcagcaacgaattggcgaggcacgagttgcaaagcttaaccatttgatggaaatttgcactagagaggaaaatttggagaggtcaaagcgcttggcgcaggccggcggctattcttttgacgccaatgcgccggtgccgacaacattcagcttcagctgatcgaagagagagaaagaattctaatccattcattcgtttgtctttgatcactttgggtgtaaaataattccattatgccttttacaccgcaccacttttgaataccgctcaatgttccaattatttttatttttcgatgaatggttcgactgttgaaatttgattatattgttgacaatgagtggggttttttccatcaattcgagtatcgtattaataccttaatgacaattaagccatgttaatttgtaataagcaaatcacccgagaatgaattatgctaacttcagatgcttttcctcgcctatagggcaacattatgtaggaatttacgcagaagtgtcgtttcgaaagcagcaaataatgttgcggaacaggggacttcttcagtttcgggaaataaggagaatctgttaaatgcctatttacaggtcagtgagaaacaattggggggggggggaggaagaagccgttgggagcagttcaatattttttcaacttctgcggatatttgacccggaatttttaatgtacgattttttattta

SEQ ID NO: 61071 - DNA, 807 bp, Heterodera glycines
  misc_feature (547)..(547): n is a, c, g, or t
  Genomic contig location: Contig_ID=SeqID_6300; Location=1905..2711; Strand=-
  SCN-specific regions: Sequence locations=1-398,420-807
taaaaataattggaacattgagcggtattcaaaagtggtgcggtgtaaaaggcataatggaattattttacacccaaagtgatcaaagacaaacgaatgaatggattagaattctttctctctcttcgatcagctgaagctgaatgttgtcggcaccggcgcattggcgtcaaaagaatagccgccggcctgcgccaagcgctttgacctctccaaattttcctctctagtgcaaatttccatcaaatggttaagctttgcaactcgtgcctcgccaattcgttgctgatcagaaatgctgaccaaaagaggcgaattgcgggtattcatttctgaaattgttaattaaagttttcaatcagtcaaagaatgacaaaggaccttccaatgtgtgtttgaacaaaacaaacacattcagacatggcttattgtcgccttggtcgtccagtggtgtagaaaatgcctcaaggtcagtctcttcctaaaatgccgaattaattgaaaaggatatttctgtgctttttttgcgttgaataaacacacctcnaaaatggtggtgctcttccgagtcggtggtttccgatgcaagggaaaggatgtcgcccggtgcgccctctgtctgatcgtccatgcttttgttggtgctcgacttccttcgcgtcctccgttcttttcgctcatttcgttcgtgctccaatgccatcagatattgcgagttctcttgaaatttgacgtttcctcttttgctaagggtttcctcaatgtgctcaccttcgtccacatcgtcgtctgagtctttcaactctc

SEQ ID NO: 61072 - DNA, 987 bp, Heterodera glycines
  Genomic contig location: Contig_ID=SeqID_6301; Location=1..987; Strand=+
  SCN-specific regions: Sequence locations=1-257,279-540,563-717,739-987
  Gene Ontology: Mol. function=farnesyltranstransferase activity; Cellular component=mitochondrial inner membrane; Biological process =heme biosynthesis
tttaacttttttttaattttaaggttgtaatcacctcacctccgcccttggcttcgtaaatctcgcgctttacgccggtgcctatacgccgatgaaacgaatccatcccaggtggtcgtcttcttcctctacacctaaataattcccaacgaatgtgttttccgactttcagctgcacttggatcggtgccattgtgggtgccatcccgccactcatgggttattcagctgccaccggtcagtgtttattgttagtagggttagcgggtttaaaacatcgacctttggtgtttaactgtttacatggtcggaccccttcgcaaaaatttctgtttactcccacttcatcctatgccaggtcatctcgattcggccgcttttgtgctcggcgcactgcttttctcctggcaatttccccatttcaatgcccttagttggaatttacgtgccgattattcggcagcgggatacaaaatgatgtgcgtgacgaacgaaggattgtgcaaacggacaacattgaggtgagaggaacttcactcactccctgccctccctttccaaccaaaacaacgaaattgggtctatttcagttttacccgacaataatggataatccttaagcttgggtttttacttctctgactatatgttagggttttcttctgttaattaaggcactctgtggcgctgctttgtctctgctcttttgctgctcctttcacacatttgaccacttggaccttcgctttcacttcactccctctaaacctttcaatgctttacttggcgattcgattctatttaaatacagataaaaagtgataatattctcaattttcaatgacatttatttcttcgcaggaatgccaccaatctgttccgcttcacacttctctacctccctattttaatggccttgctgtacgcatcgaaagatggatgccaaggcattgtcgttacaaagaaatcgcaaaaactattagagtt

SEQ ID NO: 61073 - DNA, 563 bp, Heterodera glycines
  Genomic contig location: Contig_ID=SeqID_6303; Location=239..801; Strand=+
  SCN-specific regions: Sequence locations=1-33,63-191,245-400,422-563
ggctctcaaaccgttgtgtcacttccgtctacttggaagaaaccaagaaagaaaaccaaaaaagccatcaaatttgcgcctgaagatgtgatggacaaagggttaggctacgatttggaggacgatttcattgacgacgaacaagcggtgagttgtgggttattttatgttttttttttaaagttaaaccgaaggaaagtgtgatttttatgattattaacaaatttaaaaagattatttttatcctccacattaaatgttcttgatttccctttaaatttagtacgatgaatgggtgcctacgacaatggacacggccaagcgaggtcattacgtgaacaaaggaccgttggagttccgacaaatcgactttgaccagacgacctcggaggaagacgaagagaaggacggggaggaggagagcaatgggacgagacgagagacgagcattttggaagcagacgaagaggaagcgatgaatatggaatgatcaaatttctataatttacattaatttattctgtattttcatctttgtgattatttaattgctaaatattaca

SEQ ID NO: 61074 - DNA, 1260 bp, Heterodera glycines
  misc_feature (1242)..(1242): n is a, c, g, or t
  Genomic contig location: Contig_ID=SeqID_30664; Location=14..1273; Strand=-
  SCN-specific regions: Sequence locations=1-119,150-484,507-1260
tctgttcggtgtgccaatgtttgtcggctgttgcgccattctttggatttattgggacatcttcaaaaaaccaccaaaaccacgaggacctcacaaaaagaaaatgtaaaaaaaaacccaaaaattaaaattttttcaatttaatttttcagtttcatctccggcaacagttggctggcggtgttcaatttgcttgcaccttctcaagttggacagggaatagcaatgatcagccaccgatttgacaacatcgtcgacaaacacttcgagacgcggcgctggacactgaaatccatggggattgggcgcaaaattgaaaagaatggcacaaagaaactgaaaattgtcaattccgttggattaccattggcaattccgcaaattcaattgccacacaatgtcagcggcttcaaacgcatcacaatctcgtaaaattgacgattatgcaagaaattcaagcagtccttcccatccattttcagtttcatcgacggcaaggccatcgcttttctccaacgttttcgcccacttttcgcctcctgtccgcttaatttgttcatcgatacgacgagtgaccgaattttggagtccattttgcacaacatttggccattgctcagcaaaaacatcgatggcattggattatccgccacaatttaccgccgtttgcgccaattcgtgccgtcaattctcaacgaatgtccatctcttcgcattgtctcctatgttgacgatcttttcgccgaatttccggccgatgacaatgccatggcgtcggatggacaagcgatggccaaatggcttttcactccccgcatggacgatgtgccaaaagtgttgcgatgctggttgaacaaggatgacggggatttggcgtcaaagattgaagccttcaaagcggtgagttcggtcgaattgatttatttggctcttttatcatttcgtatttctcaaccaatttctccatgctttaggcatttgccaatgcttcttctcccgccaattccatcgtttacctttcgtttccttcgccttttgcttccgttgtgccctttgatctgaccaatgaatcgactcgggaacaattgacgttgaaaaggactgacttcagctgccgttttctgttggtccgttgtccaattgcgcgagacgaaagcaaatggacaaaatgggaaaaggaagcgattggaagaatattctttgatcagtggaacagaattgacattcgccgggggtggaganggatgaaatcggggaagg

SEQ ID NO: 61075 - DNA, 726 bp, Heterodera glycines
  Genomic contig location: Contig_ID=SeqID_30666; Location=214..939; Strand=-
  SCN-specific regions: Sequence locations=1-643,665-726
atgccaaacccggcatatggaatgccaaatccgtcacatggaatgccaaatccggcaccgtcgtcgatggccgtcaacaatggtccaatcaactgttcgccttccaagtgcaacccatgcaattgtagtcctccgtgttttgtgcagcaaacagcggcgaccggtgaaggccccggaggcggtcccgcaatttcgttggtactggcggtgagttttcgcaagaagtttgtaaaaaaaattttcatcagtgagtgaaaaattctcgaaaataaatgcgataggcccccgcccggagaaaattaaattttcaaatccattgatgaccaaattggttgtcaaaaatgtatgcattaatcattttttttaatcctaaaaattatagttccaggattttttcggcaaggttgtttgtcccaaatattaaattcgttttgaataaatcagaacagtaaccagcattcgatcaaaaattcaaattttaaatgtgtttttttcgagaaactgacaatggcactaaacaaaaagtaaaaattcaaatttgaattatgtttttgtgaaaagctgacaatggcacttattaatgagttaatgacactgaacccatttaaaaatttttttccagtattatgctcttaatctcccgaaaatatgaaaacaaaaatatttcaggctgttactctttctcttcttggcctgctgactgttcatggcatgatggttttgccc

SEQ ID NO: 61076 - DNA, 1031 bp, Heterodera glycines
  Genomic contig location: Contig_ID=SeqID_30667; Location=679..1709; Strand=-
  SCN-specific regions: Sequence locations=1-17,39-1031
  Gene Ontology: Biological process=neurogenesis
ggttcgtgaacggcgctcttctgactccttccgactccatgtcctttatctgatcaatgattgggctcactattggttcgtgtttttgttttttcgtttttattccatattttttagtcagcgtaaaaagttggacagcattcgtcaaatgctttcgcgctacgtgcccaaattgtacgcttacgcgtgcagcagtccaatggcggcctcgaataacacattcgtggacaaattggagaaattggtcggtgtttgggaggggcacaaatatttcgacgacggatgctacaaacaattgcgaaatccctccgcgacaatgttggcggaacagaccgccaccgtcgcggaacaacaccaattggctgcggaagtggacaaagaaattgcagacacactcggcgcatacaccaaacagcacaaagaatatgagcagcacgtgcttacgaaagtcgcagaacgggagaaagcgttgagagagtgccgaggttggaaaatgagggctaaggcgtaaatttactcaatattcttcgaaaaaagaaatatttaagggactaaaacaccaattttccatgtaaattatatatatacatctaggtatatatgtgttttgagtacagaattttatttcgtgcaaagtgcctaaatctgatcattgaagaaaagcggaaaatgaacgaaaacgcttggctgccgagcgggagaacgttgaacagatgcgtcgtcgctcaacgcgcttcgaccagacaattcctcttccatccacaaattcgccgcacaaaatcccatcactgcttgagattaaccctccaccacacagtccggctgtgcatcaacagccgtgccttggcaatgggccttcgtcgatgggtacgccttttccccctcttccgcccactggcgcggcgcctcccccaatggctcatttcgctcctccacaacagcgtccaccggtcgacctcattccgaaggctccgtattatgagctgcccgctggcatgatggtccccctgatcggaatcgaagacatcaca

SEQ ID NO: 61077 - DNA, 830 bp, Heterodera glycines
  Genomic contig location: Contig_ID=SeqID_30669; Location=319..1148; Strand=+
  SCN-specific regions: Sequence locations=1-784,806-830
atggacaacaagacggacttggtccatactttgttctcttatctcagtgaaaaatacaccgttttcgacagagtacgttttcattccccactatgttttgttctttctactctttgtttaggaccgaaatgttggtcttatgaaagtgttaattaacgtgtgccgcgaaaatgccattaaacgccttggcaatgtttgtccacccatcccttcgtttcctttcactcatttttcactatgcatagatttttgtttctctccaactcgacgatgtgaatcggatggcacatttgggccaatcgctaccagcaaataacgacgaaatggagaacgctgagcaaatcattatgcgtcttcgtcataaatctccctattttgtggccagaatcgacggacgcactcaaacagtgttttttgaggaggaggctaaaagcagcaagcaacaaatggcagcacagctgcaaagcaaagtggacacagcaatggccgatgtgattactcttgccagcattgtccactcttatgaagatgccgttcgacttaacaccaattagtaagccgtggaagcttcgccactgggtcggtcattcattcacacaaattttagtgtggaaaaatgcgctgcacaaaaggagaaattgcgtggcgcgggtggcaatgggggaggaagttcgtcgtcaatgactttcgacgacgagggactctttggtggtgggtcgccctgatgtgaaataatggatttccaaaatgatcggattttaagataatcgaaattgttttttttaatttgttttgtgtaatatttggaaacacaatggacaaaaaagaaa

SEQ ID NO: 61078 - DNA, 716 bp, Heterodera glycines
  Genomic contig location: Contig_ID=SeqID_30670; Location=536..1251; Strand=+
  SCN-specific regions: Sequence locations=1-456,478-716
atgtctcgttacttaaaagggaacccacccgaactgtaagtcggaaaatgcatatgtgtgatataccattggatagagcagggtcgacttctattgtgaatttttaatattacgtccccatagaaagaaattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttagcttttaattatgctgtacaatgcttttaagccccgccgtgcggcggctcccattttgtgcactattttagtttttaaaattggttccggactttttggctttttgaaataaattgtgaaaaatatacgaaaattattttagcttttaattattcagtacaatgcttttaagccccgcagtgaggcgggacagttccaaaattttgtaccacattttactgtggaaagtccaagtaccttattggacaactacgtgtcaatgagcacagtcgcctttggccagttgtggaacggaaaaatgggaatatcagatggggagcgctcttttctaaaaattcctcttttcgtctaa

SEQ ID NO: 61079 - DNA, 383 bp, Heterodera glycines
  Genomic contig location: Contig_ID=SeqID_30671; Location=413..795; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaaataattctccaatgtggcccaaattttaggcccccagccacagccccttgcttctcccagttttaagtcttggatttgtcaa

SEQ ID NO: 61080 - DNA, 1018 bp, Heterodera glycines
  Genomic contig location: Contig_ID=SeqID_6304; Location=313..1330; Strand=+
  SCN-specific regions: Sequence locations=1-320,353-384,426-494,516 -845,867-957,980-1018
ggcgattttgcggttgtgtgcagcgtggacaattccggagacggcaacgtgtcagcattgggcagtgaagtgatcccgttggaccaatgccgtcatccggcaatgtgtatgctaattgatgccagctcagtgaaacagtgcgccatttcggtgccggacgatttggtcaactattttgtgcatggcgaagacacatttaaaatgttgttggaggctgtgtccaaggtttacatattttttccatttgcgatgtaaaaatggacgggggcttttacgtttttatgcgccaaaaaaattaaaaaatatgtcaacaaagacctaaatggatagaaaattattgaaatttcaatgaaaccaaaaaaaattgtaatactattttttgtgaaattttttttattaaactatatttcttaaaaaaatattttgtaatgctgctgacttaaggttctcatcaaattcgaccaggaaaacaagcagattgttgtcaaggttactatatatatatatattttttacgtaaatttgccaaaattgttttgggttttccagtgctaaaatagcctagtatgcttttttacacaaccaaatgggtattgggcgcaggtgtttttatggaaaaaccaaacacgtgcctacttttagggtccgtgacggtttttgagttttggccatgacattcatgctcacttgccatatttttaacttatttttagtcatccaattgtaatacattttaaatgcttccggtccctgtattttttggcggtgtgtgtaaaatttgcacttttttcatgggtcaaacattttaaaaaatggattctccattcagagttttttcgccggtgcgctcaagaaagtgcagattctgaaggacactttcctgctgcacagcagacagaagatgctgttgctgaaccgtcatgaggagaccatgaaaatgttggccgcccaggagccgcccgacgagttcttcgaggagtttgaagtgcagaccgcgatgatgggacttggttggtag

SEQ ID NO: 61081 - DNA, 2317 bp, Heterodera glycines
  Genomic contig location: Contig_ID=SeqID_6305; Location=2546..4862; Strand=+
  SCN-specific regions: Sequence locations=1-123,145-151,173-827,849 -1072,1094-1363,1402-1997,2020-2146,2208-2256,2279-2317
atgaaaagagcaaaggatgatgatgcggaggaaggaagagtaggggaagagagcaatgtgtgggcgcacaatgtgtgaacaatgaggggaatttgactgatttttggcgccgaatttggacaccttttgttttatttctataatggtttcgtccctttctttctcttcttttgtgcgtaaattatgatgcaaaaaaaaaaattgttttgtttcctttgcttttcaaatttttaattaatgcattgttctatatatgttctctaattttttttctctctttttttgtgtttgtgttgccatttttgacattaaaaaaccgagaaaaatttttttatgttttactttttgtgatggaaccgcgccatcgacgaagcatccgtgaagcgaacaacattggctggacaatcaggttctgttcttgctttttttcttagcattcaatgttggctggattatggccgtcgttataggcatcgtttggaattcccatatgtcagttgcattcagtttttatcggaaaattggcaaatagtcttttttattaagcgaaaaacgcatacaaatccctataaaacgcctaattcgggatttttgatgaggagaaaaatatccctgcaaattgaatgtttgaattcagccgcccaccccaaatccaggggtcggattttgaaatttgttacaattctattctctgaccctgaaaacctataacataaaaattatttccggatatctcgactcagttcgaacaaaattacattcggaatttgtttaattctcactaaatgattcacatttttcaattgtcagtgaccacccagaagatcatgatgccaccgctgctgattgtgagcagcagcatttgctgctgaccagcaatgggaccttgtcagcagcgtcttcgtcatttggtgttgtcgatggttgcggcggaggtggtggtcgtatttatcctggactgtttgctgaggacgatgctgctgaacacaagggcaacaccagacggagtgcccaaaatggggctggtggtccagcagggcgcagcaataacattggcccaaaaggcagtggttggcctccaattaaaaggtttgtgcgtatggttgagtagtgcttgctaattagaggggattcggcacggccaagaaaaatcggggaaaattgatgccatgatcaattagtggttatgcgccggattctaaattggttgttgtcaaacgatcaaaatagcaacctttttgcgcgccggttttgaagtgtttgaaatgggacacggaaaataccacaagaatttaaaaattttcagtgtaacaatggaagaacaggccgaagatgatgatgatgtcaacggtgaccataagactgacgatgatgaggaggaggaggaaaatgaagtcgctgaagaagagccgctgtatccaacccgtggtggtaccatgaggaataataatgccaattccgtgcctgctgttgcgcaaaaaattgtcagccgtcgctctttgccaggtgaaaaagcattctaatacttacttactgtttttgtgggccaagttaaatttggtatatacatttatttttagtatattggggtgtgctaatattgaaacgaaattttgaattaaaaatcgtattttttttatacttttttttcatctggacatgtaagacaccaaattctaaacaaacatagcaaatctggacattggctagtagaaattgggtagcttgggccctgttttttttttttttgctcgtttggccaattttttggtcctagaaccggggtttcgttcttgaattttcccaaattctcatcccaactaaatatttacacgaaaataccaaggaccttgttgtctcgctcctaatacacttgtaatgtaattttttttagcttcatttcaacatcaaccacagctgcaaaagcgatggtctccccaacaacagcagcaagccgtacagcaaccatggcaacgccgtcgacaccaagccgttgttgatgatgacgaggaggacgatcaaggtggaaaaagtgccaccgatggtggaactagtgccggtttctggcagttcttcgactcaaattttgagcaatttgttgctcgaggtcacggtcaccggcggcccaccaatggtggtaaatgggaaattatttaattagaaaaattcaatttaaatttgaaaattttatttatttatttttttttgaaatcctatccgtatctgtttttaatttttggaaatttgttcagcgatgttaaaaaagaaattttttgggctaaaataataatatttctgattttctgtttcaaatgca

SEQ ID NO: 61082 - DNA, 438 bp, Heterodera glycines
  Genomic contig location: Contig_ID=SeqID_30675; Location=670..1107; Strand=+
  SCN-specific regions: Sequence locations=1-438
aaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 61083 - DNA, 264 bp, Heterodera glycines
  Genomic contig location: Contig_ID=SeqID_30676; Location=156..419; Strand=-
  SCN-specific regions: Sequence locations=1-264
atgggttcggcccaattccatgccgcccaattgcacaaactgttcatggacacggctgggatcagtgaggaggacgaggcgagtcccgtgccgtcgcttcacaaccagccccagcaacaacagcatattcatcaccaaattttgccgcatcatcgctttgttgacgctattaaccgctcgccaccattgccgacggcgcatgcgctgccggcaatgcaacggcgcaggatggcaacaatggcgacgacgacagggctggcatcg

SEQ ID NO: 61084 - DNA, 531 bp, Heterodera glycines
  Genomic contig location: Contig_ID=SeqID_30677; Location=598..1128; Strand=+
  SCN-specific regions: Sequence locations=1-476,510-531
atggccccaagtcacaagctgttcttccaattggtcatcctgcttgtcgtggcatcgcatgacatctcgaatggtaagtgagaaaaaaattcaataggtcaagacttattgacacgaaataattttttttggaattcatattttaattgattaaaaattaatctgagttttgttgtagtcaaaaagaaatatgcacttttttaggtttaagcctaggaattcttgaattggttttatggtttgtatgtgttggttgatttggcatgaatgtctccaggccaaagctaaccccggaccagccgaacctagcatctcggaaatcaacggcaaaacgcggaaagagaatggaatcgaggccgactgatcgaaagcacggtctggcgaccaacggacaaagcgcacacaaaaccatagccaggggtgaggtctgaggcgactaatgtaccccgcctcaccgaaatcaaaaaatttcaacgaaaaaaattttttttaaataattgttttaatttgttggttttgtgcaaatttata

SEQ ID NO: 61085 - DNA, 181 bp, Heterodera glycines
  Genomic contig location: Contig_ID=SeqID_30679; Location=1..181; Strand=-
  SCN-specific regions: Sequence locations=1-46,68-181
aaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctat

SEQ ID NO: 61086 - DNA, 623 bp, Heterodera glycines
  Genomic contig location: Contig_ID=SeqID_30680; Location=596..1218; Strand=-
  SCN-specific regions: Sequence locations=1-57,79-335,357-623
  Gene Ontology: Mol. function=myosin ATPase activity; Biological process=hearing
aatgtttgtgccgattcatttgaccgatggccgtgtcatttcactgccaatcgttcgttttccttttcagtttaaaattcatttaatccgttttttattatcggactcgcaatcgaccccctttgaattgtgcgaaatgttgtgccaacaaatttgtctcaaagatgcgtttggcttcggcctttttcttgccgttggtcgccgttttatccgttctttgggcgttggctccgaatgcgtggtaaaattcgataaaactaaatccaaaaaagcaatttatcttttacagattgacgcaattgcatcgcttgagacgaaaagcgaaaaaaattggcgaattttctttaagaaagaattgtttagagcccaccaaaggtgcgttgccatcatttcctgacaaatgaagccttccttttacgactgactttccgtttaagtgaatccgacgaccctttggccattgaattggcttttcggcaaattttgggcggcattcactcaaaggaataccaatgcgaaaaggtgcgctaaaatgggcaagtgaattgctgcaacttttctcatcgcttcacaggaagatgacctcgtcactttggcggcgcaacaacatttcattgacatta

SEQ ID NO: 61087 - DNA, 773 bp, Heterodera glycines
  Genomic contig location: Contig_ID=SeqID_6306; Location=3232..4004; Strand=-
  SCN-specific regions: Sequence locations=1-773
atggctggaagaggtacaaccatagttagaaaaggtataagctggctggaagaggtacaaccacgtaccacgggtggaagaggtgcaacaatgattcgaaaaggtacaaccttggctgaaaaaggtaacacttggatctgcagaggaacaacatgattataagaggtacaaccacgagtggaaggttcgaaagatacaaccttggctggaaaaagtaatactttggtctgcaaatgcacaaccatgaggaagaattacaaccatggctggaagagatacaacaatggtaagaagaggtacaacctcgggttgaagaggtgctaccgtggtacaaagaggcacaaccatggttagaagaggtacaaccacgggtggaagaggtgcaacatgattagaagaggtagaacaatggctgtaagaagtacaacaatggttcgaaaaggtacaacattggctgtaaaaggtaacactttggtctgcagagacaccaccatgattatagaggtacaaccacggaaggttctaaaaggtacaacattgactggaaagataacacattggtctgcaaatgcacaaccatggctagaaaaggtacaatcgcgggcggaacaagtataaccatggctgtaacaggtacaacaatggtaagaaaagaacctcgggtggaagacttgctaccgtggtataaagaggcacaaccatggttagaagagctaaaaccatggatggatgaggtgcgacaatggttcgagaaggtaacaccttggatgtga

SEQ ID NO: 61088 - DNA, 367 bp, Heterodera glycines
  Genomic contig location: Contig_ID=SeqID_6306; Location=4482..4848; Strand=+
  SCN-specific regions: Sequence locations=1-181,203-294,316-367
atgtttgcaggaccggatccggccggattaatcctgcaaatcctgttttttccaaaaaatgcaggattgcggactgggattctgcaaaatcctgcgcaggatccggtcctgcgcgcatttcagttggcgatccttgctacacaaagtcactatttctttttggacggagaaaatgaaatcaaagaaaagaaaattaatgtgatcgttgttcggtgtgaaaacgaccgttttggaagggctatccaagcggggcagtggtttacccaaacagttgaaaaccaaatgaaatacatgataaagtaatttttatttaaatagctattagtagggtcgctacttttagtgacgaaaatctcaaaatagttaa

SEQ ID NO: 61089 - DNA, 658 bp, Heterodera glycines
  Genomic contig location: Contig_ID=SeqID_6307; Location=1432..2089; Strand=+
  SCN-specific regions: Sequence locations=1-233,255-454,476-529,554-658
gccaacattcaagcagaattcgcgggttttcttcgtcaaaaacaattttatgaccgtggcattgggcaaatcggcacaggacgaacagatggagagggaaatttgaaaaacattggctttaaaagacatggcaaaacgcccaattataacgtggaccattgcagaaaaattataaaatttttgatttgtaccctcccaatttgggtgaatttatgcagccagcatagtttttatgattggcagaatcttttaaatatgagactgcagactgggacctctgaaattggagacattaaattctcaaccggagacataccagaaaaaatgtgcatttggccgttttccatcactcaaaaatgccgaaatatgggaaaattttcaaatttaatttgccaagacaattccgcccttttttaccattaattttgtctaaagggccattttcatattaggcaataaattaaaatgctaataataagatagtttttgaaggaatattcagaaatttcctccccccccccttcggaagtaaatttaaatttaaaaaaaataacgcactccccaatttaggcaaacgaattgcacaaagtgagcgcacttttgcggggccaaagtggactgatgttcaccaatgcgaaggcaaacgaagtccaaaggt

SEQ ID NO: 61090 - DNA, 430 bp, Heterodera glycines
  Genomic contig location: Contig_ID=SeqID_30682; Location=7..436; Strand=-
  SCN-specific regions: Sequence locations=1-118,165-378,414-430
atggaaatatttgacgaatttattattgtttatgaacaagtgatcggtaaattctctgatcagttcactggaaagtgttcgtttgaggaaattacccaatttgctgcactgtaatttcattttttaaaaatttattattacaaaattatttttttcattaaaaagcaaccaaattgatagcatataattaagcaaacatgagtttttttttctatattaatcacttacatattttagtgaatttttgacaaccgattatcccgcattgaaaatcacggacattggcaatgcttcttcttccaatccgtcgaatgaggagccattggcacaaattgtccgttgggattgggaccaaaatggggcacaacaaatcattcaagtaataaaatataaagaaatattcaaataaaaaatgaattaaccaattaaa

SEQ ID NO: 61091 - DNA, 1438 bp, Heterodera glycines
  Genomic contig location: Contig_ID=SeqID_30684; Location=27..1464; Strand=-
  SCN-specific regions: Sequence locations=1-411,449-592,634-812,834 -1271,1308-1438
atggctaatttcctaaaagcaaattgtgtgattgaatttaccgttgcacgcagaaaaaagtcaatgaccgaaaggtatgtaaatattcagcggctttaatgcaatatcaatgaaaaatgggcccaaatcgcgtggtgataaatgtttcagcccaattccaatagggcaataattggtgcaattcgacgggtcctttggtacacactttggccagcacgggggcatcaccgaatcgaagttcggatcaacgacaatggacaggtaagagagcagttcgcggtgtttagcgcccgagttgaaaacgaattcgatcagtgccattagttccacgtaccgtcgggcaccgccctcgccaccgtaattagtccgaacggaacggaaaagaatttagagacgaaagccatgggaattggaattgaaagtttggaaaaaatgaattcaatttaaacatttgttttttcttgatcattttttgaatacccatgtgatttatttctattcacctgcaaaatgctcattaaaagtgcagcaaatttctccgcttcggtggataacattttttgtgctttatcactaagtcctggcgaaactgtaaaaataatatttttgtttttaattaaatttaaattttttcacttgcccatatgagcaaaaataattgtccgcagaacaacaaattcaacagtgttcattttttaagttgaaattagagttgagcggtaatcggtaattgtaaaaaaaccggtaccggtactgaccggtactgcaaaaaccggtaccggtaccggtaccataattttccaacgtaaaaatttttggacaaaattttccaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaagggatcagcggccaattttccaattttgcgaaggggtctccggccatgtaaattaatgtaaatcaatgacctttttttgctttcaacaccgctttttacgcggcacgtttttctcaagacttttgggggacaaggagggccggcggtgccgataggcgccgccgggaaaaattttgtaatttttaatgcgatttgttaacagaatttgtaaaaaaatgaccaattgattaagttttgggtttttaggatgcttaacatgaaagaaaaaagttggaatattttttaaaattaatattttaattaaaataatggtaaagaaaatgtgaggaatattctatccaagtggggaaattgaccccaggcgaaaaattatgaaaggtagaaagttaaaccactacaccacatgtgcatgtgtgtaaatccatgactaaatgaaataaa

SEQ ID NO: 61092 - DNA, 963 bp, Heterodera glycines
  Genomic contig location: Contig_ID=SeqID_30687; Location=280..1242; Strand=-
  SCN-specific regions: Sequence locations=1-119,142-326,349-389,411 -723,745-786,811-932
  Gene Ontology: Mol. function=plus-end-directed kinesin ATPase activity; Cellular component=plus-end kinesin complex; Biological process=organelle organization and biogenesis
atgagtggcgccggtggcgaagggcaggcggacggagtgacgcaaaatgcgtttgcgcacatttttgaccacatcgccaaatgccaccaggacaaacggtcagtcagtttttaagtttgttataattattttactaaaattggctgtctattttatttttttctgcctcattggcattaattattggccataaatgcccagaagaagacatattttggcaattgtttagattaggggtcgacaaaaagtcaatttgagggtcaaagaaattgaagtttttcgttgataaagagaggaaggaccctttaattttgcaaagaagaaagttttttgagaaaaacaaaaatgaccaaaagtaattgcatattcatgaccaaaacaaccttatcattatcttcaatcactcccccctttaattatcaccaaaaaacttgtctgccagatttttcattgattaaatcctcttgtcattttttgttagcttcttggtccgcatctcctacatggagatttacaacgaggaggtgcgcgatttgttggccaagcaaagcgccgcaggcgcacaacggctggacatcaaagagagggccgacattggcgtttatgtgcgcgatttgctgaacgtgacggtggccagcgcggagcagtgcctacgcatcatgcaactcggcaacgccaacagtcagaatattcaaaaataattatatttttggacatctttttgggcaaatgttttagttttttgggttatttcactcgaatcaattggcaatttaatgcatatacaaatttttatttattttttaaataggtacgtatttttgtaaaaggttttgataaagtgtcatctgcgcccatgtcctaaatatagtttctaattaatctaaatagcttgaaaaacttaagaaataacatcttttgacacattagtgaaattaatttaaaaaattcattaaaaataaa

SEQ ID NO: 61093 - DNA, 660 bp, Heterodera glycines
  Genomic contig location: Contig_ID=SeqID_30688; Location=1018..1677; Strand=-
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 61094 - DNA, 766 bp, Heterodera glycines
  Genomic contig location: Contig_ID=SeqID_30690; Location=449..1214; Strand=-
  SCN-specific regions: Sequence locations=1-200,222-766
  Gene Ontology: Cellular component=mitochondrion
atggtaaatttcaattacgagtggctaaatcctcctcttggcgttcttggtctacctcttccaatacttccgatttcctatttgtcttttatttcgttcactcttattcattttggtattttcataattaattataacaaaccaaaaaaagaattattttttagcatcttcgcaacgcaaagaaattgagaaacatcttgaacaaggaaaacattggctgtctaagggacaattccaagaagcacttcaggtgttttttagacgatatgttattttaaacttccttttctagcattatcatcaagcagttgctttggatccaaccgattatcaaatttattatcgcagggcgaccgtttttttggcaagtgggaaagtgaacgcggctttgcccgacttggacaaagttgttgaactcaagcctgattttgtagcggtaattgaaaaaaggaataattaatctttttttcttattaagggtcgaattcagagagcaaatttattgttcaagaaaggaaatctaaaagaggctcaagcggattttgaaattgctgtgaatttcctttttttctgtttatttagttttcattgactaactttctttaagcttggacatgagcctgacaatgctgaaactcatgaacggctgcaaaaaatcaatcacatacagacattgatcgaccatgggctacgccactttgacagcagagactatgtctcggcagagcaaatgttcaacgacgcaattgaggtctcgaaaatataa

SEQ ID NO: 61095 - DNA, 332 bp, Heterodera glycines
  Genomic contig location: Contig_ID=SeqID_30691; Location=1255..1586; Strand=-
  SCN-specific regions: Sequence locations=1-12,34-52,79-146,168 -279,319-332
atggctgtggggcggcagctgctactgctgcgtctgcgcccgctcaggtgaattttttcgaaaacaaaccaaaaatctaagcaaattatgtatttttgaggcggctgcagcgattggagcggcggtgggggcgccaactgaagtcgaaacaaaaatcatttccaaaaaattaactccccaatattttaaggcaattggcgccgttgccgccggagttgcaacggcaagtgccgttggtgcagttgtggatgaggtaaaaaaatccatgggttccgtgtgaatttaaaattgaaaaatattttttattatataaattttgatttttcaggtag

SEQ ID NO: 61096 - DNA, 906 bp, Heterodera glycines
  misc_feature (144)..(144): n is a, c, g, or t
  Genomic contig location: Contig_ID=SeqID_6308; Location=288..1193; Strand=+
  SCN-specific regions: Sequence locations=1-436,459-712,734-906
atggtcgctgcgaggttccgagtttcaacagggaaatttacaaacggcagagccaaacggtaagatttgacaaagcaataaaaatatggacttttgtttcctgagaatcttaaaaatcaattagtcacctaaagttcaagtacncattattacccccccccccctcccacctcatctttacagtgccatttcatttccagggagtcatccgtcgtttctatgcgcggcattggctgacaagcccaacttgtatataatcccactaattcctccgtcgaagaaagagaacgcctcatctccccgctgtgcgcctatccgttcaactttggcaagcaaagcgcgtttcatccaaacgcacccctgcggtgatttcatttttatcggcgccgaaaacaaattgctaatttgggaggtattttaacccaagcgaaattgattttcatttttcacttatttcattttcagatccattctggccaattgctttcccaggtcgaggcacatttgcgagatataagcgcaatgcgaatttcttcgtgtggccatttcttggtgaccgcctcattggacggagatgcgaaggtcttcatgacggccaagtaggaatttatacatttttttcatatgttaatatttctctccagggatttataaatccccgagaaactaatctttcatttgatgtcaaaaatgtatggttcgactaaataagaaaaaattatgacctaagaaactgaagatgcgtctaaaatcgattttacagagaaaaaaattcttcgtaaaattttctgggttttccttggaattttaaaaagattgcgaaacaaaagggtgcccccttttgtttttgaaattcaaaatcggccacttttcatatagcgccaaaaaaccttcgagaattagaaa

SEQ ID NO: 61097 - DNA, 439 bp, Heterodera glycines
  Genomic contig location: Contig_ID=SeqID_6308; Location=3149..3587; Strand=-
  SCN-specific regions: Sequence locations=1-439
cgcaaaacgtactttgtgtttatgacttatggatttgaatcgcccggagaacgtctcgtatggattctgcttgagaatgtttaggatttttcattttctccgcttaatcgcttccatgacagaatgaacgcagtgttagcgcgacggacgaagtgccgagtttggaattggcagttgccaccaaatatgtgcatggtgggcacttcatttggcacatacgcctcatcggatttttcaggaaaaaatcaaaactcggacaccttgttgcagttgcgctcgcttattgccaacagacggcggacgcctcacgcgggcgttggtttttggcgttgggccatcacaatgattgcgggtgtgtctgagattgtcatacatttcttctaattgccaattgtcttgccaaatactgatgcgcattactggatctaattcgcgactt

SEQ ID NO: 61098 - DNA, 2292 bp, Heterodera glycines
  Genomic contig location: Contig_ID=SeqID_6309; Location=1018..3309; Strand=-
  SCN-specific regions: Sequence locations=1-271,293-453,475-535,557 -969,991-1036,1059-1347,1369-2292
atggtcgacattttggaagtgttggcacactcggaaaagcctttggaaaatgacattctgttcctcttcaatgctggtgagtttttggtataaaattttgaatcagcaaaatgggaaaaagttctccttgtaaggaatttacattttcagctgaagaaaatttcctgcaggcgtcgcatggttttataacggaccacccttggcgccactcaattcgggcattcattaacctcgagggctgcggggcaggtggccgagaattggtgtttcaggttcagaaataccacccgaggacagccggatgggaaagaccattttattactccaaataaaaacatcgtaatatttcccccctcccccttcagactggtcccggtgaatcttggttgatcaaaacttatcttgacaacgctccgtacccgcactgcagtgtgatgggccaagaaatatttcagcttggagtgattccatctgacacggactttcgcgtttttcgtgactatggccgaatatcgggttttttctcaggaatttgtaatttattttttattttttagggttcgacatcgcttacattcgaaacgggtgggtgtaccacactgagttcgaccaaccacagcggatcgaaccgggcgccattcaacgttctggcgacaatgtgttggccctggccaaggcactgatacgctcaccctatctcaaacagcccgccgacttcaacgagggcagcaattgggtgttcttcgacgtggtcggcctgttcaccgtatttttcagcatgcatataggtaggattcgaccaagcaaaacggacttaccgcagttatccatctgttttagctgtttttctgcactattccgtctgtttggtcgtcgcttttttggtctggcgtcgtcttcagcacggcacttacacaattggtggacttatggttgctttctttgccactttctccctccacttacgctttcctgctgcattgtcaggctgctttttggcaccagcttctcgcccttttcgctatggttgccgtcggtgctttcgttgtttgtgtgctcagcgtgttcaatctgaccatgtcttggtacgcgttgcccgagttggttttccccctttatattctgcccatgctgaccgcgtccattgctgtgcacaacgcaatggcacaacgtgcgaggcgcaaagtgcgttttttattgcccaattcaaaattgcctttccattgctcgtccccttaagggtgctcacatggcttcgttggagagggtccattacgacttcaccgtcatccaatgggcattggtgctgctgcttctcacctggctgggcaccgccagctccttcctgttcttcatccatgtctttttccctcttcttcgggaccctctcgtctctttgatgacatcggttggccttttcaaaggtctctttcaactttttttttcatttttgctttatctcttttttaaagccttttccccacgcgctcttctgactgctcaaattgtatgtttgactccgatcattgccatgtgcagtagtcacacacaaatgctgttcaactttttcgtcccaacaatgggccgacttgggaacggaattaaccccgaacttgtgattttaaagggccatgaatagggaaatgtaattggaattcaggttatgatggccttttctttgctcgtcgctttcacttttgttttgtttacggttggtctttgtttttagcattaaatttgtttgtctcttcttcatgggatacccaacaatttgccctcgtttcagaacaatttggtttacatgagtcgccgattgaatttcatgatcaaatgcatgaccgctgtttttgcattcgcttttctggtcgttgccactacgagtgttggagtaccttataaattttcggaagatgagccacgcattcgccgactaattgctttggtctgtgtcggatttggtcaattaaatgccattgttctcatttagcatgccacaagacgaatttataattttgacaaaaaaattgttgaaaatcgaatttcatcgttaaattctaccgattctggtctttttgttcaaactcttgactatcgtggtccggacgatcttccagaacatacgtttttgcaaggtaaaagtgcataaaattgaaaaaaagttacgccgttcatttttaaggtgctggtcagccggactgctcacacacttcggatgagtattgtcagctcccttactacaccgctatccacgaactattccctccagagtatgtcgaggagtactttttgtaa

SEQ ID NO: 61099 - DNA, 863 bp, Heterodera glycines
  Genomic contig location: Contig_ID=SeqID_30693; Location=273..1135; Strand=-
  SCN-specific regions: Sequence locations=1-431,453-863
atggatcttcccaatggacagcaagacttgcaagcatccacaagcaaaagcagcgaacatttgctggaaaaatttactatcagcgcaattatcgaggctcatcagccaaacgatgccaaatgtgtcgcggaaatgccggatggcaatttggtcactggcggaagggacggactaatgaaaatttggagaaaacggttctttttaattttgccatgttaatattaatatgcaattatttttacccaaatttcataattgggattggtcacttttacaacttatccaactttttgaatccctaatctaaatttgaaaatcgaactcgaaaaaagaatttcgactttttgtttaaatacgagtttgggattgatcgaaattgatatcagattctgatcagcgattctgaaaacaacagggaacaagttttcatctattactacaaaaaattaaaaagcctaaaggtccctctttggtttttttgggaatcccaactgtaagcatcgggggtcttaaatctgtaaatgccggaaattaatttgacttcgatatttttttaattgtttcccatccctaattcagtgacatttacgagaattgcgaaacgattccccaaaaggattgcctctcgataaattctgtcgctgttgccgccaaatccgtcaaaggttttctcgtatttgtcggtcggaaggatggctcaattgcaattttttcgccatcaaacgcattcaaagaaccgctgaaagtgctgcagggacacaaatcgaatggtaattacttttccaatttcctattgactttatttttcagtctgtacacttctttatgacgaaaacacgggccttctcatgagcggttcatgg

SEQ ID NO: 61100 - DNA, 905 bp, Heterodera glycines
  Genomic contig location: Contig_ID=SeqID_30695; Location=157..1061; Strand=+
  SCN-specific regions: Sequence locations=1-427,451-728,750-905
atgacttcacgaattttggttattggttcaacaaacattgatgatgctgaggcgcataatatggtttttgacatgtctatttttggcaaatgtgttgaaaccaatcttcccatattctcggaacgtgttcaattagtcaggtaattggcattttgagtttggcatttattttttctacctctacaggaagtacgcattggtaaaggagatctacctcacggaaaatgatgagaaagaacttgctcacgacacaaattctctttctggattaagtaagcaatcctttttattaaaatctgcttctattattcagtttataccgcaaaaaatatattttgaactttatcgaaattaacatttataactctaaatcgtcaaaatggtttatttgttagatttttcgagtaaaattttatggatttagtagcttttttaaatcctgttttgaaacttgaaattgattctgattcgtaatgcaatattctgaatacgtgaactttatatgaaaaaatattttttgccttttactgcatatgagcattaatttgaagagctcgagactacttgtgcgcgttaatattggttccagatttccctcaaatttaggtttgcacgaggcatgccactctgcagtttcaatttgttcatcttcacaacttacatacgtttcagcgcttccttcattagggagattaggacacgtacgctataaatgtttatgtttttgttaattttattgccttcttaggtaatggcgttgccggacattgaaaagaagactgtgaggaaaattgatgtcttgaatgaaattgactatctattagcggggtatattggagaagaattgtttcttgaaaataaggaacgagtaacaaccggttgcagcaatgacctccagagggcga

SEQ ID NO: 61101 - DNA, 873 bp, Heterodera glycines
  Genomic contig location: Contig_ID=SeqID_30696; Location=49..921; Strand=-
  SCN-specific regions: Sequence locations=1-609,631-645,668-873
atggaccccaatcagcttaaactgattttggaggctgttttgaaggcatcagcggaacaaaacaacagttctgctgcattggcgacatcaatcgatgcgcgcctttcgacatttgagtatgaccctgagttagggcatacatacgacgtttggctcaagcgctatgggcagaccatcgcccaggatggacaagcactcagcggccagtcaaaagtccaactattgattggcaaattgggcgaagcggagtacaagcggtactgcgacagcatcgcaccaaagacgcagaacgacttcaattgggatgagacgaccgcaaaattaaaaaaattgtttggagaaacccgatcattgtttctccgtcgttttgattgtttccaaattcgtcaagaagcgcaacaggacgttccaagtttgattgcacaaatcaactcgtcctgcgaaaacgcagatctttcgctgagcaaagaggagctcaaatgcatgattctcatcattgcattgcgcgacgaattcaccgatctgaggcaaaaatgccttcagcgtttggaagacagtcgaacgagcggacggtcaacctcactgcaagagctaggagaagagtgccgcaaataccaaattctaaaggaaagcgcgctctccctcggctcaaatccctgcagcaccagtgccatccgagccaaaccgcagcagatcaaggacaagcagaagcccaaaacgaagccgcagcaaagccacaaaggccaaaatttcctgccgaaaaattcaacggcacctaaaggaaaagtggaccaacgtgatcagccctgctattcatgcggaggcaaaagtcactggcaaaaagactggtggtttcaaaaactcgacgtgtga

SEQ ID NO: 61102 - DNA, 742 bp, Heterodera glycines
  Genomic contig location: Contig_ID=SeqID_30698; Location=116..857; Strand=-
  SCN-specific regions: Sequence locations=1-161,197-742
caaattcagaccgcttcttgcactgtgctcaatccggcgatggcccgttgcaacatcccgaaaatttacgactggggcaccaaaactgtgtatttccaaccgcaaagtcagggcgcaaatgacgaaagagcattcgttggatacatttatttcggcatgcgaatttaatttaaatttaattgaaatttcaatatttcgtacagtgcctccaacgttggacccaatgcgattggacatcggcaacatttacgactggtacaaaaacccgatgccataccaggtaggctatactgttggtcaagggaaacgataaaatcagtcgtataccgtataaaaaacaaaactcatccatatactgtactggatttaacaaccaactcttattctaataccatatcgagtagacaaaatagcgtaataaaacttaacaccgccgactcagtctgataccgtactaacaactaacttcattctattaccgtataaacttgacaaatccttgtcaaaataccgtataaaacttatgtaatactctcagtctgataccgtatttcactgcactgaatgaatttaatggcaatgtttttgaggtgatgccgatcacttggtacccgcgcaacttcaccaaccccgacctgaactacatggaccagacatggcacatcagtgacgacgcgctctacggagtgcagcttggactgtacgtgatcggctacaaggaggccaaagatgaccaggtgtt

SEQ ID NO: 61103 - DNA, 89 bp, Heterodera glycines
  Genomic contig location: Contig_ID=SeqID_30700; Location=1..89; Strand=+
  SCN-specific regions: Sequence locations=1-24,51-89
aactttttggcctgtttaaaaaggaattaaaaatttttaaaaattttattcatctccctttttgatagaaaaagcatcagagtgcctaa

SEQ ID NO: 61104 - DNA, 348 bp, Heterodera glycines
  Genomic contig location: Contig_ID=SeqID_6310; Location=762..1109; Strand=+
  SCN-specific regions: Sequence locations=1-348
atggcccttaagaaatgggccgcaaatgtccaggacgcaaatgtcgggacgcaaatgtcgggccgcaaatgtccgaatttggctggagccgcaaatgtccgagccgcaaaagcaggggtaaccgctggggatgcatatttgattgaattaagaatttaatggctcaaattttcagattctcgtgagtacatcgactgcgaaagcggcgatctgaagacactcgaaggcgcatttcaccaacttaggacggagatggaaaacgttgcgttcatcgactttgatacaccgaaatgaacgaattcccattcgtgtgggcgtataagtgtgatcagttgcagcagaagacaa

SEQ ID NO: 61105 - DNA, 336 bp, Heterodera glycines
  Genomic contig location: Contig_ID=SeqID_6311; Location=127..462; Strand=+
  SCN-specific regions: Sequence locations=1-120,142-202,254-336
atggacacttttatggatattgaaaaagtgtcggaatttgcgagggaaattattattaatgaacgtgtaaatgaatctgtcacttatataaagggattgccatggaaaatatgggcacaaataaataagaaaatgaaagcactgacaataatgagaaatgtttggccattttcctttattgtgcggctccaaaagagggtgcaaattaatgttaattgataatatttaataatattatttttagatataaattggaattgcaaatgttcggcaactcttcgaattgtgtcgcaaaagagcgaagtggcggatttcaagaaagaattcagggaagaa

SEQ ID NO: 61106 - DNA, 1446 bp, Heterodera glycines
  Genomic contig location: Contig_ID=SeqID_6312; Location=1577..3022; Strand=+
  SCN-specific regions: Sequence locations=1-438,468-515,537-540,564 -845,867-877,900-1281,1304-1346,1376-1446
atggagactggtagattattttgcaacctcctcagaaaggggtacataattggagaccggcagtttaatggagactggcacataaaaagagcaaatacggtaagtcaatgacttttttttctgctgattcgaaatgccataaattatttaaaaatctacactttgtttaaagcttctaactattatgcatttttttttctacttttaagaatttttttgcaactttttgattttttcgtaaatttttagttgacttttgatgttttttcgcatttaaatttctatccctacttttcgttccggcctaaaaatacacagcacagttaccagaattggtcgtccaaatttgaccttttttccgagttcgggttacgcatggggtcaaaatgggtctaaatggatgacggatttatgatcagtggccttgaaaacctatgcatttttaatttaaattaaaatgaaaaattgttttgagttaaactgcataagagctgccaaatcgaaaaaagagagtgaagaaatgagaatgaataaattggtactttactgttatgtgactaaagccaaatttcaaaaaatcaacaaaagggcgcgcaaaattcacacgataagctgatccatttgataaactttatcagcgatttttacattttttcctcccaagtgatgctgctgtctgctgtgcgattttcgcgcccttttgttgattttttaatttcgagttgtgaaagtccgggctttttgtttatgatggaaaatctctttgctgatgaaatgctataaggaatcactcggaaaaacaaagtcaattatataaaaaagcttagaatttgcggatattataaagcaaaattatattaaatttacgcctaattcctcccttttaccttttgggaaaacgagcaaaatttcaaaaagaatgaaaattaaattctatttatacctacttcgatggattatttttttaaatgacaggtctatgaccacgatgttaaccggcaaagggtcagccgtgcgcaattgcccgcggtgattgacgagatcatgaacgaagcaaatgaaggcgccagggcattcattttggcgaatttagagaatgtccgaaaggttaatatggggttaaacggtcgggaaggctcggtcaaaaagaattagtaactgtatcagccacgggtcgcagtcgcagtctttctgagaatttttactaaagttttttattttttgaattggcaatttgcgtccaggtcgacgctgttggtatcaactagagtagagcgggaccgggaccgggccgggaattcccggtcctcagaggtcccggtcccagattttgaaaagctcaggttccggtcccggtagggcaaccgggaaccgggaaaaacaagcactggtaagaatggggtctgagtgaaaaattagtgaagaaaattggagtcaacgggaaaa

SEQ ID NO: 61107 - DNA, 603 bp, Heterodera glycines
  Genomic contig location: Contig_ID=SeqID_30705; Location=118..720; Strand=-
  SCN-specific regions: Sequence locations=1-87,120-231,262-603
atgctcgaaaagttgttcaaagaccaagacaaggggacggtgttcatctcccagaaaaacactgtccaaacggcgtaagttttcatattttattttgtttttaaataaatgttttgccagcaaaacatttgtcgacttttacaagcagtcaatgcgaaatggggaagagggaattgtggtcaaagcgttcaattcgctctatcgcccgggaagccgagcagaacgaaacggttggaagggaaggggtgggggaagtgagtattcggtttattattttgcatttttaaaggatggttcaaaataaaacccgactacggcgttcagtcggccctcgacttggcccttgtcggaattcgctatgagaacaacgtgttcagtcatatcaaatcgtttttggtcgccgctcgtctgcccggcccatccacaaatttccacttgaaaattgttgccggcataacttcacggctcaaagcattggactttaaacgactgaccgaattgctgggccccaaaaaggcgctgctgcacaaaatgccgacatggcttgagaggaacaacggtgccggaaagtatgacctatttgtgccaaaacataacatccaa

SEQ ID NO: 61108 - DNA, 756 bp, Heterodera glycines
  Genomic contig location: Contig_ID=SeqID_6313; Location=965..1720; Strand=-
  SCN-specific regions: Sequence locations=1-230,252-294,316-527,564-756
atgcttttttcgttttttctattccaattttattctgttgtctactcaatagcgtcaaagagaagtcctgaaccatggggggatacactgaaatcgattgacgacaatgccagagatttcaaatggcctgaccgacacgaaaagggtacatgggcagcagtcgccgcaaccggggaaggctccagggctagagctgaaaccggtgtcaaccgagaggaaggcagtggtatggaggaggaggaggaggaggacagccatattgtaagagcggaagcgttgagtgaacgtgaaggcggtgttgcagttgctgcagccaacaaagggcaaacccaaaagacgagtgatgataataatgatgatcgtgatggcgcgcaccagcaagtcgtcgtaatggcacgtggaggtgaagacgcccgtgcaaaagctgaagcaagcggaggtccaagaagtgtcgttgaaacacgaattagtgataaccaacgagggggagaaagattagctttgggttcggccattattcatagacaaggaagaagaagaggaggaggaggaggagtaggaggtcgaaacagaaaccgtcagagaggcaaagaagaacagggcgaggacgaagacctattgccaacgataatttcacccccgccccccgcatatatggagctaaacaatcgtcagaaaggaaatgagcaagtcacactccacaacaatgtgcacacaatgagccctgtcagttacccatatttgttgaggaatcaa

SEQ ID NO: 61109 - DNA, 1609 bp, Heterodera glycines
  Genomic contig location: Contig_ID=SeqID_6314; Location=3091..4699; Strand=+
  SCN-specific regions: Sequence locations=1-657,679-733,755-843,865 -1057,1079-1277,1299-1609
  Gene Ontology: Mol. function=aldo-keto reductase activity; Cellular component=cytoplasm; Biological process=xenobiotic metabolism
catggtccgggaacttcgatttaacgatttcctataagcgaagttatacacagaatgagttccgcttcttcacctgtgccttcacttatccttaactcgggcttcccaatgtctcaaattgggtttggcacttggatgtgcaaaccaacagaggtcaacgaaattgttaaaagtgccattcgtaatggatatcggcatttggattgtgcattcatttatcaaaatcaatcggagattggcgcagctctcaaagacatgctccaacacggagagattaaggtgggggggggagacaaattcaaatctaattctcgcgaatttactaaaaacgcgtttagcgcgaggatttgttcatcaccagcaaagtttggaacacttttcacagctttgacgccgcattggcaaatgtccacaaaagcttagaacagctcgggcttgagtcagtgtgctgttgttcaactgctgatccgttctgttttgttccttcgtttttagttatttggacctttgtcttatccattggcccatgggttacaaagaggggaccgaactcttcccaaaggacgcggagggacagaaagtgtttttgtcggacgtggactttttggacacgtggcgggcgttggaaaaggcggtggcccttggcagagttcggtccatcggcgtgtccaatttcaactctgcccaaattcaacggatcatcgacaattgcaacatcagaccaagcgttttacaggcaaaataaaaaagaaacagccaaagacagactttgttggaaaatgttggcacatttcagacggaatgtcacgtgttcttccagcagaaaaagttgcgcactttctgcaaaaacaatggcattcatttcgtcgcttcgtgccccctgggctcgagtgccgacaatgctttccgcaagtcggaatacccttctgtttttgaacatccgaccatttctgagattgcttctctccttcaaaaggtaggcacagacagaaaatgaaaaactgtcaaattgtttattgttagttgactttagagcccggaattttgcaattgccgggaagagaattggaaaaagaaaggggtgagatccccggaactttaatgaaatttgttaagaaaattgaggaaagatttcaactattgtaagattcatgacagaatggttttgaattatgccatgctgcaatattttttagtcccggtccaaattgccggtaccgagacttgaaaaatgggcctggacggggccccgggactcccggccctgtgttttgtccaaagaccgggaccgggagttccggcgggatcccggttctatccgggctctatttaatttttagccattaacaaataaatgcacttatttccaagatttttgtaagacaaaaacgcaatattacattacttttcaaataaagagctgttttagtcaaatgcccaagttgcgctgcgtttcttaacccaatttggcgtcgttgtcgtgccgcgttcgtccgatgcgcagagacaacgccaaaatttggacattttcggattttcgctaaacgaccaacaaatggcgcaaattgaggcgttagacacgggcaaacgcattttgtattgactgtca

SEQ ID NO: 61110 - DNA, 728 bp, Heterodera glycines
  Genomic contig location: Contig_ID=SeqID_30715; Location=394..1121; Strand=+
  SCN-specific regions: Sequence locations=1-126,149-305,328-375,407 -408,434-495,517-648,670-728
atgaaacttgattatttatctcaaagcaaaaaaaggatggtgcttaattttttgttttccttgaccgggttattgtttcaattgtctagagtttttaaggtattcctgcaattaagagttttttttatttaaaatgcatatcattatgtatttattaacttttattttttctctgttttatatcaatccaacttcatttattatattagttttattttatggcaaccaatccaatgtaatttgtatactttggcaggctatggaataatttcttatttagcgttttcaaatattaaactataagtcaattgctctgatgtccgtgcactcgacaaatgcttaataacttttatggaattgaattaattgattgatttttcatttttggtttcatttttatttttatagtttaaaatatttaattaattatatagaatgttttattgctttaatatcaaggctaaaattgtttaacttatttgtatattctcatacgttggtttaaaattccaaattccgagcttaacaaaattgttttaataatttatcaatttatattagagaccggacgactggggtcggagggatccgagtcgggatcccgactgaatccaaattaaatttttgtttttatgcgattttaggttaacatcacagtattaaatcaaattgaatgaagtatgttaatagtcttaaatagaatagtaaattataaaccaattactaaa

SEQ ID NO: 61111 - DNA, 929 bp, Heterodera glycines
  Genomic contig location: Contig_ID=SeqID_30716; Location=32..960; Strand=+
  SCN-specific regions: Sequence locations=34-34,57-149,254-299,334 -380,430-449,476-514,647-666,747-803,848-855,877-929
atgttatttgtgcgatttcgctctgttttcggaccttatcgtgcgttttctgaattcctttctgcaaagtaagttttaatctctgagctgccgtttccaaccatatttggagtacatatttaaatttgaggttattttttttattgtagtcggacttgtctttatgacttccatgtgaaaaatggtgccaaaatggttgagttcgcagggttttcgatgcccattcagtacgatctttcggtcagtgcttcgggtgagttggcgacctccccatttcatttccccgtactccccattcagtgcttcacacgcgatcgaatgtgagccttttcggttggtttactgtttctttagttgcttgtttctaatgaatttctttagatgtctctcatatgttacaggttggttggtttttgttgttattttttgatcttatttcccaatttttaagactgaaatcaccggtgcccataggtgattttgctttctttgaatgttttgatcacaaaaaaaatagggtgcaattcattgaatcactgacgccaactgatgtgacgaatttgccggagaacagtggagctttgagtgtttttacaaattcagagggagggataattgacgacctggtaatagaaattaattcaaagacaaagaaagtaactttcagataatttcaaaaacggcccacgaatcactttatttggtgacgaacgccggaaggattggaattgatttgccatatttggaagtgaaattcgccgccttttgctaattgaagtgttattaattaagcaaaaagcctccgaatggcgtggcaatgggaaggaaatccaagtgaatgtgttacaaaaaaaagcattggtcgcaattcaaggttattgcccgttctaacactaaaccccctcaaaactcaaaaggtcctgagacga

SEQ ID NO: 61112 - DNA, 168 bp, Heterodera glycines
  Genomic contig location: Contig_ID=SeqID_30717; Location=651..818; Strand=+
  SCN-specific regions: Sequence locations=1-127,149-168
atgggctacgggtcgcaagcagttcgcctcctgctcaacttttacggacggaggccgcggcatgtttcaacgacaacggcggcggcacaatgccaaaatggggaggacaaaaatggtggaaatgataaggaggaggatgaagagatgtcgagggtccaacttgtggat

SEQ ID NO: 61113 - DNA, 64 bp, Heterodera glycines
  Genomic contig location: Contig_ID=SeqID_30717; Location=581..644; Strand=-
  SCN-specific regions: Sequence locations=1-64
gaagtttgggtggacagcgacgcggacaatgcgcgcaccgcacagagttgggaattcgtcgtcc

SEQ ID NO: 61114 - DNA, 1263 bp, Heterodera glycines
  Genomic contig location: Contig_ID=SeqID_30720; Location=103..1365; Strand=+
  SCN-specific regions: Sequence locations=1-54,78-770,797-1053,1076 -1090,1114-1228,1250-1263
atgatctccgcgggacaaaatttatgcccgctcacagcaatgatcatagaaaacgaagaaaaagaaccagaaaaatattgggatttggaaatgattggggttaaagataatcccgtagaaaaagatgatgatgtgacactaaaaatgttccaagactcagtataccgaaaagatggacggtatgtggtaagttggccttggaaaggcccaaaagacgaattaccgactaattttgcattagcctatcgaagaatgatcggcataatcgaaaaattaaaaaagaccaacgaatttttaaaacattatgatgaaatatttaaagaacagataaaagaagcatagtcgaagaaaccgaaataaaaggatatgacgaacatttcttaccacatcactgtgtgctagttgcaggaaaaaagccacgagttgtatatgatgcgtcagcaagaataaaaggtcaaaaatcacttaatgacatgttattcagaggaccaatctatatgccagaattgcctggtaaaaaccaatttcaaagacaaatctttgcgcattcagatttaaacgagtaccatttggggtaatttcttccccgtttttactgggggcaacagttcgatatcatttagaaaatgaacaatcagagttggcaagagaagttaaacgaaacacatttgtggacaatatatttgtaggttgtcatgattttgatgaatcaatcgaaaaatataaaaatctaaaagtgttatttgaaaaggcacgaatgaacattagagaattcatctcaaattctgaaagagtaaataatgagatcccagaaaaggatcgtttagtaaaggaaaacccaaaagtacttggtataaattgggacattaaaaccgacacttaccaaattaaatttccaaatgttcatgaaacagaaaggataagcaggagaagtgttttaaaagagttaaactctgtttttgatccatgtggatggctatcaccttgtttattaccagctaaattattcttccaaagtctatgggaagaagacaggaaatgggatgataaaataggagaagaaaaacagaaagaatggaaatacattacaagtttatgggaaaataaatcaattaaatgcatacggagaatagtccctgacaaatttaacagagcagaattacatgtttttgtagacgcatcaaaagatgcatatgctgcttgtgtatatctaagaatcgaatcagaaaaaacacaaatcaatttattatatgcaagaagcag

SEQ ID NO: 61115 - DNA, 2589 bp, Heterodera glycines
  Genomic contig location: Contig_ID=SeqID_781; Location=2357..4945; Strand=-
  SCN-specific regions: Sequence locations=1-112,134-186,211-309,334 -447,477-677,702-843,864-989,1011-1017,1047-1367,1389-2425,2452 -2482,2504-2589
atgattgagaacgctttggatcaacagctgctctgctttgtggaaatgtgttttaatgtgttgaagggtcgtgttccgttagggaagcgacaaattcaacggttgggtgaactgaagcaccagttgaggagcttagcacgcgcgcgttgcgctaaaacagctcgcagggtgctattgctgaatcatcaacaacaacaacaacaacaacaaaccggtgctgggttcccaatggtagccagtatgttggccagtgttctcttaccagtgttgatggacaaatttttgccaaaaaaaaactaattgacggggaaataaataaataaatatataaaagcgaaacaacaggaacactcatatatttgaggagagcgcaaaaaaaatgcgtcacgcaatgcgaatgtttctcgtcccggaggacgtctttcagtcggtatttgttcaaccccaagcagcagcagcagcagcagcagcagcagacggtgccgacggcacaccaattgggcttttgcgctcgcgcatccaacaaattgagcgcagcagggagctgaacgaagagcagaaggccgcacaataccatcaggaattcaaacggctcaacaaactggtgcgcgagcaggaggagcagccgatcaatgttcgacttcagcacgaaaaggagagagaaaaaaatgcagcaacgccgccgccgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagcagaaacaccaaacagcagtggaaatggagaaacggaaaaagaagagggtgatgtagatgatggggaacagtgggacgacgcacaatcatcatcgtccacggcgtcaacaggtggtgccgcagcaaaaagagtgctcagagcaagagatggggaagcaggaaaaggaggaggaggaggaggaggagaaacggctgatcgccttcaaccaaaacacaactaccagatgaccaaaaatgcactgatcacacacattcgaaaaaaggggcacagtctgggagtcagtgatcagggaaaggttttgcgcgcagatgggtccgagtttaaaacgagcaacgtggaggcaattgtcagccatttgttgaacagggacaaacgaagcgaattcaaagggccgcctgtgggctacaaggaatttgctgaaaaggcaagagaggatccgttgctaaaaaagtatttgtttccggaacagcctctacaatttggcaaaggcctgactgactttaggcatggaaaaggacataaaaagaagtgcgaagggggaggagggaaaagtgtcttcaggttcaaaccgacactatggtgatagaccgaaagaaagaacagctgttggaccagctgtacaaagatgttaactcatcggtcagctttaccagcgttgagccgcttttgcgcgaggcgaaaaaggtgaacaatcaaatgagtagaaaggatgtagtggactatttggccacccaacgcacatacaccattcatagacaagcgaagaggcgctacaaacaactaccaacactcgcttctggactgcacaccgaatggcaagcagacctgtctgtctttgacaaattgtcgcgagagaatcacggctacaagtaccttcttgtctgcatcgacacactgagcagacagctctttgttgagccggtgaaaagcaaaaagagctccgacatggttgctgcttttgaacgcttgtttaaacgctccaaatacataccatggacattgttgaccgaccaagggctcgaatttaaggcaaaagaggttcaggaatatttcaaaaataagaacgtgaaaaacttttttatgtacacctcgccgcgaattcacgcagggatggcagagcgggccaaccgaaccatcaaagaacgcctttatcgctatttcacggaacggggtacccaaaaatgggttgatgtgatacagcaaattgtgcatggaataaaccactcgtacaactcaagcataaaaatgcgcccagttgatgtgaattttgagaatgccgaaaagctcaggaaaaaactcaagcagaacgctattggtgggacagcggaattaaagcggaaacaaccactaccacgtttccaggtgggtgaccgtgtgcgcattgagaagtacaaacacgtgttccaaaagggctacaccggacgcttcaccaacgaagtgttcactgttgccgaagtgcacactgaccgctttcccgtcacgtaccgaatacgtgatgacgatggttcactgattaagggtcgtttctatgccaacgatctctgtcgtgtgctagtgcgcaaaaatgatgatgatgatgatgatgatgataccctatatgacattgaaaaggtcgtccgaaagaggaaaaagcaaggtgttgaatacgttttggtgaaatggaaaggctacagtcaacggcacaacagctggattcctgcaagctcgatgacatggaaaaatatataa

SEQ ID NO: 61116 - DNA, 821 bp, Heterodera glycines
  Genomic contig location: Contig_ID=SeqID_781; Location=5875..6695; Strand=+
  SCN-specific regions: Sequence locations=1-54,86-141,188-223,245-821
atggacgcaattcttgcaaccgattggctccacaatgcgttcccagagcgaaagacaacaacaacaacaacaacaacaacaacaatttctagtgtgggagaagaattagacgatgccgtcaaagcagtgagttttacacaaaaataaatttaaaaaaataaaataaaaaaataaatgaataaataaaatcaaggacgagcaaatcagttggcttaaaattatcgaagaggaggaggagcgaggaaatgaattgcaaactggtgaaatggaagtggaacgagcgaaaggtttggttgtttacaagaaaaaaaatgaaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggttttttaatttaaatttatcagctcctcaattgtatagatgatatacattgtttttaggtccgtatttactactatgtgaagcatggcgtaaagctcgtttatcctcagcttccctgtgttcatcaatttggcggtggtgaccattgttctctgtttccgcttgagtgtctgagcgtcataaaagatgcttga

SEQ ID NO: 61117 - DNA, 2234 bp, Heterodera glycines
  Genomic contig location: Contig_ID=SeqID_782; Location=499..2732; Strand=-
  SCN-specific regions: Sequence locations=1-691,713-1458,1480 -1682,1720-2234
atggcacccgtaaatcaaagacatgaacaaaaggggcaaaaagaaggcgaaaatggaggagccgaacatgtaagtggggctgtaaatgccgcagtggtgctcctccaacagatagcgttcagtgtccgcgttgaagccaaacacaagcggaagagacagacacaagctgaacagccagcagaaggcgatcgccaggtacactcttcgaaggtgcgaagatcatcaattagcagcaggagaagggaggacatacctccgcctgtgtttgtgcgttttgtaatccgctggctttgtggccgccaccaatctgtgagttatggggggaagtgcactctgaccaaatcgaacagagcgatcaatcgccgaacctatccatgctgatcagcagcaaatgcacaatagaggacgtggaggcgagaacgtccaacacgcagtaaatgtagcaagtaaaaacgggcaaatgccaatgcagcgaatttatctgaagcccaaagagggggggggggggggggatgagtttgtgcctaaattgctcaccgtcatgtaaatatggaaaggggtgaccaaagtgccaaccatcaaatcggcacatgccaaactgagcaacaaataattggtcggtgtctgcagacttttgttggagaggacagccgccaccaccaaagtgttgccaataatgcacgaaattggcattgtgacaagcagcagccagaccctgaggcgagaaatggacatggttttcggcaaagccgtgggacattaatcgaccattgcggcttcagttcggcgtcaatgtcagcgaactgtgaggaatcaatgcgacggacgtgccgttgcagctgatgtacgggggaaaatgccatttggtgatccaacggatgagaaaaaggcgaaaaaaacaaactgacaaacatcgcagcatcactatgggaaatggcacgcataagagaggaggaagggacgatttgtggtggttaatgagccttaaaaggtttaataaagggataggacaggtgtcattttagcattaggaaacaattgtaagcacaacaaatgattgaatgatttaaatttaattggatcatcgcactaaaagatgttccctcgagagtcaattcaatgaaaaatgtgaaatttttacatttttagaccaatttggatgtgtgggaagaatgaatgggcaacaaacagtcaggggctaagaaggaaaagcctcccccctccccccggggtgaagacgaacaaatttacattgcccgtccgtccgcctcaaccaattccaatgcgttgagagttgggaatggcctttttgggtacgccaaattcaattgaatttcgatgggatttgccacaatgcgaaagtcggccggaaatgttgaggaatttccgccttttgctgcagctaatgagttacaaaagattgaaccataccaaaggacgaccaaagaacatcaaaatgggagtagataatattcccaatcaaattatcgattgattttcgatcgataatttgagtgtgtctactttttttctctgacatccccttccacaaacccaaacctattggatggtctcctcgagagagagagagagagagtacattgacccccccccccccccatacctattggatgatctttgatcccttcaacccaaacctattggatggacttgtgcgcgagaatttaattaatttaaattttaattaataatttaaatgagcgagagctgcgcgactatttccgaaaaattgtgaaaaatcaaaaacatggtagtggactcgaaccgttgagagtggaagcgaggagcttaaccacttggccacaggggcagttgaaaggtatgggataattgttgactttatgatgaaaattccgaaaaatcgtgaaaaatcaaaaacatggtagtggactcgaaccgttgagagtggaagcgaggagcttaaccacttggccacagggtgagttgaaaggaactggataattgttgactaaatggtgaaaaattttcccctttgcttcaccacaagcgctgcggaggcgggcgtgtggcggtgagagagtgatggtggacgcctctgtttcgatttttcaattaattgattatatgcgcagccctttaccgttgattaaggatatttaagctccttaacattgcctttttctctttttctcattttttcaattttgttaaattttcatcagcaacaaacatccttctcattttataataaa

SEQ ID NO: 61118 - DNA, 769 bp, Heterodera glycines
  Genomic contig location: Contig_ID=SeqID_782; Location=2018..2786; Strand=+
  SCN-specific regions: Sequence locations=1-3,25-769
  Gene Ontology: Mol. function=electron transporter activity; Cellular component=integral to membrane; Biological process=synaptic transmission
ggtctggctgctgcttgtcacaatgccaatttcgtgcattattggcaacactttggtggtggcggctgtcctctccaacaaaagtctgcagacaccgaccaattatttgttgctcagtttggcatgtgccgatttgatggttggcactttggtcacccctttccatatttacatgacggtgagcaatttaggcacaaactcatccccccccccccccccctctttgggcttcagataaattcgctgcattggcatttgcccgtttttacttgctacatttactgcgtgttggacgttctcgcctccacgtcctctattgtgcatttgctgctgatcagcatggataggttcggcgattgatcgctctgttcgatttggtcagagtgcacttccccccataactcacagattggtggcggccacaaagccagcggattacaaaacgcacaaacacaggcggaggtatgtcctcccttctcctgctgctaattgatgatcttcgcaccttcgaagagtgtacctggcgatcgccttctgctggctgttcagcttgtgtctgtctcttccgcttgtgtttggcttcaacgcggacactgaacgctatctgttggaggagcaccactgcggcatttacagccccacttacatgttcggctcctccattttcgccttctttttgccccttttgttcatgtctttgatttacgggtgccattattccaactcaataatccttctgatcagctcacttttagttacatttttttca

SEQ ID NO: 61119 - DNA, 486 bp, Heterodera glycines
  Genomic contig location: Contig_ID=SeqID_783; Location=3041..3526; Strand=-
  SCN-specific regions: Sequence locations=1-486
tatgtacgacagtccttcttacggtagcggatattcgccctcatattatggtactaactttttgtgacgaaattaacaacacggagtttaggtggctattatgggaggaatggtggcctagggtatggtggaatgtacccgggctacggtggctattcgactgcgtcctactacggcggttggccctatacggctgggtacggtgctcagaacggatacagtaagacaatgccaattttggtgaattaaaagcacaacccccactggtgcagcagctaattgtaagaaataagttgggaaaggaagaaactgagcacaaataatgggatggacaaaggcaaacgcgggactgatcagcgaaattaagcatcgccgtggagataagcagaagaattgcgagggatttgcgaagggaccgatcagaaaggacggaaatggcaaactctctcataacaatggcataaatgataaaaaaaatatgaagca

SEQ ID NO: 61120 - DNA, 2991 bp, Heterodera glycines
  Genomic contig location: Contig_ID=SeqID_783; Location=1..2991; Strand=+
  SCN-specific regions: Sequence locations=1-563,593-740,762-874,896 -911,933-1035,1149-1153,1176-1365,1401-1621,1643-1697,1719-2337,2500 -2599,2621-2991
ccggagggcaatttctcgggtttggggccgatttgggtaacatcgccacctcagcgatggagacagtgatcggcaagtggcggtcgctggtcaagcaaaccaatcgaagattgttttagggatcgatcagaaaaaccgtaatatgatcacatgggagaaaccgctgttgaagaaaatcgaggagacggctgccgaacacgcgagttcgcttaacgaaagcgagcgggagcaagtccgttccaacgcaatttatgggacagggggggggggatccaatcacttcaccgaatcatttgatcaattcgattaccactttctgatcacatatcatttttcattccgttttggttttttcatctgatcatccgataattcttcgcttttttgcttggtcatctcactgcccccgccccatccgttcagcttcaaaacattctccaagtcacgagttcgtccgcagcttctcagacaagcgtttacgaatgcttcgatgacaaattaaagcggcgattgtgtgtttcgaattgggcagaaaaagcatatgtcagcagcgacattctgttagaggagagggaggagatcagtcaggccccgccctcctcggtgattttggacgccgtcacgactttggacccaagtttcggcaaggactcggccataagtggtaaggccggaaaaaagctcccgtaagcctcttagcatttagtgcttttctcataaatgggcatttaattccgcggcattttcctttttaattgactattttgataacgaacagcaaatgttgccaatcaaaagcccaatcagcaacaaaagatgatgggcatgaacatgttggaagtgcccaaaatgaacgcagcggcgagacgaaggcattccgaaaacggacaaagacgggtctcagtgatcagtggcagtgccaatttggtggtggacgcgcgggaaagggagaagcaacaccgacgcttttcactacaaccgcccagggacaacgaaaacgaagagaatttgttgaaagtgccgaacagaattgtaagggaaagggagagaaaaaaatagggagggggtagggagagagagacaaggggagagagacagagagggggaaaagagagaccggggagagagagagagagagaaaggagagatgccacagagggaggaagaaaaagggatagagataatccggcgatttggaatcccttctcttcaaaaatgcagttaaaaatattaagcaaaaaggtattttcaacaattagcttccctcccgccattccttaccaaaagcgatcagattccatttttaattccttcgcggggagcgcaacaaaactttggagtgaattgacaaatgaatattcataaaatcattttaaacaaaacaaaactttaaaataatgaatggattaagcagtgattcctcccttttgtggactttttctttaacaataataaatgatcaaataataatgctttttggcaggggagtaaaaagtccatgcggagactgtccgagctgatctccggctgggaacggccctcgcgctcttcccttggccaactgctcacttttgctcgcagagactccgtttatatagcgcggaaaaagttggcagggctcaaagattgggcattgggtgagttcggtttggtcggaagcgatcgatcggaagggaatttggacagaatttccactgataaaactttgtttcttaagacctgattgccaagctaaagtctaaacaggtaggcaatgagcccaaattctttcgatcgctctccttccctttttagggattggccattcgaagagaggcgagggctaccaaattggtcgctaccgtaatgggtagacactgtgcattttgtcgtgctctaacattccgttaagccgtttttcttatctgctgggccccctatttttcgatgaacttgtacaaaatttacaaattgtacaacgaccaatggtcgcatcagtccgaattcactttccattggctcagtgcgttgggttacctcaattcgtccctcaatttcttcatttattccgcaattaacaaggtgatggatgggtgggtgcctcggcgactctttcggcaatttttcgactttaagaaatttcgtatcactttttggcgattgctcggcctcaggcgaagccaacgcaagaaaaaggcatggcttcttccgccagcacagcacaaaaagaaacgaccaaagaagacggacagagacaaagagcaacaacagaaccaaacggagcagaaccaaaaaatgcagcaaaacaacggaaaaagtggcgaagagagcgacggaaaggaaaacggacgaaagtcagggaatggaaggaagaatgaaacggaggaggagaaggaggggaagggaacggcacagaaagagcagcgaaagtgccatcagaagaagcagacgaagggttcagaggagaaaagggcaaacagcgggggaaggacggacggagagagcgggagggggaggagggcaaagcgcaaaaacaatgccggggccgaagagcgacagcaaaatcggaagaaacgattcgtgtcactaatgtgagtcattagatacttaatgggctaattgtaggaaatggatgcgtattaagtccactgagccgacatttgtccattcggaagccccaaattgtggtcgaagatttggcaaacccaatccaaacttcgatgaccatttccgctggaggggagacaacgtacaggtggtgggcatgggattggcacttaatggccgaatggccaaaatttggaaagcaattccagacgatcgtcggacgattgcatccaacgctcatgctcagaagtgtttggcggtggcattgtctttccgagcggagcccatcacaacagccgcagggggtcggacatgagcaattcgtcggcatcacttcagctgcacgacatccaccaaattgaagcacagagtgccgaagaaatggcccaagcggaggtgaagccg

SEQ ID NO: 61121 - DNA, 513 bp, Heterodera glycines
  Genomic contig location: Contig_ID=SeqID_6315; Location=409..921; Strand=-
  SCN-specific regions: Sequence locations=1-35,95-110,189-252,274 -279,301-451,473-513
atgaaagtgaaattaattagcgggaataaggcacggtggtgtagttggttatcacgcgagtctcacacactcgaggtcgccggttcgaacccggctcgtgtcaatcgttcttttttaattttattgatcataaaattgaaatattttaagataatttaattcattttttaattttaatttttttttttgctttatattcgttttatggggccaaaatgctttatgattttttttttgcgaaatttcaacaaaatatattttttaattgttgttttctgcacattttctcaaaatttttaccataaaaatcacttgggtatgtaattatatgcacatgcattgtttcctggtttatgggaggcctcgaacgtatgaaaatatgttttggttcgttttgaagcttcaaggacgtatttccatatgcatattttgcatctttgtgcattttagcgcctttttatgtttttcttaaaaatgattttcatatttagtattttcgatattttagcttaa

SEQ ID NO: 61122 - DNA, 562 bp, Heterodera glycines
  Genomic contig location: Contig_ID=SeqID_6315; Location=2046..2607; Strand=+
  SCN-specific regions: Sequence locations=1-16,38-338,361-562
ccgattggcccaccgattcgaagccgtccctccgaagtgatcgttcatctccgtgccaattcctacaacatcagcgcatttgtgccaaaccacccgggcggagaatccgttcttcggctggtcaatggtcaagacattgagcaatacattgagggacgaaagtgcgttttgggcatttgccatcggcatcgatacgcttatcaggtggccaatttggcaaaattaatttatacattggataaattacactcaaatttgttgaacaaatgccaaagccgattattgttagcgaatctttgcttttttcgagattgacccaccggaacttcaaaaatgaaattcatttggtacaaaacaaaacctaattagcaaatgtctttgattattaattgccttgatttgaggtgctcagacaattcgaaatgccttcggatgttatcgttggggtgaagggcaaattttacaacatcagcgcatttgtaccggaccatccgggcgggtcttttgtgctcagagcgatcaacggtcagcagaacgtggagcagtacctggaggggcgaaa

SEQ ID NO: 61123 - DNA, 420 bp, Heterodera glycines
  Genomic contig location: Contig_ID=SeqID_6315; Location=1815..2234; Strand=-
  SCN-specific regions: Sequence locations=1-152,174-340,362-420
atgccgatggcaaatgcccaaaacgcactttcgtccctcaatgtattgctcaatgtcttgaccattgaccagccgaagaacggattctccgcccgggtggtttggcacaaatgcgctgatgttgtaggaattggcacggagatgaacgatcacttcggagggacggcttcgaatcggtgggccaatcggctgaacagaaaaaaggcaattccaataatttaggattattttattcacttttttacctcttcattttcctttgattttattttcagaaaattcagcgaaaaaacaatgaaaatttgatggaagtgaaaatggcgcattaattaagcttttctcaattaaaatttcaattctttccttaaaataacgaaaaaatgcaaaacggaaattgtttaaaaaaaacaaaaaaataaa

SEQ ID NO: 61124 - DNA, 268 bp, Heterodera glycines
  Genomic contig location: Contig_ID=SeqID_6316; Location=116..383; Strand=+
  SCN-specific regions: Sequence locations=1-12,35-143,165-268
gttttttcctgttttgcctggacctggacctggatttttttcacatttgacctggacctggatttcctggacaaaaatccaggaaaatccaggtccaggaaaaatccaggttgtcaaaaaatgcctggacctggatccaggaaaaatccaggcctggatccaggtccaggtcgaactctacaaaggagcagccgaaagcttgtaaattcatatccaatttggaaattgtacagaaacgcaaaaaacaattacacttttatttgtacaa

SEQ ID NO: 61125 - DNA, 158 bp, Heterodera glycines
  Genomic contig location: Contig_ID=SeqID_6316; Location=671..828; Strand=-
  SCN-specific regions: Sequence locations=1-25,50-136
atgcgtttcgcttccattcgtttcgctttgtttttatttctctttttggcacattttggcgccaacgaaacgacggaaaatggcgaaggacaattggaatcagaggaggagaaccgaaacgaactgcgcaaaatgccatttgaggagcaggaaaaagc

SEQ ID NO: 61126 - DNA, 293 bp, Heterodera glycines
  Genomic contig location: Contig_ID=SeqID_6316; Location=1978..2270; Strand=+
  SCN-specific regions: Sequence locations=1-293
atttgcttctctcttcgtccatttctctgctctttcatccccatggtcctccgtacccccaatccgaactgctccaactccatttgcgcttgcaacggacgcaccgccgcgcgatgcgttgggcgcggcttaacactttcgaggcgggcgccggcttcaaatcgctgaaagattggggggggggcacaattagggcgaggaaaaggtaatcaattaattagtctactaattaataacgggaaaagggaagacttctgctaacaaaatgagtgactgactcttgggaaaaaaga

SEQ ID NO: 61127 - DNA, 1017 bp, Heterodera glycines
  Genomic contig location: Contig_ID=SeqID_6316; Location=1519..2535; Strand=-
  SCN-specific regions: Sequence locations=1-193,216-253,275-594,618 -700,722-751,775-1017
atgaaccttcgctacaattttgccctttttttgctgttcattttggcatttgccgctttttctgacggactttcggtggacgaaggcattgacgaggaaggactgtgagaaaacgaacatactctgcattttgtcgtttgaatttgccattaaaaatccaaaatcccttaatttacggattatttattacatttttgagtctgtttagttttttgcttttgccttgctaattgattcaatcgttttgattggcaattcgaatttgtcttttttcccaagagtcagtcactcattttgttagcagaagtcttcccttttcccgttattaattagtagactaattaattgattaccttttcctcgccctaattgtgccccccccccaatctttcagcgatttgaagccggcgcccgcctcgaaagtgttaagccgcgcccaacgcatcgcgcggcggtgcgtccgttgcaagcgcaaatggagttggagcagttcggattgggggtacggaggaccatggggatgaaagagcagagaaatggacgaagagagaagcaaattgaggacaaatggtgaaggaaagagcgaacgaaagatgcacagaatcattcattcattttacaattgtaaagcgataattaaacgattaatcacaaaattgggacttaataatcaatcgtctgatacttttgattagtaatttatgcaaaattatattttaattgcacttttttaagtcatatggacaatccgtcagaaaatttatcaaaaacatttgggtggcttataattagagctcgcattttgagacatgccttttttgcgcactagtttcgataattaagcataaataacacattttccacttgatttgagacttctacgttgacttttattatgccttttttttttttgcctttttcgggattttcgtgccttaaatgccttttttgccatttttccattttggtgccttttttggcgttttttccgaaaaattccataaaaaatgcaataaa

SEQ ID NO: 61128 - DNA, 934 bp, Heterodera glycines
  Genomic contig location: Contig_ID=SeqID_6317; Location=74..1007; Strand=-
  SCN-specific regions: Sequence locations=1-198,241-269,291-447,469 -747,769-832,854-934
atgtatttgccatttccactgatttgtccctttttaattggtcttattgttagtcttgtgatgtgtgccgcttcggaggtcactcagcaagaggcggcctttgtttccttttattcaactttaattctgaactgtgtgtcgcctgctgtgtattgcgttttggcaatttgcttatacgtccgaaggccaagtcagttcaaaaaatataacaaataatttaaataagatttaaaaaattttcgcccgacaaaaaataatttaatttctgattctgttttattttaaatgcgaattacgcatttgatggattcaaatattcaagcctaaaatcagtctgacaatgagattctgttttttcgactcttaagtcgacgagaattcttatggcattttttcccgctttttggccggggattcgatggcatttccttctttttttggcatcctctcccttttcattgcagaaaacaacaacactcaaagtttgtctctcagtcagctgagtctgttccgctccatcttcgtgctgatgctcctccaactcctcggctggacttccaattccctttcgttgtttttcttccagaatttgttcgccatcgcttcgctctccgatctgacaaaatgggcaattaattgtgtgttcagttacattttgatcatcgcaaccgcaaccaatgggcccattttgtatttttgcaggtgaaaattgaaaaaaacagtcacaattaaaaaataattagggcaaattaattaggtaattaaataatgagagcacggaacatttatttacgttccccacttgctaatttaattcaataaatctcccccaattttagttttgaatacaaaaaagccattcaaaagcaattccgtgcattttgtcgaagtattggcaacaccaaaagaagcaaaaactcgcgggtggtggtga

SEQ ID NO: 61129 - DNA, 451 bp, Heterodera glycines
  Genomic contig location: Contig_ID=SeqID_6317; Location=1253..1703; Strand=+
  SCN-specific regions: Sequence locations=1-231,273-451
atgacaaatttaagtcggtccaatccgatggccaccatcaaagcggaggaaacattcttagaaaaaacggggagaagcattggccaaaagcactggtccaagcgaatcagattttggccagtcaaaacgatgaaaaacatagggaaaaagccgaattggtaaatggcaagcgaaagagagtcaatggcaatcaaaacattggtggagccgtgcaattgcttaaaaatggggaaaataaattaaaatattttgaaatttataattataatttagcaaagacacggaccgatttgaaattgtgacaaaaaccaaaagtaaattcaacacaatgccaacggaagcgatcaaagtacgaacagtgatcagaatgaccagcaaaggcacaaagccggaagaggagagaaacgagtaaaactgaacaaaggcaaaaagcaattagcagtggaaatta

SEQ ID NO: 61130 - DNA, 829 bp, Heterodera glycines
  Genomic contig location: Contig_ID=SeqID_30722; Location=1..829; Strand=-
  SCN-specific regions: Sequence locations=1-51,75-130,156-829
  Gene Ontology: Mol. function=microtubule motor activity; Cellular component=microtubule cytoskeleton; Biological process=cell organization and biogenesis
tccgtcggtgccgaagtggtggacaatgcctttctcggcctaaactcttgcgtttttgcttatggacagacgggtcagtcatgttgagattggctaatcgcatatgctatattgaatttgcgaataggttctggcaagtcgtacacaatgatgggcacttcggaggaaccgggtaataatgagggattaattaggataaagcggataataatgagggataattgtgataaatcgggcaataatgaaagattaattaggctaaaccggataataatgagggattaattggataattatgagggattaattgggataatttatggcagcacatcaatcgtaattggactaattcccctccccccctccccaagggattgtcccccgtttatgcaccgaattgttcgaacggttggcccgcgaaacgagtgaagatgggataaagaagttcaagttggaagtgtcctttttcgaggtgtacaacgaacgtattagggatttgcttgggtcggtttcccttttttaataattcgaattctctccccaaaattaggccgtcctccgctaagagttgcgtttcgacaccgaaacgtattccgtcgctgaaagtgcgcgaacattcgctgttgggtccgatggtggagggactgtcggtgtacaaagtgaccaattacgaccaaattgagaggtgaacaaacaccgaatgaaaggagcattccaaaataggaccaaaaaagttatttaggttaatcaacgcgggcaatggggcgagaacgaccgccgagacactaatgaacgagaggagcagccgaagtcacaggtggggccaaca

SEQ ID NO: 61131 - DNA, 49 bp, Heterodera glycines; identical to SEQ ID NO: 51181
  Genomic contig location: Contig_ID=SeqID_30725; Location=906..954; Strand=-
  SCN-specific regions: Sequence locations=1-49

SEQ ID NO: 61132 - DNA, 284 bp, Heterodera glycines
  Genomic contig location: Contig_ID=SeqID_30728; Location=959..1242; Strand=-
  SCN-specific regions: Sequence locations=1-131,161-161,186-284
ctttgcttttttgtccatttattccaatcgcctattgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttccta

SEQ ID NO: 61133 - DNA, 340 bp, Heterodera glycines
  Genomic contig location: Contig_ID=SeqID_30731; Location=13..352; Strand=-
  SCN-specific regions: Sequence locations=1-104,126-340
  Gene Ontology: Cellular component=26S proteasome; Biological process =protein modification
atgtacctattttatcaaaatttgttttttgtttttagtcgtattgatgtgctcaattcactgaccactgaagatcgcaagttgttggtccgtcttcatagtcttgaaattcttgtaatttcttcatatatatatatattttcatatttgcacatctttttcccaattttagggcgtttcgaaagttttcgatggaatcaaaaccgcatacttggcactcaaacacaggaagaatcgcaaccatcggcagcgcattgtcgtattcgtgggcagtccattggacccattgttggcagaaaaagaaatggtaaacacttattgggcgctatatgaaaagtga

SEQ ID NO: 61134 - DNA, 1652 bp, Heterodera glycines
  Genomic contig location: Contig_ID=SeqID_6319; Location=1167..2818; Strand=+
  SCN-specific regions: Sequence locations=1-23,46-1129,1181-1339,1385 -1652
atgtgccgacttcgcatggcactgccaccatcaccagcaccaccagtggaggcagcacattcctacgcacggcaaccacaaattatttggcccatctcaacaacattttccgccgtatgtcgcgtgaaaattacaattttataaacaatttttgccggaagaaaacggcaggaattggtgggggataaaggaggaaattcaaatgaaaattttccatatttccgttcccaaattgtcaggccgagcagcgccaccgtcagctgccgacacttcggctgttctgcaagccgacggcactgaccacaacagacgggggacagcagacccatcggtagagaaacaattttataaatttttgcaaaaaggatagggttgctcactaaacgggtctatttcttcctcaccaaattctattacccattatttctctcgaaagcggacttctgatgcccaaaatctccgtaaaattctttttttttaatcgaaaaattgccttttatacacgactttgttttgtattcaaaatgctactttgtccattttgcagagcaccgctgcccaactgttgttgtcttccgccgcattggacgacgcattcgcaaccagccgaagtgtcggcgatgttcagcaccaaccgttgcctacgaccaccgccacttccgcttcaaatgccgtgcctgcccagccgctgcaccaattggtccgctcccgttgggccggcatgcgcgccacgttggcaaacatggtaagcacataattagctaatctacattagtcaaaggcaaatgccgtacaccaaacatgaaagcgtcatcggaacagaagtgcgggtacacagctataacttattatttgtcaagcaaattttgtaatgccaagaactattagcctaaaaacccaaaaaatatatttttttttccgctgccccacggcttaacaattttttacgcctgaatgaatcgtggtcgtcttgataaggaaaaacttatacaaatatgttaatatttctggcgccgaaacgtccccgagggtcgcaaaagtcgggacacgactcaaatcatccgggtacaccccaaaacgtcgccgccgtaacgtcgccgtcgaaacgtcaccgccgaaacgtcgccgcaaaaaaaatttaaaatttttcaaaattttaagaaaatttaaaattattttaccttttctgaaaatctaagtgttaataaaaactaaatttgttgatttctaagaaaaaaatcgaaaaaaacttgaaaaaaaaaattttttcccctgaatttcttaataaaaattttttttcgaatttttctagaattttttccgaaccaggctaggtaactaaaaaatttttgataaatttttagataaaattttaaaaaattttgcggcgacgttacgtcccggcgacgtttcggctggcgacgttttgtccggcgacgtttcggcggcgacgttttgtcctgctcccgtcccatccatcatcaacaattgttttgaattttcagttggccgacaaatatttgtgcattcgtttgttggaccatcttctgcagagtgggaaggcgagccgtttcatcaccgggcacactttacgtctgtttttgccgcttgtgctcagtgtgccgaccgttggcgacggcggtggactatcg

SEQ ID NO: 61135 - DNA, 729 bp, Heterodera glycines
  Genomic contig location: Contig_ID=SeqID_6320; Location=636..1364; Strand=-
  SCN-specific regions: Sequence locations=1-729
atgtgcagaagcagcagcacgggacgacactgtccgggacggatcagcgccgaccgcaattggcaccgactttcgatgcctcgattgccgagcagtcaacgttccaatgggcaacggaaggtcaatcatcgtctacgagtcaatgggcaacggaaaaacaggacgttggacagtacaaagaattgcccaagtttgggcacggcggtgggggcggccaccgccctttctgaatttcgccacgtgataagacaatgccatgaatttgcgctttaccttttaaacttcaattaacttatctcattttctgcgtattttaatttcattttattctttattctcatttttttgcttgttcgcttatgttttccttgtgtcttatggataaacttaattcttttcttttttactcaattacgtaatttattgcctaggctaaaacaaatttagatcgaaaaaatattttttagtcacttaaatccgggtgttcccaaaattttaagtctgtccttcaaaaaacacaaaatgaaattattgtaaaagcaaaattaaattttccgaccatggaaatggatgttcacggcaagtctcagaaccaaagaattgggactttgacctgcattttctggacaaaaatccaggacaagcaaacattattgtttatcccatggctcattctgacaatatgtagctgactcagttttttttggttaagagatagacaaaaataaa

SEQ ID NO: 61136 - DNA, 440 bp, Heterodera glycines
  Genomic contig location: Contig_ID=SeqID_30732; Location=78..517; Strand=-
  SCN-specific regions: Sequence locations=1-58,110-143,166-205,228 -334,384-440
atggtgaagcttggtctgggggggggtgggggggggggtttgtgcccacacagaaatctaaaatttaaaaaaagtaacttttaaatttaaattaaatattttattttatccttttaagatgttcattcgaaagaacaaaaaatgagcaaaatgattgattattataaattgaagaaagcaaatccgtcgttctgtgataaagaaattgctggatttttaaaaatctcatcagcaactctaaaaagatggaacaaattgatgctaaggtataatgatgatttattttgtgctctatcaatttcatgcttttcaaagaatttatcagccaaaaatgtaataaaataaatttcatgttattattttggtttttataattttataatgggttggtactctatttgctatctcttttttgcatttaggccatctcttataataaa

SEQ ID NO: 61137 - DNA, 1154 bp, Heterodera glycines
  Genomic contig location: Contig_ID=SeqID_30734; Location=93..1246; Strand=-
  SCN-specific regions: Sequence locations=1-259,299-403,426-727,749 -1154
  Gene Ontology: Mol. function=aminoacylase activity; Cellular component=cytosol; Biological process=amino acid metabolism
atgaagaaattggcagccacgacggaatggaaaagtttattcatacggacaaatttcgttctctgaacatcggttttgcgcttgacgaagggttggccagcgaaacggacactcactcagttttttatggggaacgatgcgcgtggtgtgagttatgacaattggacaattttacaattctattcctattcagggctgcaaatcacttgtcctggcggttggtatttttgtattgtttttgcgtgcactacgccatcctcaaatttttattgttggaaaatataaaacattttgattatcattttcgttatttgtctttttagcccctgggcatggttcgcgattcgttgaaaacacagctggtccaaagttggtatgtgtgggatgggtggcaaaatattggttttatttgtggtttttctttgcgaataaatttccccattcaattattttctaatttaattttttagacttccattttggccaatttcaatgcttttcgtgaacgtcagcgtcatttgcttctcgccgacccgaatttgcgtctcggcgatgtcacaagcgtaaatctgacaaaaatcgagggtggagtgcagaccaatgtgatccctgcccaattcgtggcatgtacgtttttccgcacaaacagttctatttgtatgatcactgaccgtgtggatttagtctatgaaattcacgaagtttgtaaatgctggtagttgttagaatgactttgaattttgtttgagaccttttatataacgtaatcgaaaatgttttcgactgttggcatttaattttggtatttgtctgtctaccaaatttcaagtcattctaactactgttcattgtcgtcggggcttttttggattgtttcatgaaattaattatgttcttaattattccattagattttgacatgcgcgtgacgccaaccgacgactttcaggtgagtcaatggggaaatgttctttctgttttttggactttctgtcattggttcagcaaatggaagcaatgatcgccaattggtgcaaagaggcgggcccggacgtcacttttgagttcgtccaaaagggaatgtgcaaatcgctgacccccaccgacgcctcctccccgtggtggcacgcgttttcgtcggcgcttagcgaaga

SEQ ID NO: 61138 - DNA, 1031 bp, Heterodera glycines
  Genomic contig location: Contig_ID=SeqID_30735; Location=285..1315; Strand=+
  SCN-specific regions: Sequence locations=1-2,193-194,224-349,372 -548,570-599,621-987
atggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaaaatatttcaattctttggggtgtattttcagaaatttttctgttcatttcttaggggtgtgtataacatttaataaattttacgttgtcaacgcactcataacaatgtcagttattgtttaatacatctgctaaatgggaatgtagaagtaaacacacaatactttatcttcagctgctttaataagcattgggcaattaattatctggtcaaaattttgacaaagaaaacaacacaatcgaacataatttgtaaaagtttccatttggcagttggttggcattttatcactttgccaaaatcaaattcccacccaaaaaaaatatttaaataaatccacattaattaaggaatacataagttaaattttcacaaattgtcgttaataatcccatggaattgttgctgtttcgtcagggcgaatttgacaaattgtatggatgtgagggatttaatgcgggcaaaatcccaattgaagaaagaacaaacattatgaacggatgcattttgatgatactttttttcatttttgaggtcttttttcgctgggtgatggaattatagggctcttgatttgaatttttctactcttgaccgagacgcaaaaattcaaagaaaatcccaaaagtttaaaaataaatcgatataatttaagctactgtatattccgtgtatggtatcaatttacaaaaacatgaaaaacaatgcctgctacaaattgatgttcttcattggcatattggacatggtcatcttttaacagaataaattcttcaagaatatttatttatttttaaa

SEQ ID NO: 61139 - DNA, 439 bp, Heterodera glycines
  Genomic contig location: Contig_ID=SeqID_30736; Location=470..908; Strand=-
  SCN-specific regions: Sequence locations=1-439
aaaatggtataagtaacaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 61140 - DNA, 452 bp, Heterodera glycines
  Genomic contig location: Contig_ID=SeqID_30738; Location=27..478; Strand=-
  SCN-specific regions: Sequence locations=1-75,115-131,177-223,245-452
  Gene Ontology: Mol. function=voltage-gated calcium channel activity; Cellular component=apical plasma membrane; Biological process=male courtship behavior (sensu Insecta), song production
attttttactggagcgtgataaccttggtgttcctgaatactgtttgtgtggccagtgagcatcatggacaggtgaaatttagtttaaaattttttaaataataattttttttagcccgaatggttcacggaatttttaagtaattttttatttgttatttatttaaattttattacaaatccgaaactttttgtagaatatgccgagttcacatttcttgccattttcatcagtgaaatgcttatcaaaatttttgcaatgggttaccgtacttattttacatcgaagtactgtattgatacttttaaatttattgattttttctttattttatttgtttgtattttgtcagatttaatcgttttgattgcattgtgattgttggaagtgccattgaagttatttattcggaacttaaaggcggatcatttggaaacaaagaaatattaaa

SEQ ID NO: 61141 - DNA, 390 bp, Heterodera glycines
  Genomic contig location: Contig_ID=SeqID_30740; Location=647..1036; Strand=+
  SCN-specific regions: Sequence locations=1-390
tgagaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgcgaaaaaagagatagccattttttggtcaagaattttttttgtttgcgtttcaaatatcgtaagattgtttgatagggccagacaagagaaggcaactgttggtaccaattttgcgttaaaaaaatgagaaaaaa

SEQ ID NO: 61142 - DNA, 90 bp, Heterodera glycines
  Genomic contig location: Contig_ID=SeqID_30742; Location=796..885; Strand=+
  SCN-specific regions: Sequence locations=1-6,84-90
atgtcttctctctctctctctctctctctctctctttctctctctctctctctgtgttctctcgtctgtctgcttctctctctgttctct

SEQ ID NO: 61143 - DNA, 419 bp, Heterodera glycines
  Genomic contig location: Contig_ID=SeqID_30745; Location=956..1374; Strand=+
  SCN-specific regions: Sequence locations=1-73,105-293,336-419
atggggtcagaagagtttgtgaagggaacaccacgagtccgcgaagaggccgagtgagtaccttcggtgcaggaaaattattaaattttaaaaattttttaattgctttttaaatatgccaaaaaatgtaggcttaacttttttagtgaaaattcgatcactcatattttttgataattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttatgaaacgcaccaaattttatttacatgttagtttaggcactctgatgctttttctatcaaaaagggagatga

SEQ ID NO: 61144 - DNA, 769 bp, Heterodera glycines
  Genomic contig location: Contig_ID=SeqID_30749; Location=1..769; Strand=-
  SCN-specific regions: Sequence locations=1-192,216-769
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatttggtgcgctttagagcattttctgggaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtataggatatagtgaagctattccggaaggattcggtctcc

SEQ ID NO: 61145 - DNA, 1105 bp, Heterodera glycines; identical to SEQ ID NO: 30751
  Genomic contig location: Contig_ID=SeqID_30751; Location=1..1105; Strand=+
  SCN-specific regions: Sequence locations=1-82,104-271,294-606,629 -717,739-906,929-1036,1059-1105

SEQ ID NO: 61146 - DNA, 866 bp, Heterodera glycines
  Genomic contig location: Contig_ID=SeqID_6325; Location=73..938; Strand=-
  SCN-specific regions: Sequence locations=1-372,394-737,759-866
atgcgtcggaatagtgtccaacaattgcaacaaaatgagcaaaagtcgccgctgcacagcccaatggcaaagtgagcgcaaattcaaaagcgaagcaaagcaaacattttgccaaggtttcgccgtttgagtgccatttttggcggttggtcggcacgggtggaggccaatgtgtcgccaccgccgcctttttgctcttccggcgcgccaatggccgtccgccgagtgccgttctcaaactctcctcatgtggcatttagcaaatgccgaccatttttatgctttttcattgttttgacttagcttcgcccgcaacgccccgcgctcacccgccaattttccattcattcgtccaatggttactcattttgaaatgtttctcaattttaattcatttgtttgcttttcccgacatggcattttcgtcccatttatttgcccaaattgccgcggaaaacgcggccaacaaaaattgtttcagtaaatccgtcccattttatgaatgtcttccgccacaacgggaaaaggtattgcgtgaaaaacaacaaattgcattaattaattatgctgcttttgatcgggccgtcttctgattcgcttcgccctccccaaaggcaaaggcctccgtccgccgcgccgccttccgtactcaatttgaccgctctctctcggcttccccagccaaatgcgagcggtctgtccccgccccctttcgttaattaattgttaattaattgtctctcactgattttatgattttccgtcgcctcttcttcgacccgtcgtccgctcagccggaggctcgacacctaatcgcctacaaaggtaaaaagtgtaaatgaaaaagaatattcccaaacaataaa

SEQ ID NO: 61147 - DNA, 394 bp, Heterodera glycines
  Genomic contig location: Contig_ID=SeqID_6325; Location=1..394; Strand=+
  SCN-specific regions: Sequence locations=1-68,90-180,202-394
cgtccatttgtcccttagtgttcactctgtcctgacactttggtatcactcctccaaaactgtcctgcattatttattgtttgggaatattctttttcatttacactttttacctttgtaggcgattaggtgtcgagcctccggctgagcggacgacgggtcgaagaagaggcgacggaaaatcataaaatcagtgagagacaattaattaacaattaattaacgaaagggggcggggacagaccgctcgcatttggctggggaagccgagagagagcggtcaaattgagtacggaaggcggcgcggcggacggaggcctttgcctttggggagggcgaagcgaatcagaagacggcccgatcaaaagcagcataattaattaatgcaatttgt

SEQ ID NO: 61148 - DNA, 1040 bp, Heterodera glycines
  Genomic contig location: Contig_ID=SeqID_30753; Location=550..1589; Strand=+
  SCN-specific regions: Sequence locations=1-168,191-243,265-1040
atgaaattgccaaaggtgaacacacttttcgcgaaggttggtttagacttggctggcccgattcccaatcacgaagaagggcgaccggcacgattctttgtattatttgctggttcacaaggtttgtgattgccgtgcctgttcctgatgccaaggcagttactttggtaaaggcatttttatctaactgttatttaaagttcggcggatgcacagaactcatcactgacaatgctacggcattcacttccgaattctttcgagaattctgctccatgctctacataagcaaacgatatgcgacgccacactggtcgcagggtaatgctacgactgagagaagcttccggactttccacaacatcatgtcaaaatatgtgtcttcggaccagcccgactttgatgaacacctcgacatgacaaccttttgctataacaccgcgattcattaatcaaccggtgaatcacctttctttttaatgtatgggcgtgatccgatcttctgcattgatcagattttagacccaaaatcttctcgctcgtctttagtgagtgatttgtctgaattcaagcaaaagcttgtcaattccttgagaacagcttgggaggctgctgccggtgaatctaaacaggcacagcagcgggctaaggcccaatatgacaaactcattcggtgtctggaaatcaaagttggagacagggttttactccgaaattacgctggaaaagttggcacgtcaaagaagttccaccttccatggaagggtgtgtttcgagtaattaagattgaagaggtgatggtaacgattgtcagttgtaatgccccgcaggctaaccctaaagttgtgcatattaatcagcttaaaaagtgcgtagaaatcttaggacccgcttgcaccgcaccaaatgtctccgatgaggagaaactttctttggaaaaagcagatgctgttgaagtatttgacatgcccggttttaatcatctgaactcagacaatccaaacaaatccgaaacagaccctaacactgagtccacataa

SEQ ID NO: 61149 - DNA, 1153 bp, Heterodera glycines
  Genomic contig location: Contig_ID=SeqID_30754; Location=115..1267; Strand=-
  SCN-specific regions: Sequence locations=1-288,344-518,540-546,969 -1153
atgtcggaaaagtcagacgtttggtcgttgggtgtcattctgtaccaaatggtgtacggtcattcaccgtactccgcccttttgcaccaattcgatgctgtggaggacgaaacggaacggatggaacgcgcggacgcggcactccgtccagcgattttgcacggcactgagcccattcatttcggacagtacgaagacgaagcgatgcttaacatacttaaggtgtgatggaaaaaggtcatcgaattatagggatttagtctgtacagtaatccgaggttacagtagttataaaagtaaattaataaattcattaaaaattaattttataatacaataaataccccaaaagaaatgcctcgagcgatgccccgaaaaacggccgaacattgaccaattgttggcactgatgaagcagcaattcggaatgggcacagaagaacagcgaataaaatttccagggaataaatttcgcattcacttcaaagacattgtgatgcgatgagaaacggcagagagaaagacggacggaaggaaagggggaaaagagagagcggaagagagggagagagaaagaaagagaggggagagggagagtgagaagggagaagagagagaaacagaaagggagagtgtgtgagaaaaaggataaatatagagagaaagagaagggtggtgatagaggggaagagagagtgtgagagaaaaaagagaaagggagagtgtgaaagaaaaaggagaaatatagagggaaagatacagaggggggagagagagagtgagaagagagagaaagagaaagggagagtgtgtgagaaaagggagaaatatagagagaaagagagggggcagggaaaagaggagagaaagagagtggtgagagagggaaagagagaatgagtgtgagagaaaaaggggaaacatagagagctgaatagagagagagatagagagagagaggagagagaaagtgaggaaagcgagagatagtgaaatgtgatttaatgattatccaatccaaatttctagctattcaacaagattaatttatttttcgcacttttctctttcgctttttcataaattagccgacaaaaaatgaatcattgggaaatgcgttcgattggtccgtcatttgctaatacataataaa

SEQ ID NO: 61150 - DNA, 407 bp, Heterodera glycines
  Genomic contig location: Contig_ID=SeqID_30755; Location=496..902; Strand=-
  SCN-specific regions: Sequence locations=1-184,328-352,374-407
atgtttaattgcctcattaatttgctcagcaatttgattgccactcatttgtcaccaaatggcgcctatggcctcgtgtttggcattaacagttttgttgcacttctgctccaatcagtcgtcacactgcttattgtcgatgtaaatggtgcttttgcattgtcacttgaagcacaagtggggcaaataattaattaatactataaatacattatttcaatcatttttaattaataattaaattatccataagaactagaaacatttatataatttaaattaaaataaaataaaattaataaattaattttaaagataattaaaaatgcatttctttatcacagtttaaatgttcattttaatttgatttgttttttcagttcgtcacctatagcatatgcatgttg

SEQ ID NO: 61151 - DNA, 125 bp, Heterodera glycines
  Genomic contig location: Contig_ID=SeqID_30757; Location=489..613; Strand=-
  SCN-specific regions: Sequence locations=1-125
aagcgtcctaatttccctacaaagtttgaaaacgggcgcgaagcgcccgtcctgaggccgcgaagcggccgaatatcccccaaaaaaattaaaaaacggggcgcgaagcgcccgacatgaggccg

SEQ ID NO: 61152 - DNA, 280 bp, Heterodera glycines
  Genomic contig location: Contig_ID=SeqID_30759; Location=647..926; Strand=+
  SCN-specific regions: Sequence locations=1-153,197-280
atgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaattttttttcagaaactgctctgaaacgcaccaaaatttatttacaagttgaataaggcactctgactcttatattatcaaaaagggagatga

SEQ ID NO: 61153 - DNA, 434 bp, Heterodera glycines
  Genomic contig location: Contig_ID=SeqID_30760; Location=456..889; Strand=+
  SCN-specific regions: Sequence locations=1-124,146-434
atggcggatagcgaaatggaggtgagaaaagtctgaaaaaggagaaaaattttatttgaaagaagcaaatcggacacataaaaaaggatgcaaactatttaaaaaagcgatcgatcattttttgatcgaattgatcattttgatcaatgataatttcaattgggaaaaaacagctggatgatcaggagggatttattggaaaaggcattgatttggtcccagcaaatgatcatgtaatcgccgcttaccacgctgcagcacagcaacacaaccatgaacgcctccaaaatgccggcggtgccgacaatccacggcaaacggatgaagaagagaacgccgaaaatgttttgcaggcatggaatgtagctgaacagcagggaggacaatatttagattatcctccacagagaataccaccaaatgaatttggctga

SEQ ID NO: 61154 - DNA, 437 bp, Heterodera glycines
  Genomic contig location: Contig_ID=SeqID_30760; Location=405..841; Strand=-
  SCN-specific regions: Sequence locations=1-241,263-437
  Gene Ontology: Mol. function=potassium:chloride symporter activity; Cellular component=integral to membrane; Biological process=transport
ttgtcctccctgctgttcagctacattccatgcctgcaaaacattttcggcgttctcttcttcatccgtttgccgtggattgtcggcaccgccggcattttggaggcgttcatggttgtgttgctgtgctgcagcgtggtaagcggcgattacatgatcatttgctgggaccaaatcaatgccttttccaataaatccctcctgatcatccagctgttttttcccaattgaaattatcattgatcaaaatgatcaattcgatcaaaaaatgatcgatcgcttttttaaatagtttgcatccttttttatgtgtccgatttgcttctttcaaataaaatttttctcctttttcagacttttctcacctccatttcgctatccgccattgccaccaatggcgtcgtttcgggcggtggaccttattatatggtcggtcg

SEQ ID NO: 61155 - DNA, 810 bp, Heterodera glycines
  misc_feature (43)..(43): n is a, c, g, or t
  Genomic contig location: Contig_ID=SeqID_30760; Location=931..1740; Strand=-
  SCN-specific regions: Sequence locations=1-48,71-182,209-262,285 -669,691-742,764-810
atgacttcgccggcacggcgacgggtgccaacaacgaaatgcncgtacaacaacaagcacaaaaacaacagcagcaaccatcggcaccagcacaacggaagctcggctaagacgccgacggcaccgccgccgacggcgacgcgactcgccacggagacgacggagaaggagccgttgtgcgccaagcagcaacaacagcagcacaacatggcattgtacgaggtcagttgagtatcgggacgtggagttatcgagtgataacaaaattacctgctgatcactccgactaaaccattaatgcctcgggattcgactttggaacccattcacggcatcatttccactgattgtgagactgatcagtacgaaactctcgattagagtcaatgggtgagactgatcaaagccaataatttaccctggacactgatcaaagtcaatagtttttatcttgacactgatcagagtcagtgaattgctgatcaaatcacctctcgacactgatcagagtcgtttaattcaccgaaacttaccgcggcagatcaatctagcagaagcagtagcgaatcaatttgtggcccttttaaggacgactgctccaagggcggacaaaacattggccaaatgttgcgttcgctgtccctttacaacgccattctgccgacagcggtggacgaggaggacaaagagtcgacagccaaaggggcgacaaacggaggcgtcaaaaacggagaaaaggagcgcaacggcggcacaaaaggggcgcccaagcgacaaaccgccaaattgggcacaattatgggagtgtaa

SEQ ID NO: 61156 - DNA, 56 bp, Heterodera glycines
  Genomic contig location: Contig_ID=SeqID_6327; Location=57..112; Strand=+
  SCN-specific regions: Sequence locations=1-8,31-31
gtcccggttcccggtcccgggttttgaaaatctcaggtcccggtcccggtagggca

SEQ ID NO: 61157 - DNA, 2814 bp, Heterodera glycines
  Genomic contig location: Contig_ID=SeqID_6328; Location=430..3243; Strand=-
  SCN-specific regions: Sequence locations=1-272,294-409,431-1179,1214 -1764,1786-1966,1988-2171,2193-2289,2311-2412,2435-2553,2576 -2638,2680-2814
atggataaccaaaagttgctactttttattgtatttttggtaaattatcacttttgttttgcattgtctgcggaaccccaaaacaaacgcaacaaccatcatcaaattgccaatgaatttgttgctctgaagcaaataagtgaagcattgtcgcaacaaagtaacggtgaaaatagaaaattaataattaaatacccattaattaaatatcattttatttaccatacaaatacagaggaactgacgaatggcgaaaagattgacaatgcgaagtaaatttggatttttatataataaaatgccgaaaaagttggcaccataaatttggcactaaaaccatgccaaaattaatacaaagaattgaaaaaaaattaagtaattcggaaattttgatattcaatttttttaattgatttatagctaaagaaatagtgcatatttgcatccttaaaagcggggcacccgaattttaacgtatcgctaacttctcttcttatttcaattgatcgtttaagcaaatctttggaattggtacttgagttgttgaaaacggaatgccaattagccaaaattgctagcaaaaattcatcctcaagttacccgaccaacggttatttggcaaaattttgtgacaaaaagacaggtcaaaatttggacacaattgaaaaactaacggaacatttaacggatttcattgaaaaagatttgccaaaaattgtggaagcaatgaaaaaaacagaaacgacggaaataatttctaccggtagagtatacggtacaatggctgagattttaccacgagcaaaacagtacccgaatgatgcatctctgcttctatatgcgcaagcgatgaaagcattgagccgaattagccaagaaattgagcctggaacaaccatagatgcactgacgaaaacgttgaaaaagcatacggtagcttcggacgatggtgatacagtaaccttaatgccaagtgaattgacacaaatcatcatggagctttggacaaatacaattttgaaaggaattgctaatgccggccaagaaaaatacaattatctgcaggtaaattaaaagattttgggtggtaatttcatgaaaattactttgatttgaaatttataaatgtacctaataatttatcataaaatttacgcccgaataacccaaatgatactcatataaattgatttattttttaatattatttatacatacaattaaggaactaaattgcccataattaagaatagtgaaaataccattaaacctttatttgtcagccccaactcaatggcaccggcgccgaccgttcacaagaccgtcgtcatagacgcgcacctccagtatttcatattcattccaatataattatgatgattttgctgattgtgcaaatgtctttaatcgccgtagttggcatcgatgcctctcgaagcgatgcaaattgggtcacagtgtttaccgctttttttaccatgtttttcatttggcgtgttcaaattccgggccaaccgccaccgccaagtatacatttttcactgaatttcaatttaattttgcccgtggttcaaacgcggattggtgctggcatgccatttggcggagcagcacagcgaccaactgcggcgggggatgatgaccgggcacaacatttgcatgcgatgctgcgaatgttcaacgcaatgaatggtcgtgccaacaccgcggcgccgtcggcaggttgggaaaagcacgaaagaaatcaaatgaatagcaaatgtcggtgaaatatgaataaaatggcaataggataattttatcatggattatttgccagtgatactgtatttaaggaaagatatactgtgattgaaatattagtggatcaatcagaagatttatagcgtgttctgcataaagcatataattacagtatcaactaattcgtctttttttaaattttcgttttttaaaatgacagaacaataaattaataaattttttaggctcgaatagagataggagccagaatatcacaacaacaacaactccggcaccaccgacgggggacaatggaaatgatgaccgtaaacaagttgaacactatgacccagtttcggacacatttgttggtgcggaagagacatttgtgaccactacgacagaaagtccgatcaattgggaaggagaagggacagaagacagtaatggcgacactgatgactcattagcaagagagtacggtaggccaaattgagcaaacaaaacggaagccgaagatggcagaattatgagaggaacgaatgaaaagagaagaaagaggagcaaatttttatggtatataaccctcatttgttaccaaaagaatgtcagacaaatttacatttccatggcattaaaatttggccaaaaaaccatttatttcccatttataaatgttttttgcttttatcggattgactttttccattgtttgcctattaaccataaaattcgtagaattatataagttttcgttgaacggacaatcactaaaaattagtaaagaggatgagattctgagctaaagacggaaaaaccaaatttcctttggagattggtaaatgtttttgcgtgacctgctaatctaagctcacatgggggataaggagatttcaaaaaattaaaatttaaattaaaaaaaattattataaaaaactattaacaaatgcaaacattacaaaaaaaagcgtttgatcatctttaaaattaagaatatttgtaaaaaaatttgatttaaaggaccataaaaaattgtaaaaatttccaactattttattgatattgaataaa

SEQ ID NO: 61158 - DNA, 287 bp, Heterodera glycines
  Genomic contig location: Contig_ID=SeqID_6329; Location=873..1159; Strand=+
  SCN-specific regions: Sequence locations=1-9,31-176,198-287
atgatcactgatctttcccttttctctcatggatggccaacaaatggcacgaacacatggataagtgatgaagcattgttggccaaaaatggactcggacttaatttttgccaacggcgggcggctgttcttcgacttgcaaacttttcgactgttttggcactgcatcaactgcccaagcttgcaagcactggacttcgtccacccgaatgatttctttggtctccggcttactgtagccccaaaagcttacggtaccaccttcggccttctgtaaaagcagtcaa

SEQ ID NO: 61159 - DNA, 513 bp, Heterodera glycines
  Genomic contig location: Contig_ID=SeqID_30763; Location=343..855; Strand=+
  SCN-specific regions: Sequence locations=1-66,90-193,223-289,311 -391,413-513
atggcgctggaagcaatgggcttggactcgtcaactgacggcaacgacagcgagccatcactggccggtgattttgattttaaaaaattaacaaaaaaagtttgaaatgggacagaagaaagacacacatcagccaatcattggccatcctgacaatgagtggcgaaataaatagatttgctcataaattgtcataaataaatatttttttaagatttaaaacggcctgaaaatatggacatttctttaaaaatcctctattagaacggccccatttcaaagagaaaattgaaaattttagctttatttagtatttttttagcatcaattaagtcattttgacagtattttgcggtttgtaaacatagttattataattatgttttagctcgtttgttcaaaggtgttgacaccaaagctacacaacaggtcccagcgacaactattgtttagtgcaagcaacacagtacggcatctaacgaacgtaaatacattcgaatttaaatcatttca

SEQ ID NO: 61160 - DNA, 253 bp, Heterodera glycines
  misc_feature (94)..(94): n is a, c, g, or t
  Genomic contig location: Contig_ID=SeqID_30763; Location=1191..1443; Strand=+
  SCN-specific regions: Sequence locations=1-53,75-253
atggagaagaacctacagcaaatgaagaagggccaaaagaagatcattggaagtaaattaaaaattatttatttcaattactaaacttactcanaaatgggtactgtaaattacagtgccatttaatatcctttcaaatttttgtgtaaaaaagtccttccgtatttaaggttttgccgttcaaattgaagacctgcagaacggacaaaaggcacttgtggaaaaaccaccacctgaagtggagactgaatag

SEQ ID NO: 61161 - DNA, 304 bp, Heterodera glycines; identical to SEQ ID NO: 53844
  Genomic contig location: Contig_ID=SeqID_30766; Location=296..599; Strand=+
  SCN-specific regions: Sequence locations=1-304

SEQ ID NO: 61162 - DNA, 914 bp, Heterodera glycines; identical to SEQ ID NO: 30771
  Genomic contig location: Contig_ID=SeqID_30771; Location=1..914; Strand=+
  SCN-specific regions: Sequence locations=1-16,38-174,197-567,598-914
  Gene Ontology: Mol. function=RNA lariat debranching enzyme activity; Cellular component=nucleus; Biological process=mRNA splicing

SEQ ID NO: 61163 - DNA, 1640 bp, Heterodera glycines
  Genomic contig location: Contig_ID=SeqID_6330; Location=1..1640; Strand=-
  SCN-specific regions: Sequence locations=1-817,841-986,1013-1037,1059- 1197,1219-1640
  Gene Ontology: Mol. function=helicase activity; Cellular component =nucleus; Biological process=chromatin modeling
gacgaatcgttgacatttggctgagttgacgaatcgtcgcattttggctgagttgacgaatcgttgagttgacgaatcgttgacatttggctgagttgacgaatcgtcgcattttcgctgagttgacgaatcgtcgagttgacgaatcgttggcgcgcccaagcccagtgttagacaaaattgctcataacgccaaatagcgtaattggcgtaaattattgcgcgctaattcaaaattacactggaaaatgccttttttgtattttttattttgatcagccataactcgcttcattcccaactaaagtgaacaaatttggtatctaaaataagaatttgaaaaggggaatctttttctaagcgaatgctaagcaatttaagtcatatgaaaaaagttgtgagagtttcaaattttttatcacgttataactcaagtcctaaactgctgatttcaaccaaaatgcgaaaactaatcattttctattgattctaagtgttcaaagtgattttgtagcctataaaccaaaattgttagaattagcgaatttgatgttttttcatgtgttagagacatgaaaatagtacgccaaaattagaggaaaagaaatgcaaaattttcatcatcccttaactttaaaataggatagaaattcattaaaaccttatagaacattcgattcaaaaattttttctctatcgatgtgcaaaatttggtgtgaatttaaaaagcagaaaaaaaagttaaacagcatgaagtaaatgttgttttttacataattaaaatgaagagatagtacgccaaagaaagagaaattataaagaaaaagagaaacgacgagatagtactaggcttttctctgcacagtggagttgacccatagtgtattgacacatgtctcgttttttgactcggtgtgttaacaacgcccaaaaaaactcggttttcgtgcgtcaaattaattactttctttaattaatctactaggtattttaatttaattttaaattttttgtatacgaaagatggagacacaaaattcatccaagagctttgatgattctgacgtaaaaatggaggaagttaaagaacagttggatgaaaaggtttgcttggattgaggattgtttcagcaataaataatttagacgaagcctgagttcgacaaattcctaaatgagatcgaaaatgaagttcaaaagcaagtttttcaagaaaaggtaatttgttaatttctttttgctatttcaaattagagaaattaaaggcggcaccgacagcaaaacgtgaaggggccttggtaaagtcggctgcgttaggggaccaccgccacagaatgaccgaaaaagaggaagacgagcaactgctgcaacagagcgttcgaagcgacgacagtccgttcatcttcgagaattccccacctttcatcaaaaacggggaaatgcgcgactaccaagtccgtggactgaattggttgattcaattggaacacaaccgaatcaacggcattttggcggacgaaatggggtaaaatgttacttggttacttaattttatgacctttccaatgcgttaagtcttggcaaaacccttcagacgatcgccgttcttggatttttgaagttttacagggactctagag

SEQ ID NO: 61164 - DNA, 429 bp, Heterodera glycines
  Genomic contig location: Contig_ID=SeqID_6331; Location=481..909; Strand=+
  SCN-specific regions: Sequence locations=1-406,428-429
atgtgcaaaatatgtgccaaaccccgaaatatgtgcgatatgtttttatgggtcgggggcgtttgggccccagtttttgggcccccgcgtttgggcccccgtttttgggccccagggtcgtttgggccccaagcgcctcccctcgattcgtcaactcaacgattcggcaagccaacgattcgtcaactcgacgattcgtcaactcagccaaaatgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcagccaaaatgcgacgattcgtcaactcatccaaaaatagttttaaaaagcagtttcaagagcttttaa

SEQ ID NO: 61165 - DNA, 1861 bp, Heterodera glycines
  Genomic contig location: Contig_ID=SeqID_6331; Location=1019..2879; Strand=-
  SCN-specific regions: Sequence locations=1-47,69-153,177-793,815 -1178,1201-1676,1708-1708,1730-1840
atgaaatcgattcgtaaacaaattgaacaacaacatcgacgaaaaacaccaaagcggttcggagagccgtctgctgattacgacgacagcaacatttttcctacccaacgcgaggacgcagagcagattgaacaagccgaatacaccgcatcagatgaagatgatgaggaaaacagacctctaatcgaatttcaacaaggaaaaacggagaggggatcattatgcatttggcatcaaggtcgggtggttaaatttttcaatggcttcgattttttgcagggttccgtttcactcgcatcagagggcggtggtaccgctgttccaaccgggactgtgaggcaactgcagcattgagtaaagaaggcggaactaatggtgtgctcggaagaaagagcacaaccatctgccggacccagcgtgcttccacgcggaggtaaaacgcaacggaattaagacgacaacgatggaaaacccgcgcaaaagccatcaaaagtattggcagaagtccgtgcaaacaccaaggatgaaacatttgtgtccatgggcactgacctcgcactggcggcagtaatgagaaggttattctcttttgatacttgtattcctctttcactcttatttccagttttttaggcagaaaagaaagatttacggcaacatggaccgtgtcaaccctctgaatgttgtcctacccgatgccctgcttatgaaggatggcgaaagcacattgttgtatgacagccgagtgcgtcgccaaggagaatcggatgtggtcttggtctttgcacacccgaagttaagttcattaatttctatgttcaatttttcgcttttattttcagctgttggacgttttgaagcgggcgaggaaaatttcggttgatggaacattcaaagtggcaccagttttgcgatcatagtaaatcatgcacccgatggtttggctgcatttttcggttactttgcgagggtatatgttggactgaccgcacacgaacaagaagccggcgccgtcgcgtttgttccgggcactgatcaaagccgacgcagttcaatcagcaccaatgccactggggatgccgaatacagtcgccggaattcatttagtagtggtgagtatttttgttttttgaattcgttcttattttctttattttagtaaatttggaccatatttatggaaacaatttcatccaattcggcgtcccttcacctgttccatcaacgccaacaacccagtcgtcaacaacagtttccgtcgtgccgcgctgggagctgccaattgtgcgtccaccactgtaccccgtgcacttctggaatgtccacgaccgtgcgaggtcagcagtggagaagacgaacaatgctatggaggcgtcacacctccaattttcggtagtgtgattttttgcgatttttttcatcacttttcacatttaagcgaggtttagtccatcacccgtctttgtcagacttcctagcagctattctggattctgtcgacaaacagatggacatcgcaagatctgcccgggtgttcccacacaagcgtcgcatcaaatatattttgaaggagcaattgatcggagatgcactggacgaagcggagtacaacaccgacgaagacgtcttgaacatcctttctctgctgagtttgcagatgcagggatatgtgggcgggctgcgtgcacgaggggcacaagaacatgaggactatgcagaagcggaagattgaaccaattgcaattgattgaaatttttaaaccttcattcaccctataatatcagttgaaatttgtttaacctcaatccctgataatcatcattttgattcgtttttttctttgaatttttgtttaataaa

SEQ ID NO: 61166 - DNA, 388 bp, Heterodera glycines
  Genomic contig location: Contig_ID=SeqID_30774; Location=737..1124; Strand=-
  SCN-specific regions: Sequence locations=1-107,134-217,239-263,292-388
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaataaa

SEQ ID NO: 61167 - DNA, 107 bp, Heterodera glycines
  misc_feature (86)..(86): n is a, c, g, or t
  Genomic contig location: Contig_ID=SeqID_30774; Location=1..107; Strand=-
  SCN-specific regions: Sequence locations=1-56,82-107
ggttcgatgaaactttttaaaatataagcctaaactttttggcctgtttaaaaaggaatttaaaattttaaaatatttattcatcntccctttgatagaaaagcatc

SEQ ID NO: 61168 - DNA, 129 bp, Heterodera glycines
  misc_feature (39)..(39): n is a, c, g, or t
  Genomic contig location: Contig_ID=SeqID_30774; Location=1192..1320; Strand=-
  SCN-specific regions: Sequence locations=1-129
ccctttttgatagaaaaagcatcagagtgcctaaactancctgtaaataaagttttgtgtgtttcagagcactttctgaaaaaatacttatgaattattttgcaaaaaataaataattaatgaaaaagt

SEQ ID NO: 61169 - DNA, 182 bp, Heterodera glycines
  Genomic contig location: Contig_ID=SeqID_30777; Location=9..190; Strand=-
  SCN-specific regions: Sequence locations=1-1,24-102,125-182
aaaatctataaaaaatttaaaaatgagaattcatgcgagattttctggaaataagcttaatagggactagttaagctgtaaaaaaaaatttggggcgatttgaaagagaaatagaagaaccaaggttcgatgaagttttggtaagccaaaaaaatccaacattttaaaaaatctataaaaaa

SEQ ID NO: 61170 - DNA, 438 bp, Heterodera glycines
  Genomic contig location: Contig_ID=SeqID_30777; Location=413..850; Strand=-
  SCN-specific regions: Sequence locations=1-1,24-160,190-325,355-438
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagaga

SEQ ID NO: 61171 - DNA, 749 bp, Heterodera glycines
  Genomic contig location: Contig_ID=SeqID_30778; Location=198..946; Strand=+
  SCN-specific regions: Sequence locations=1-237,262-368,666-677,701 -713,735-749
atgaccaaacaaattgagcagggtaaatgccaaaataaaaatgaattgaacttcctatttagatcaaaaattgtacaacgaaatgtcaaattttacgaaaacagaagaccaaattttaggaaattttggaatatctttgcatttgcaagaaattaaattatttactgggcgaacaaatttggttgaaaatcataacgcaacaataaacatggttgatgataaatagttttttgtttctaaatttaattaaatttaaatttagttgacagaatttttttcaaaaaatggttttggaatggttgaaaatgaaagaaaattgaaaattgacctggcaattgaaagaattgaacgagtggtgaaagaatgggtaaattaattaaaaaataataatttatcaaatatggcaaaactattaaaaataataatttatcaaatatagcaaaactattaaaaaataataatttatcaaatatggcaaaactattaaaaataataatttatcaaatatggcaaaactattaaaaataataatttggtaaattatgccaaaattattaaaaataataattttgtaaattatgccataaaaataataatttagcaaattatgccaaaattattaaaaataataattttgtaaattatgccataaaaataataatttagcaaattatgccaaaattattaaaaataataatttggtaaattatgccaaaattttaaaaataataactttgtaaataaggcaa

SEQ ID NO: 61172 - DNA, 146 bp, Heterodera glycines
  Genomic contig location: Contig_ID=SeqID_30778; Location=1379..1524; Strand=-
  SCN-specific regions: Sequence locations=1-123,145-146
gtccaggcctggattcagtttgaaggacctggattttttctggacttgggttttcctgggtttcggccaggaaatccaggtccaacatggagtctaggtctaggcttttttcaaaatgtcgagctctaagaattaccaaaaataaa

SEQ ID NO: 61173 - DNA, 93 bp, Heterodera glycines
  Genomic contig location: Contig_ID=SeqID_30784; Location=443..535; Strand=+
  SCN-specific regions: Sequence locations=1-93
ggattatctttcaaaacacctcgtagactgggggataattggagactgcgggattaatagagactgggctataattagagcatatacggtatt

SEQ ID NO: 61174 - DNA, 1478 bp, Heterodera glycines; identical to SEQ ID NO: 30786
  misc_feature (162)..(162): n is a, c, g, or t
  Genomic contig location: Contig_ID=SeqID_30786; Location=1..1478; Strand=+
  SCN-specific regions: Sequence locations=1-154,222-534,556-686,710 -745,775-971,1014-1478
  Gene Ontology: Mol. function=potassium channel activity; Cellular component=integral to membrane; Biological process=cyclic nucleotide metabolism

SEQ ID NO: 61175 - DNA, 329 bp, Heterodera glycines
  Genomic contig location: Contig_ID=SeqID_30790; Location=650..978; Strand=-
  SCN-specific regions: Sequence locations=1-253,275-329
atgactcactttgtgccatggattacgcaacggtaagcgcacggaacgggggaacatacggtcgaatgacatggccgagatatggtactggataagtgcgataccgtagtcatctgaccgattcgctgatcttacaaattagcacagtaatttcttttcagtttcgcgcatggcgtcgtggaaggtgagcaaaaactgtgcaataatctgatcatcgcaatgcttttgaccggattcattttgtaatttggcattgctttttctctccagtgttttagaattccatgaaatttttgatcaattaataacattgggagaaattcattaaa

SEQ ID NO: 61176 - DNA, 1214 bp, Heterodera glycines
  Genomic contig location: Contig_ID=SeqID_30791; Location=247..1460; Strand=+
  SCN-specific regions: Sequence locations=1-218,240-313,365-396,419 -508,533-747,798-947,969-1042,1064-1077,1101-1214
atgccagcgcctcgacgtccgcttccgactcgccttgtccgaccaattcgtccggaacaccgctgccatccgaggccggcgaaggtgagagaaccgttggcctactcccaccccccccccccctctcgaatttggacaaaagtcgacaacttttcgagacagacattcgactttttcttcgaactcgtcaccgtaattggacgaaattgacacattcacttttatttgctttctttttctacccattttgcccgattgagatgacaaattggatgcccaagaactgtttgatcggagctttgctgttgaggacgaggaggaagatgaagaggaggaagaagaagaccatgaagaaggggaagaatgggcggatggaggaggagaaatggaatatttggagagagaagaagaggaggagtgtgaaaataacgaacagcgaaaaagagtgtggattaattaatactaatgaatgatggttgaaaaggcaagggtacgagagaggggtactttcctttttatggccaagttttggattttaacaaattgaattgtaagattctttaaaaaatcattgccacatttggaccaaaaatttttatacggcttttctacaagatttaaactcttctgcctaatcaactcgtacaaacggactcgcctcccagtctcggtcgattttgtgctggtactcatccgcattatcttcacctcaaagcatatgaattcaacagtctttgcattcttccctatttttcattttattttaaaaatatttttgattaattttaaataattttgacacataaaactttctaaattatccaattcactttccaagtacaagattgcaattacccaagttcgtaacggggaaaatttgtgaaatccaagtgaacatgaaaacttaatcaaaaccgtaagccgaatgcaaaaaattttaaacttttaccataaaatggacattttttatattcagatgcaaaaccatttccaagtacaatcttggaaattcttcgccgtttttttaaatttcttacgttggatataaaaaatttcaaaatttatccaagttctctctttaaaatttattttaaaataatgcgacaagaaaaacaataactttttcccaatttattattatttcatttacctactatttcatcatttaatgagtttggcttttcgttggattactccaaaatttactcatttta

SEQ ID NO: 61177 - DNA, 871 bp, Heterodera glycines
  Genomic contig location: Contig_ID=SeqID_6333; Location=465..1335; Strand=+
  SCN-specific regions: Sequence locations=1-247,269-816,838-871
atgtcagacaatcgaaaagaagcggaggaaaagatggcaaaagcaatgtaaaatttaaaattaaaatgccaattttcaatttcaattttaaattttgtttcctttttcttcagcttcatctccggcgacggttggctttgtgtgtttgatttgctctctccgcgtcaacttggccttggaattgcgctgatcagccaccgctttgacttttatgtggacgaacatttcaaaacgcgcaaaagggcattggcatttattcgaattcgacgcaaaaatggagtgaatggcaccaaggaaatggaaattggcaaatattacgattggaaaccattgccaattccgcaaattcaattgccacgcaaagtcagcggattcggactgatcagcatagcgtaaaactggcgattatggcaaattaatgcaacatttcccatttcttttcagtttcattgaccaaaatgtcatcgcttttctccgccgttttcgccaacttttcgccaaatgtccaattaatttgtccatccgcaccaacactagtgattatcgcattttgaagtccattttgaacaacatttggccaatgctcaacaaaaacattcatggcttgcgattgtccgccacatttttccaccgtttgcgacaatttgtgccgtcaattctcaacgattgtccatcacttcgagttttctccatcgattatgacaatctcttcaccgaatttccatgcgatgacagtgccatggcatcggatggacaggcggtggccaaatggcttttcactccacgtccggacgatgtgccaaagttgttcaaatgcttgttgctttgtgatcgcgggcatttggcgtcgagaatcgaagccttcaaagcg

SEQ ID NO: 61178 - DNA, 1262 bp, Heterodera glycines
  Genomic contig location: Contig_ID=SeqID_6334; Location=678..1939; Strand=+
  SCN-specific regions: Sequence locations=1-209,231-710,732-1262
atgaagcggaggaaaagatgcggcgacgaacatttcaaaacgcgcaaatggacattggattttgttcgaatttggcgcaaatttgaagcggatggcacacaggaaatgaaaattgtcaattgcctttggaaatcgatgcaaattccgcaaaatccgttgccaaagaaagtcgtcggatttgaagccatcacaataaggtgaagcgaatgattttttggtgtttcctctgtgtaaaacgattccttcctcttttttacagatacatcaatgacaatgtgatcacttttcttcactgttttcgtccaatttttgccgcttttccaatcaatttttccatcgtcgatacctttgtgtcgcaaaattgaaagagtgccggaaactgtcttaacaagtgaaagagtgccggaaatgtcttatgcctcgacgaaatgtcatcagacaaccaaaatgaagcggaggaaaagatggcaaacgcgatgtaaaattaaaaatgccaatttaattttcatttttaaattttgttttcccattttttcagctttatctccgccgattgttggctttgtgtcttcgatttgcttgagccgtcacaacttggccacggaattgcgatgatcagccaccgttttgacttttacgtcgacgaacacttcaaaactcccaaagaaagtcgtcggattcgaagccatcacaataaggtgaagcgaatgattttttggtgtttcctctgtgtaaaacgattccttcctcttttttacagatacatcaatgacaatgtgatcacttttcttcactgttttcgtccaatttttgccgcttttccaatcaatttttccatcgtcgatacctttgtgatcattaacagcactttggattccgttttgcgcaacatttggccaatgattgcgacaaacatttgtgccatccaattgtccgccgaagttttccgccgtttgcgacttctcgtgccgtcaattctcgacgactgtccatcgcttcgcgttttcaatgcgtataatgatggtttcttcgtcgaatttccatgcgatgacagtgccgcggcatcggatggacaaacggtagccaaatggcttttcactccccgtccggacaatgtgccgaaggtgttcaaatgctggttgcaatgggatgatgggcatttggcgtcgagcattgaagacttcaaaagggtgattattgtttgactgatttggcacttttacgggctttgagggtcgctgacaaaaatattttggatggca

SEQ ID NO: 61179 - DNA, 343 bp, Heterodera glycines
  Genomic contig location: Contig_ID=SeqID_6335; Location=136..478; Strand=-
  SCN-specific regions: Sequence locations=1-343
atgaaagcaaatgggcaaaatgggaaaagaaagcgcttggatgggaaatttatgatcagtggaacaaaattggcattcaaattaataatgaggaccaaatcggagatgggtaagcgaatgctttttctaaattcaaatttattaagtatttttatttttaggcttcttgacgcaactcccggcccaagtgatcagaagaagtgaatgattttgttgaaaagtgatcgatcaatttagaattatggaattattgacatgctcataaaaattgttctttttactgttattggactgatcaacttgtgtttttgcaaaaaaaaaaaaaccgattttgaaaaataaa

SEQ ID NO: 61180 - DNA, 643 bp, Heterodera glycines
  Genomic contig location: Contig_ID=SeqID_6336; Location=1383..2025; Strand=+
  SCN-specific regions: Sequence locations=1-9,31-96,146-282,317 -516,538-549,588-643
atgtttacgcaacatttcttctcgtatttcaattcaaacatcgatatcaatttttatgagtaagtattagctagctagaaacttaaaaaatgaatgaatatatgtaaaaaaataataaacaagtgtaaattattttaaatattatcatcaacgaattttgcttcaaaaaattacatttattcttttcttaaattgcaaaatcattatttatttatgtgacataaaatgagtatgtaattgaaattgcttattacataatataattttataagatttagtcactttataacatttaaattaattatttttattataactgatacttttttaggttcgtctcagcacgaagaaaaacattgagtgagtcattgactaagggggacagatttaagtagagtagagcgggactggggcctggtactgaaaaaacgggacaactgagtacctaagccccggttttgaccgtgaccttggaccagtcccggttcctggttttcccagccaaaaatttccaattttgaacccgaaaaggtcccggtcgcggttttgcccaaaattcccttcccgctctactctatatttagaattggacgaaagcattccaacgggacggattctctttttggggagtttgaattggaaa

SEQ ID NO: 61181 - DNA, 1027 bp, Heterodera glycines
  Genomic contig location: Contig_ID=SeqID_6336; Location=2400..3426; Strand=-
  SCN-specific regions: Sequence locations=1-105,129-147,170-591,615 -937,975-1027
atggatattgtcaattgttatggaataccaataccaattcctcaaattcaaatgccactcaaaggtcatcggattcgacgggatcaacatcaagtaaaattggccaatgtcaaaattttttgccaacagttcccatccattttttcagtttcatcgaccaaaatgtcatcgcctttctccaccgttttcgccaacttttcgccgtctgtccaattaatttggccatcgaaacgaccaatgatcgcatttcgaagttcattttgcacaacatttggccattgctcggaaaaaacattcttgtcttggaattgtccgttggaattttcccccgtttgcgacaaatcgccccgtcaattctcaacgactgtccatcgcttcgctttgtgtcgctaatttttgataatctcttcgccgaattccctgccgatgacagtgccgcggcatccgatggacaagcattggccaaatggcttttcactccgcttcaaaacaatgtgccgaaaatgttcaactgttggttgcgatgggatgacgggaatttggcgtcgagcattgaacacttcaaagcggtgcttattatttatttagtactcattctgtggttgtcatttactacttaaccaatttttccacattttaggcatttaccaatgcttcatctcctgccaatttcattgccatcatttcgtgtccgttgccttttgctgattccgttgtgccatttgcgctgaccaacgaattaactcgcgaacaattggcattgaaagtgattgacaatagccatcgttttctgttcgtccgttgtccaatttcgcgagacgaaagcaaatggacaaaatgggagaaggaagcgattggctggagaatttcttatctatggaacagaattgacattgaaattaataaggatgacatcggagatgggtaaggcgaatgctttttcaaaaacccaattttattatgtattttttgttttaggcttctcaacgcaactcccggcccaagtgatcagcagcagagtgaatga

SEQ ID NO: 61182 - DNA, 427 bp, Heterodera glycines
  Genomic contig location: Contig_ID=SeqID_30794; Location=623..1049; Strand=-
  SCN-specific regions: Sequence locations=1-55,79-195,217-237,271 -351,373-377,401-427
atgaaaaaattagaaaaatcgtatatttatagtctgatgggggtgataaagtaattttcaatttttctgttttttgggtaatttggtaaacataaattaagggagaaaataatcaattgaactacataccataaacttaatctaataataatatgtaatttgaccagtacaaaaaaataatttaattgttttaaaatgcaaatttactattagcaaatttggcataaaaacggtttgaaaaaatattttatttgtttaaaaatataaattcaatttcagtttttataggaatttacatatttaccattggatttaattttaattgccttcggttgactcattaaacaaatgaaaaaattaaaatttaatttacctatgaaatttgttctttgataatcgtcattagttgaatcattaagcaaataaa

SEQ ID NO: 61183 - DNA, 64 bp, Heterodera glycines
  Genomic contig location: Contig_ID=SeqID_30795; Location=1060..1123; Strand=+
  SCN-specific regions: Sequence locations=1-64
aattactggagttagcatcatagcagtgcttttccttatgtttttgatgccctcgcaaaatctg

SEQ ID NO: 61184 - DNA, 821 bp, Heterodera glycines
  Genomic contig location: Contig_ID=SeqID_30797; Location=107..927; Strand=+
  SCN-specific regions: Sequence locations=1-506,528-615,639-649,687-821
atggaggcgaaaaagaaaaaattggaacaaaaaacattggaagaaatatttggagaaaaatgggaagaaaaagaaaatgaacagaaaaagagagaaattgttcaaaaattcaacaaaattaaagagaaaattaagcaaaaagagagaaaatattcaacaaaagaatggcataaaattgaattgaaaatagcgaaaaaattgggaacaaatcgaacaaaaatttatcaatggatcaaagaattaggaatatacaaaggccacaacaaatcaaaaacggatgtacaaaaaattgaaattgttcaaaaatttattacaatgaaaaatgaatataaacaaaaaggaagaaaatattcgagaaaagaatggaagagaaattatgccgtaattgggaaaaaaattggagtctgccatgatgcaattaaaaaatggaagaaacaatttggaatgaatggaagaagaataactgaaaaagaaaaaatggaaaaaatgaaaatgtattggcaaatgaaaggagaaaatccaaaaatgagtgacgagaaaatttcaaaaatgttgaaatttaatcgacggaccattttcaattggaggaaacaatttgagaagaattaaatgaggattaaaatattattgagataaaattgcattttccatttcttagagcctatttttggggatttttaagacataaagcctaaagctacctttcgagttattagtgtctatcctaagcttttattattagacctaaaagcctaaagaatttgtgaaagaacctatttttgcctattggcgttttgtcgaaatttgttaacaaaaatgca

SEQ ID NO: 61185 - DNA, 815 bp, Heterodera glycines
  misc_feature (10)..(10): n is a, c, g, or t
  misc_feature (23)..(23): n is a, c, g, or t
  misc_feature (120)..(121): n is a, c, g, or t
  misc_feature (207)..(207): n is a, c, g, or t
  Genomic contig location: Contig_ID=SeqID_30799; Location=106..920; Strand=+
  SCN-specific regions: Sequence locations=1-141,165-208,253-253,343 -348,412-425,455-491,519-735,768-776
tgtacccgcnccagtcaaactcnccgcctgacactgtcatcggtgcgggtcgccgggccaccgggtggcccgacttaacaccaaaatggacacccttgcgggcgcactcccgtttacgannttaagtaaggaatcgatgaaagtagtggtatttcactggcgccttgcggctcccacttatgctacacctctcatgattcttcacanagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaggaacagcaagcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcg

SEQ ID NO: 61186 - DNA, 64 bp, Heterodera glycines
  Genomic contig location: Contig_ID=SeqID_30800; Location=507..570; Strand=+
  SCN-specific regions: Sequence locations=1-64
aattactggagttagcatcatagcggtgcttttccttgtctttttgatgccctcgataaatctg

SEQ ID NO: 61187 - DNA, 1190 bp, Heterodera glycines
  Genomic contig location: Contig_ID=SeqID_30804; Location=73..1262; Strand=+
  SCN-specific regions: Sequence locations=1-355,378-382,405-765,787 -792,815-1190
atgcttgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgatacaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacatccgaatcaattaaatagcttctgagataataaggtttatcataaaatttcatttaaaaataaacactcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtctacagacttttggaaaaatttatttgcaatttatcaacaattttgagaagtgagttagaaatgataaacttcacgattcaaaccagttttcggtgctctaattaaccgcgataaaaacattcgaatcaattaaatagcttctgagataataaggtttatcataaaatttcatttaaaa

SEQ ID NO: 61188 - DNA, 811 bp, Heterodera glycines
  Genomic contig location: Contig_ID=SeqID_30807; Location=296..1106; Strand=-
  SCN-specific regions: Sequence locations=1-365,393-546,568-685,707-811
atgaaattgtgcgcacttttgagaccattcgccgagaagttcgatcgggaaaattggacagaaagtgagtttttagaaatagacaaatttttgaaaaaagaaaataaataatttttctaggtttgaaaaaattaaaacaaaattcagtgggggacgaacttcttccctgtgaaattgctgcatttattgttttgccatttaatttgtttgtttttctcagtgccattgacgtcgatttgctgtccgcccgcatggacacgcgcttttgtcgtccgctcgacctgttcatacggaccagcgaatgtcggctcagcgattttctaatttggcaggcaatcaaaaaaacagaaaattcaaattttcgtccctttttaaatttaatttttcataatttctgcttcagctccaatgctccccccgctgtgtgctaaaattcgacaccgacgtgctttggcccgaatattcgctgttccatctcttccgtgccgtcctccattatcaaatggcatttgtgcgcttcggatggtggacaatttgggaccattgaaacatttgattatttttgttgtttgaagaattgccaaagggaacttaaaagttttattatttattctctcattgccttttcgattacttttttatcattgtttttccctttgtttgtttttttactcatttcttccaatttgaaaagccttttttctttgttccgtttgacacgggagtaatcccgaaaaatcacaacgataatcgccttcagaggaaactttgaaggtttggcaggtttcgtcaacagattttgtcaattaaa

SEQ ID NO: 61189 - DNA, 457 bp, Heterodera glycines
  Genomic contig location: Contig_ID=SeqID_30810; Location=233..689; Strand=-
  SCN-specific regions: Sequence locations=1-163,186-236,258-457
  Gene Ontology: Mol. function=succinate dehydrogenase (ubiquinone) activity; Cellular component=mitochondrion; Biological process =tricarboxylic acid cycle
cggacaatgcaaaaaatgcggcggtgttcagaaccggaccattgcttcaagttacggcactgtccagaaggaacttacgaattttaccattttaaggaaggaattgagaaagttcgaagtctcttcgcacaacaaaaacgccttcgcgtttcggaccgcggattgatttggaattccgacctaattgaaacgttggaactgcaaaatctgctcattaatgccctccaaacaatcgtcgctgctgagaacagaagagagtcgcgcggtgctcacgcccgggaagactttccggtgcttttcattttgcagaatttaaatgttttaccatttcatttttgcttaggttcgggtcgatgagttcgattacacgaagccaacagaaggacaatcgaagaagaaattggaggagcattggcggaagcacagcataatttaccaaaatgtggagaacggagcg

SEQ ID NO: 61190 - DNA, 795 bp, Heterodera glycines
  Genomic contig location: Contig_ID=SeqID_30811; Location=54..848; Strand=-
  SCN-specific regions: Sequence locations=1-179,215-486,520-795
atgccaatttcattggcattattatttataagcggattggaattgtttatttggcctcatgtaaagacattgaaaattttaatgattcaaccgagttatgcgatgatccagagtcacttcacatttggattaaatttggcaaaattgttggtcaaaaatcatggacatgaaattgtatgtttaaaaacattaaaaataaataataaatttaaatgattaagcatctgctggtaccaattagagatgaaaatgacaaattgccggatcgaaatgatgaaaagctccttaatgttcgatattttatagagaaaaacgattacaataaaacaacgcccatagaaaggagcagaaaaattgggacaccgccaaatgacacgacttattttggtaaaaaataattatagtataaaattaacggtgtaaaatgctgaaaaatatttaaaccacaacacactcaatccttaattatatcattaattcttctgcaattttttaaaataatgtaaattataaaattttcaacaaaaatatttgaaatctggtaaaaaaaaattccctacagcaatagccaacaattcatcacttatggacgatttgtgtgctgaacagtttgatgttggaattgcggaggcatttatgatgacggaatattcaatgacaattttccattttttacgaattccagtcacaattgcgaccagcgcaatgccaatatcgccacaccaattttatttgcttggcattttgagcaaaatggccgcaggaaatgtgccgggtatgaaaacaattcattaa

SEQ ID NO: 61191 - DNA, 539 bp, Heterodera glycines
  Genomic contig location: Contig_ID=SeqID_6340; Location=291..829; Strand=+
  SCN-specific regions: Sequence locations=1-280,302-461,484-539
atgaacacatggccaaatttggttgggcatttgggacacgcacggcatgcccgggcgacaaatgccatcgatgaatatctctaattggaggaattatcttttctattctttaagtctaccccaacaaattttacgttttctttttggcgctttgtgacacaaaattcgccaaaaatgaaaaaaaaaacatttgaaaattagacacgcattatttcatttttttgttgatgccctaaatttgccaaaaaagtgtctgcccctaaaagatcaatcaataattttttctctgtcttccctgttgccggtttttgcgtgtctgtcccaattcaatcaatatttctgtcatttatttctctctctgttcagattgaggatgccatagcgtcggcgatcaatggcggtggaagtgcgaaggtgggcgaaggtggcggacattgcgctgctacgcaacgggcgactgagcggcgcgtcgtcgccgcgggcgccaacgacgactttgtgcggcgactggtggacgtggtccgacgcgagccggcact

SEQ ID NO: 61192 - DNA, 1371 bp, Heterodera glycines
  Genomic contig location: Contig_ID=SeqID_6341; Location=2188..3558; Strand=-
  SCN-specific regions: Sequence locations=1-396,418-631,654-821,844 -1276,1298-1371
  Gene Ontology: Mol. function=protein kinase A anchoring activity; Cellular component=integral to membrane; Biological process=eye photoreceptor cell development
atgcgtctgtacgactttttggccgacgatttgttctgcgtctcccccaacaattcgctactttcacccgcttcgtccattgtccgtcgtacgcacactgtgctcacactgatgcacacgctcaagcagttctattgggtggtgaggccgacaacggcgccaaattcggcacaaatggcaatggaaccaatggatcggctgaccgttgtgcacattcgcggatgcattttgcaaattgtcaaccgactgatgttcaacaccgtcccggcggatatcagcgagaaggaagtgagccgggacgaagagttccaatgcatgttgaactttgtgaacactgtgcaggaggtgaggcaatttgaatggcaattaagccatttgtagggggttgaaatttgattatggtgatatggcacatccgactggttttttagtaccattgttaatgcctaaaacggaacgcgaattgccctttccccccttttcaggtgccagcttttgatcgtaagaaggcgctttgtgtgattttcaaaatgatcagctccggcaatgagttgatcaggattccgacgctgaaaatgctcagttattttttgtgtcgttcgacccaaaagtaattaatattcatttccacaatttttccttttaaaatgtgcacttttttaggcgcaaaaatgaggcaatcaatcagaagaatttgttccatttgctcaccgaaaatctgttgctcaattgtcgttcgctcagtctggccacgtacaacgcactgtttgaaatgcttgtcgagccgatttgagaaccaaagctgctcaaccttgaacaagaaaaaaaaaattttttttttttgatgtcatctgtttgtcccggcacttgcggccccagacaaatgcatttttgaaaaaagtaaatagcaattaatgtcccttcgggccgtaaatgtcggggccccgtcatctgcaagttgttgaatctttaaatacataggatgagagtatatatcctattattttcttaatcgtgtatatgccgttatatcgttatacttatccatgcgtgaggtcacatcaaaatgggacctaaatcagtttcgtttagtcaaatcatcaacttgtgcatttcaaattcctttttgtcgtcttcgtactttgggccggatttcaaattcctttttgtcgtctgcgcaaatttctgggacggacttcaaatacaaatgttggttattatttgtcttatttcttcgttttgttacgttttggtaatccaaacgtgttttcaagactagaacagaaagaaaaaattaccaaaaagggggcagggcaaaatttactattaccatttgattctgtgaccattaaaaccccagggtgaaataaa

SEQ ID NO: 61193 - DNA, 1828 bp, Heterodera glycines
  Genomic contig location: Contig_ID=SeqID_6342; Location=43..1870; Strand=-
  SCN-specific regions: Sequence locations=1-647,669-764,787-822,844 -1054,1076-1332,1387-1423,1445-1549,1571-1828
  Gene Ontology: Mol. function=protein kinase A anchoring activity; Cellular component=integral to membrane; Biological process=eye photoreceptor cell development
atggcaaattcgaaagcagtggcattttataattgcctaaatctaatcggctttaagttcgggcacaccgattgcggaccatctgaacaacgcggacaaccaggtgttcatcgccaacaccatccatctgctcagccaactcggcgacagtctgacaatggcatgcggtggactgcttccactgttggccgccgcaacggcaccgaatgtaaagttgaaattcatttttaactaatatttacaattacaattggtgtctcttttctctgatagcaatgtttgtttcagagcgaattggaaatcaacgacaccacccagcaagagttggacattgaggacgccgcccgttttattgccacttttgccgaactttccgatgtttttgtgttcgcctcgggcgtcagtctaaacgaagtgcggccaaatttcattcattttgattttcttttaatcactggcaaaatcaaaaaaaacctttccattttcagttggagcaggagaaaaacatgccatcgggtggcattttgcgccaatcgctgagacttggtactgattttttaatgttttttactccaatttctttcacgcagtttccactgtaaccgttcgtaacattttggcgtgttcaatgcacaaagatggactgtacaacaccgacaattcgccaaaatttgttgcaattcgaaaatttgtaagtttagggggttgcaccccaaaatctcaccacccgtaatctcgccaaggcaaaacttctagccgaaatcttaaaaaaaattaaaattttatgtagagattcttcaagaaaaaatgaaaaatttttctagcgttttttcttaaaattattcttgaaatcaaaaaaactttccaagatagtttgaaaatttctttaatggcgtcgttttgtcccgtccccgtttaaagagattatgggtttaaaacttttgctcatttagtgcgagtcgtcgaagccaatctccgactttgaccgactgttacaaaatgttgacttgcaaaggctgaaaggtgtcatttacagggacatggtaatccagggaaaaaacaaataaatatttcaataattccattttcaaggaggagactaaacaggcccaattcctcgcgttggccgtcgtttactttctgtccgttttgatggtcagccgttaccgggacattcttgagccaccgctacccccgccggcttcacaagcgatcagtcctccgttggtcactgcgttgctttatttgggagtttcctatcagagtcagttcaaacacgaggccgagtcgaatttgccggacacatatcggaaggtaaagctaatcagtatgaaaaattgattaattaataaataatttttaattttcataaaattaacaatttttgttccgatttgttccaaataaactggatttactgttttagttctattttgaatcattttttctgttcccattggtccacccttttcacattttttcagcaattgttcgatgggcgtcttcacgactctctcgttttcgcttactgtcccaagaattgccatgaccaactttgtctgttccaacaacaaacgcccaaagggggccaactgcacagttccgccgcctcctattttgtccaagtgccacatgccgtcatgaaaaatgtcgagtgtccaacgatcggaatgccaatgactcatcaaatatcttttcagggagtcaaattggtcaaaacgcattccgtccactgctcgttgcattccatcggcggcatccaagtgttggtgccgctcttctctcaaattgatgccaaacagcacgaacccgtggacaatgacatttg

SEQ ID NO: 61194 - DNA, 544 bp, Heterodera glycines
  Genomic contig location: Contig_ID=SeqID_30813; Location=834..1377; Strand=-
  SCN-specific regions: Sequence locations=1-12,34-216,245-331,431-544
atgggcgacgccgcacaaaagcagaagaagcaattggacgcgttggtcgccgacatggcgcccgtcattgtcgacatggtcatcgcttgggcctcccgcacggcgtgggtccatcgcgcgttgggcgcctttgtgttgtgtcgtttcgccaaatggcttaactacggacattttgaaccaattttgaaggtcggtggtcaaatacagtcatcagcctgcaatttcaaaaaatttattaaatttcttggtaaagattttgaattttgactattaattatgcattttcctccgcgtttaggcctttgttgataaagatgccgaactgttgaaagaagagggggaggaggaggaagaagatgatgagaatgaggaagaagacgaaagtgaggacgacaaagaggaagaggacgaaggagtggaagaggaggagacgcccgacgtggaccccaaattggtggccgatgtgcgccgagcgatgggcaaagcggcgactccgaagaacgccacggaggtgccatccgatgaggacaactgggtaatctga

SEQ ID NO: 61195 - DNA, 563 bp, Heterodera glycines
  Genomic contig location: Contig_ID=SeqID_30814; Location=53..615; Strand=-
  SCN-specific regions: Sequence locations=1-371,393-563
ctcaaaagcttccagctcgttcacaatttttttattgatggcggacgaaaatttgtcagcaattgatggtaatgttttctttacattttcaatggtatatttgttttctcagaagggtgtctgcgcattgacaccaattcgccaaatggagaagtgcccgcaccaccgctaccaacgatgatggcccgctgtttgcccggggccaatgcggaggacacatttgtcgtcgacgtcgaaagtatgaaacttcaaatttattattagaaaaaaagaaaaatttttgcagatatatcacactcaattaatctggtgaattattcggacaccagcagcaacgagacaacttttacctggtaagaatggggggggggtaaaattttcattgaaaattataaaagctgttttgcatttcagcacaactgatcgtccaaaaagaaaagcggctgaaaaagccatgatgcttttgataaaaccgtaatggttttatcactcctttaattcgccttaatgtttttcctttcaggaaacgccaacgaaaaaacacatcagcggaagaaaaagaa

SEQ ID NO: 61196 - DNA, 181 bp, Heterodera glycines
  Genomic contig location: Contig_ID=SeqID_30816; Location=123..303; Strand=+
  SCN-specific regions: Sequence locations=1-139,162-181
ggagccaaacgaagtggacgaactttgggattacgacatgcgtttggtgtactttgtggccaaaaaacgtgtgctaaaggaccaaattgaacaggcgaaaaagggcggccacggaacagttgatttggaaaccgatctcatcaacattgaggcaagcaggggcacagaaaatgccagataa

SEQ ID NO: 61197 - DNA, 78 bp, Heterodera glycines
  Genomic contig location: Contig_ID=SeqID_30817; Location=27..104; Strand=+
  SCN-specific regions: Sequence locations=1-78
cgcttccaattccttctacaatcgcctttatacatcccattatgagcgctaaaattatcagagtgccgaaaatcgcat

SEQ ID NO: 61198 - DNA, 572 bp, Heterodera glycines
  Genomic contig location: Contig_ID=SeqID_30818; Location=14..585; Strand=+
  SCN-specific regions: Sequence locations=1-75,99-215,239-328,350 -392,414-572
tcactgtgcgcctgcagcccggcattctctgcccgtgttcagctgctcctccgccgggccctcccccgcaaatggcgccgccgccccctccgcctccgatgtcgcagccaatttgcatttgcacaccgcgtaccaactaaaaagtacattcgtccattgtatcattgcttcagttcaacaggacccgtgctgttttccgccgcccccgcaaatggcgccgccgccccctccgcctccgatgtctcaaccaatttgcatttgcacaccgcgtaagtgccggggagagggctttttgagggggtaagacgctatcttctattcaacaatgcagggcagcaggaccagtgctgtgccgggacgggccaagcgccgccccctccgccgcaaatggcgccgcccgtccctccccctccggcgccgatgtgttgcactccgatgtgctgctcgcccctgtgttgccctcctccgccccaaatggaaccgccgctccctttggcccctccgccgatggcaatccaagtcagtcagtggtgatgggcacaaattcgagagtggagttgaatgaatgctaa

SEQ ID NO: 61199 - DNA, 423 bp, Heterodera glycines
  Genomic contig location: Contig_ID=SeqID_30821; Location=1017..1439; Strand=-
  SCN-specific regions: Sequence locations=1-288,310-389,411-423
atgtttgatgagcctcggggagcaaaagtcgaaatggcacgacgagggggaaaaggtgaacagaaacagaggaacacagaacgaaccatcccctcgccactcatctatcagattgaggctggttccattgtttacgagtgccgtggggcgaaaatggtgccaatcggatgtttggacgaatttgggtgggacggggcggggagggcaaattaaatcataaatttaccatctatttgcaaaccaaaaatgcttattattagccaacaaattcgacttaatgagacgaccgtggcgaagggccttctgatgcgatgctcactttcgcgttgggcgaccgatttgcaattgaaaatcattggctgtgtgccgaagggaaaagcgaacgaaaccattttggtaggagagaaatggacagagaaagag

SEQ ID NO: 61200 - DNA, 1770 bp, Heterodera glycines
  Genomic contig location: Contig_ID=SeqID_7; Location=1568..3337; Strand=+
  SCN-specific regions: Sequence locations=1-368,404-595,617-775,811 -1399,1449-1499,1560-1770
atgagaaacacactgagaaacacgagaggggaagtgtgtgaaatcaggttcttgcctttggaggacaatgagcgtcccgaccttgtgatggagatcctcattcaacaccttctcgaccgtgtcttagatgggcacccgagtccaatcctagttggactgcagctccaaccgccggggtttgatcgaccctacgtgatccgacttcggccacctgaacaaaacaacgcggcagcacttgctgcagctatcgaaagactcaatgagcaatcggccgctggaatagacttgctttctggaacgaccgtcaccaaagttctcgctgtgtggcctttggaatccgttcgtgtcgatgctcagcgagggggttgataaaaaatttaaaattttgataaaataaaatataggtgcgtgcgatttggataacgaacatcacttatcacacaacgtgcagtcaatagttcgtgttgtgaaccccaacgatcgttactgcctcgcgcgtgctgttcttcttggactttgtgatcgtgagacacaaatgccaaatggaggtggtcgtggagcgttcaacacatacgcaagtcgtcaataccaacatgggactcaggccgttcatttgcttacaagagccggtgtttctgttgacaaacacatgtacacactggaggatgttgcgcaactccaacaatatatcaataatgagaatggggtaggacaaattcgccttgtaatcttcgaaaaggagcaagaataccgtattgtcttcaagggagaggggtaatatttttttgtttatctaaattaaaaaaaaaacatttgaagaactgcagcgcaattcaatttatgtatcctgctagaacgaggacacttcaactatattggacgaattgcacagctcttcaaggttcctggatactgcattgactgtgaacggagagcagatgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgaatatcatttggcgaatgatgcccctgctccaattgatgggcgcggacatagacaacggcgttcactttgtcaatggcgacgtttttgtcccacatgcggtcgtgttgcctattttggaatccatcaatgcccctcgatacgtcgtgctattgggccagttgattgctttcgttgcaaaggtccacatatgttggatgaaccttgctacatccaaccgattggtgttgcaccacctttaccaatgcttggtcctgttcacaacaacgacgacgacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgagcgagatgaactgctaccacttcgtctttgcttcttcgatgccgaaacatcccaggagcgcccactacagctcaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaaga

SEQ ID NO: 61201 - DNA, 1815 bp, Heterodera glycines
  misc_feature (93)..(93): n is a, c, g, or t
  misc_feature (99)..(99): n is a, c, g, or t
  Genomic contig location: Contig_ID=SeqID_8; Location=1..1815; Strand= +
  SCN-specific regions: Sequence locations=1-63,85-280,309-379,402 -668,690-1431,1453-1815
aaggacgatgcggcgactctttgaactcgacactaacccattggatggagcttcacgtcgtatgggggtgtgagtggaaagaacggctccgancgcganttggagctcaagcagcgtttcgaagcagtatttgtcccgtgtccattggatccacgaaacgatgccactccgtggtggtcgtacggagcccttcaaacttcatcatgtgtgctcagacgatgaagagatattgtgcattgatatagttagcctatatccctacgtcatggtgctttttctcaataaatttgaatttgaatttgaatttagaaggtgaatcctttcccagtggggaatccacgtgttctcacgcgtgaggtattgcttcatccaaccacggccccacttccctggacatgttcgtcaaataacatgttccggggacttttacttgtacgagtgctcgcaccgcgcctaattcgtgtcccgttgctgggctatcgcaccaaagatggacgtttcacctttccactctgtgcttggtgtgcggacagacgccagcaacgtccatgtcaacatggtgacgaaaagcgttcttgggtgtgcgcatacacgcacatggaattgaacaaggcacttcaactcggctatattgtcgttgatctctttgaggtacattaaaaataacgaaaaaaaaaatataaaaaaaaggtttggaactatgacgagtgggacgacgacttgttcagcaaatatgtcaatacattcgttggtctcaaagtccaagcgactgggtggccggaagggtgtgagacagatgaacaacgtaaagaattcgtggataatttcatgcgcacggaaggcatccaattagactcaacgaaaatgacacccaacccagggctccgcctcattgccaaaacattggcaaattctctgtggtatacgtttttaaacttctatttgaacaaaaaaaaaatgtttaggggaaaaatggcacagcgcgtgggtttcacgcagataaagtacacgcgcactccagcggaattccatcaactcttggacgatccaacattagacaaactggactttgtccacgtctccgagcatatggaccgagttgttgtcaggaagcgtcccgagtttgcaaaggcacccctcacaaactgtcttccagtcgcaatatacgtcacatcgtacgcgagacttcatctctattcatacatggaaaaagtgattgcactggaaggggctgagcttctttattgtggtttgcgaatacaatagaaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacggacctatgtcagtttttttttaattttcacaactaataattttaaattttagtgatgacgtcatcgacaacgatgatctctacgtgtacggaggaggtggagcccatcgttgcatccgagtaactttcccgcaaattgaccgaaatgtccgttctgacgtatacacctgcgaggcccacaaagactacagacctttctacgccaagggccgtgttcgaccgggaatgcaaacacgaccatttggatat

SEQ ID NO: 61202 - DNA, 705 bp, Heterodera glycines
  Genomic contig location: Contig_ID=SeqID_8; Location=2459..3163; Strand=-
  SCN-specific regions: Sequence locations=1-155,179-193,217-705
atggatttaattctcgccactgattggatgaataacgcttacccggaaatggaacaggacaaggctaacatgtcaccaaaggaagaccctagttggattagtctcattgatgaagaggaaaagcgggagcctatagctattgtgcaaatcgatgaggaagaggagaaacaaagaaaaagtttgtcttttagtgttattttttttaattaaaatttagatcctcccggaaattgcgactgtcgagagaagcgtcgttgctttattccgcttgttgaccacttgtgcaagaaatttgagtgttccgcccacgagttacacgtactcttcaaagacttggggaagcgtcgcgccatcgttgaacacctacgctcttctcaattgtgcacctcccacctgcgtccatcgatacggaatttcccagttcgctgcaacgatctctccattttggatgctcactcagtccctgcataccgtggttacctcggaatcacggtgtttattctttttattttttttatttctcaaaatattttaggttcgaatgcactattacatcaaacacggtattcgattgcgtcattcaaatttgccttgtgttgttgaatttggcggtggagatcataagactttcttcccattagaagctttgaatattgttatttagatgttttctgtatcaaattgtactgttgtttttaaaataaa

SEQ ID NO: 61203 - DNA, 1649 bp, Heterodera glycines
  Genomic contig location: Contig_ID=SeqID_8; Location=6054..7702; Strand=+
  SCN-specific regions: Sequence locations=1-574,598-1537,1559-1649
atgccatccaattctttttacattgttcttccttcaaatacaaatgttgaaggtaacaagacaaattcattccgggttcgtttaccacgaaaactacaattcaactccgaatgggaagttggactcgctgttattgtatatcctcatacttggccttcgattggtactgttgaacagcaatttgtagaagttgaatggcaaacaggaaatacggtgcgtattgaagtaccaccatcgaatgtcacaaatccaattgacttgggtaaaactctgtataggctcttgggcgaaggaagtgaaccgttagcaaaaaaggtacgaaccgcacagaattctttttcgcatgctacaaactctgctcgtcgtggggctagagaagaatacataaaacgaaaaacgagagagaaacgaagtattcgagatgaagaaaaacttctagaagccttattgacggacattgaaacaatggttgacctttttggtgtgactcaaggtcttttagcgcgtgagaagcgcgcggagacgagcaaaattccgttgagaatgtctgctgatgacaatgaatcataccaacataaattggatgaatatttttcaaatttaagtggtcccgatttggacatactcgaagaaatgatcagagcaaaattgaacgaagaaattaaaaatatggtagaggaggaccgtacaattcttgatgcaacgaaagaaatgggaatggaagcgtgggttcaagcgtaccgtaaagttaggctcgtttgccgatttatttttgatatcaacaaaaatcgtttcgagttaatatttgatcagcgatatgtaaggagggttaaaatttcttcacaacttgcgtatatcttaggctttgacagtacagattttacgacatcggaaaatgaagcaaaatttatgccagatatgaatggtggcgtatcatcttttcaagtttatactcccgatctcattgaaccaatgatgattggtgatgtcacagcaccagtgttacgcatcgtcacaattcgaggaaaacctgatgaaatagttgaagaacaatttttagcaatacaatatcacaaaattttaattaaggaaatttctgaactcctgatcgaaattcgtacaaatagcgggagcctaatgccattccaatatggaatatgtacattaactttacatttccgaaaactgtcctacttctgaagatgaataccttggaaattgataaaattttatcgacaagcccactcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtggtcgtcatgtgctcttctttttgtttaatagatgtctgggaactccctttgaaaagattgtaagatttttgcattttggaaaaacaacacctgacacacttgtcagttcttttgttacaagaata

SEQ ID NO: 61204 - DNA, 557 bp, Heterodera glycines
  misc_feature (543)..(543): n is a, c, g, or t
  Genomic contig location: Contig_ID=SeqID_8; Location=12271..12827; Strand=+
  SCN-specific regions: Sequence locations=1-22,45-94,125-129,254-557
atgaaaaccccaaatttcctcgccatttccattttcatttccatcggatttggaattgcaactccatctaatgaagatgaatgtaagattaatcatataaattaataaatttatataaattaatcccgttataaatatataattcatataaatttatataaattaatcccattataaatatatataaacttaataaatttatataaattaatcccattataaatatatataaacttaataaatttatataaattaagccgcgatgatgacaatcagcagcagaagcaatattgtgtgtccgacattgagcaggacccccaaattttgcatgagcaatgcttggatgccaaagagtggtccttgtccaacggattggtcaaatttattcaacaaaaaatgtgaaggatttcaaaagaaaactaaaaaagtagcaaaaatgcattaaaaaatatgtatacaatccggaaatactatattgtttcttttttgtcacatgttcttctctttttctgtctctttttcaaatgttttccaaaagattanatcacaaatagaga

SEQ ID NO: 61205 - DNA, 230 bp, Heterodera glycines
  Genomic contig location: Contig_ID=SeqID_9; Location=1158..1387; Strand=+
  SCN-specific regions: Sequence locations=1-86,122-230
atgctttttaaacagacagaaatttttatttttaagggtatttttgagaaactattaatcccgatttttatctcacagattgacgcaaatttataatagaattaaatataaataatttttaggaataatatgctttttaaacagacagaaatttttatttttaagggtatttttgagaaactattaatcccgatttttatctcacagattgacgcaaatttataatagaa

SEQ ID NO: 61206 - DNA, 661 bp, Heterodera glycines
  Genomic contig location: Contig_ID=SeqID_69; Location=246..906; Strand=-
  SCN-specific regions: Sequence locations=1-75,97-160,182-301,323 -325,359-386,409-598,620-661
atgccaatgaaagtgttggtgccaccagcgacaaaagcgttgccgataaccgttccattagccacaaaaaaggtggtctgtttggctgttttggtggtcaaaatggtaatgatagtcattatcatcatggcactgctggtagagaccgttcccgtgaaagggatgaacacaatgcagctttgtacggtgccgcaattgttggctacggtattggcgcagctggttgtggcggtgccggatgtggtggcggttgtggcgctcgttgatgccaattttttttttacaacaatttgtgcagaattaagaaaattgcaaaagaaaaacgaaaaaaatgaatttttttattaataaatttttagtttgcacaataaagattaaaaaggaaattttatttacaaataatgtttatttgtgtctcgtatgcgtcaatcatacagttattgtttttgtaaagtcggatacggtaatgggatggtatgaaaaactgagcatgtatttggctaggattgttcgtggattaatgagtgtaggcaattttctgaattttatcatcctcatgaatagagaccggatttgtttgaacaccaatatctatccgtaaatataattaaatatttttggctttttttcaatattttaaaatctgtgctttacaaataaa

SEQ ID NO: 61207 - DNA, 2636 bp, Heterodera glycines
  Genomic contig location: Contig_ID=SeqID_69; Location=2786..5421; Strand=+
  SCN-specific regions: Sequence locations=1-286,308-379,401-442,471 -565,591-639,661-783,806-845,873-998,1027-1120,1143-1237,1283 -1359,1381-1536,1562-2346,2368-2464,2501-2520,2560-2636
atgatcccagggcagcaaaatgttggcaccccattccaatacactaatccaaattgtcaaaacggtggtcagcagtttcaggcaatttattttgttttattttacttaagtaaaaccaaaaatttgtgtatttaaatttctttaattttatttagccaatgatcccgaccgcacttgggattcaccccatgtcttcagtgatccatggcactccttcagcgggcacatttcagccaactttttcaacagtgccacaggcaattcaaattcattaattaaaaaaattctttaaaaagtcagatttaattattcaaatgggtatttagcattttgtttctcatccttttgggatgggtcaattgaatggcgcctatcaaatgcccgggggttaccaaaactcatcgtctgcttcacaggcaataaattattcaagtcttttttctttaaatacataatttttaaattatttagcaaattgttgtacctccgagtcaaatgcctccgaatcaaatgcctcccccttatcaaaacgcctctcttgtgcatcaacaacatcaggcatttgaataatttttatttaaatttattatcttttgtttgttaatagtttgtgtccccagcaactaaccaaatgccgggaaatttccaaaatgcctctttcgctcaggcaatcaaataatataaatctaaccaatttttattagtctatttagctttttattccgtcagctcaagtctcgaataatttaccacacgctcaacacaataaccaatcatttgcacaggtttaaaaatcagattttaatgatattatcaaatctattataacatggattatttttgagttttaaaattaaaaaaataaaaataaagtttttctgcatttaaaaaaaatgatattgagatgcgaaaaatactttatttggtgctatattaattgagaaatttttaaagaagcgataaaaaaaatatcttgctaaagttgttgatctttgaacaaaaaaaaaattgtataattttaaaattctttagaagtttaagtcatttttagtcaaatttacttattaatgtttttatggaattttcgggattttttttgtaattacagaatctacggcaaatcaaaaaattaaagaaattttcagttggcgccggcattgcgtgccaacaacaatcaaatgatcacacatgccatggttggcccacaaaatgccgataattcgcagaatttgcaggcaaataattcaaaaaaaattgtttttataaaacatttattttttttgtttcttttagcccacgaattggtcaaatcatttgcctggtacccaacaaaatgtcgggccccatctttcaaacaatttccaatcacaacaacaacaaaattgccagaatcttcaggtagtgtattcttttttcaaatttaaattatcaaatacactttgtttttattaaaacatttttttgtttctttcagcccacgaatttgtcaaatttgcctggcatccatcaaaatgtcgggactcatctttcaaccaatttccaaccacaacaacaacaaaattgccagaatcttgaggcaaataatttcaaaattttcacaatttttgtttgaatttcaattttttcagcaatctcgccaattatcagaacaaatggtagtcccaggacttagcgaaaatggcacgacttcgtttgattttatggttaaatcggtctccaatttcaatcagattttaccgtaagaaatttacaaaaaattcagttctattaatttttttgtaggccaatacaattattcgtttcctctttggatttccgtgaggctcaattaacaccgaatggtccaatgcgtgtttgtaatgctatcctaatcaacggggagggaaagaccgttgaggtctcagcttggcgcttacaagcggatgtgttagcatcagccatgagaggctatttgtacattttcgtaaactgccgtgccaaaccaccgcgagaacggaccaattgctggttcagactgaacattgatgccatgagttcatacatggtacaggtccaggttcgagcgttgagcgtagcaaaaaaaaaatacgagattattttagccacatattgcagtgccacaaaatacaattgctcccgctcaaagccaaccgttcggttcaattatgcctaatgaaccgccggttaaacctttcttcagatttttaaattaaagtctattttcacccccagagatcacaaattgtcaattccggggcaaatttagtggctattcaaagccaacaaaatgaaaattccgtgcctatcacgcaatctgccccggtaaaaagtgttgtatttcagacaatttgatttttgaatttaatttatttcagtctaatcccttagctcatgatcaaattttggtgcccagtggggcgaactcgcatcacactgatgagatagtggaggtgttttttatacaaataataataataataataataataataataataatggcttttaagaccattttggattaaaaacttttttttaatttttaaataacaaaatattcttgacttttcattttttttattgaaaatatattcaaaaaaagtaattccttatgaagttgttttgaaatatagaaa

SEQ ID NO: 61208 - DNA, 445 bp, Heterodera glycines
  Genomic contig location: Contig_ID=SeqID_69; Location=7794..8238; Strand=+
  SCN-specific regions: Sequence locations=1-150,172-414,436-445
atggcgcgtcaaaatctaaacgaatgctttgtccttgaaagaacgacaccaatgagaaatgttatgcgcaacacgaggggagaaatttgtgaattgcgatttatgccgcttgaggaagcgcaccgtcccgatctcgtacttgaagcactcatccagcatttgcttgatagagttctagctggccatcctcgtccactcatggtcggattacaacttcatccgccaggattcgacagaccatatgtcatccgactccgtccaccggaacaaaataatgcagcggcgctcgcagctgccattgaacggctcaatgagcagtccgcggccgggattgatctactttctggcacaacgatcacaaaagtgctcgctgtgtggccactcgatcccattcgtggcgatccgcagagaggcggtttttaaacaaattttattctaaagatta

SEQ ID NO: 61209 - DNA, 4205 bp, Heterodera glycines
  Genomic contig location: Contig_ID=SeqID_69; Location=8385..12589; Strand=+
  SCN-specific regions: Sequence locations=1-496,528-905,927-1633,1656 -1799,1821-2131,2153-2188,2210-2631,2656-2745,2768-2994,3016 -3157,3201-3315,3338-3498,3520-4205
atgccaaatggaggtggccgtgacgcactccgtgcgtacgttagacatcaaaatcaacatggacctgaagcggtggctttgctgaggcgctctggaattccacaccacaaggacatgtacacgctgcaggacgttgggcaactgcaacggtggttgaacaatgcttatggcattgggcagattcggctcgttgtatttgagaaagagcatgaataccggatcgtgttcaagggagaggggtaagccttggttattaaaagtataaaattttcttgtccaaagaagtgcggcacaattcaatctgtgtctcttattggagcgaggccacttcaattatattggccgtattgagcaaatttttgacgtgccaaactactgcattgattgtgagcgcagagctgacgcgcgttatcattcgtcagggtgcaaaattgtgtgccgtctttgtttgcgatttggacctggttttccatgcaaaacagaaaatgtgaaattgtttttaaaatttaacaataaaatatatatttcagcttccaaacggcgtgacgagcgcgagacaatgcgcagagtgtctcttcatttttccgaacgacgactgtttcaactatcatctcgtcaatcgtggtcctgatcaaattgatggacgtggtaatcaacaacggatgccaatttgtcagtggcgtgaagtatgccgtttatgtggacgtgtctcctatattggaaagcatcgctgtcctcaagttcaacttggtgatgtttgtcgacactgcagaggccaacacaacgctgatctaccatgttttatccagccactcatggatagacctcaaccaatcaacatcatcgacgatcaagaggcgcatgacaatgaccttgtcattgatgatgatgaaaatgacgacgaattgccgcttcgtttgtgcttcttcgatgccgagacttcgcaggaacggccgctgcaattgaacaaccaagtggctcagaagcacgtcccattgctcatcgtcgcagaagtcatctgtgatccgtgcattaaggccggaatcagtgtcaatgacggtttcgaaagaagagcgcctggttgtgtttgtctatgtggaagagtgagggggcagcaaatgcgtcagtggtcttctccgccgtttgcaaacgcacatggagacaacacaccaactccagatggggcgccgaccttcaatcaacggcgcttctatttccattcttttgacaacggagaagctgaagaccctgtggagcaattcttggtttttttgatgaaccatgggtcaaggaaggcgcacactgtatgcattgcgcataacggcgggaagtatgattttcatctcgtactcgaggctctccatcgccgaagttacccgcctaaacggctctgcaccactggactaaaaatttattcaatgaagctttgtggccggaatcaacgccgcattacgttcaaggattccattaattacttcttctgtgagcttgatggactcgtgaaaagtttcgatctaccagctcacttggcaacgacaaagccatttttcccgtatctgtatatccaacggcaaaatctggttaatcgtctccaaggacttccgggtatagaattttattcaccgaatacaatgaaggaggagaagcgacagaaatttttgcgatggcacgccgataacaatgagggagcccaattccaattacgagaacagctcattatgtattgcgtaaacgacgtggcaattctacgggagtctgttctacgctttcgacaactcatcggagaacacacacagggattggatccctttttggtgtcgacaacggctgctgggttagctctggccacactccgtcgctgttttttgccgccgaatcggcttgtgcactcgccagagggtggatatctacgtggacgacgggcctctgccgaatcgagacgttacatccgcttctttgagatggaacaccccggagctcaagtgcagtgcgcggattggtcggtgggcgaagcacatgtggatgattccggataccgactcgacggactttggcgtcgagacccaccccttcgtccacttgccatcgaatggatgggatgctattaccacggtagttggttgttgtctgtttggtagaaaatagaaattataagggtgcccaaagtgtttcccgaaccggtggcagaagcttgccgcggggcgaaccgctgaggacttgttcgagaggacgacgcgaaggctttgggagttggaacatcagcatggattcgaactacacgtcgtctggggctgtgcgtggaaggagcagctccgccacgatccggcgctgaagcaaaggttcgagcaagtgttcgtcccatacccactggatccacggagcgatgggttgcgcggaggacggacggagcccttcaagctccaccatgtgtgcgcagatgacgaggagatcatctgcatcgatattgtcagcttatatccatatgtcatggtgaatttctctttaatgctcttctcaatttcgtttttcacttttagaaggtgaatcccttccccgtggggaacccgcaagtcatcacgcgcgaagtgctcctccaacccccgactgttccactcccttggaattgtgcggaaaacaacaccttccgtggtttgctgctgattcgggtcctccctccgcgacacatccgtgtgccattgctgggctaccgcaccaaagatggccgcttcacctttcctctttgcgcttggtgtgctgaccgccgacaacaaaggccatgtcagcacggagacgacaagcgttcgtgggtgtgcgcgtacacccacgatgagctgaacaaagctctggggctcggatacatcgtcactgacctctttgaggtaaatttaagatttaaatttgtttttttagctaaagaatcaaataggtctgggactacgaggagtgggacaacacgctcttcagctcctacatgaacacctttgtggggctgaaggtgcaggcgagtgggtggccggaggggtgtgagacggatgagcagcgccgagcgtttgtggatgacttcatgcacacggagggcatcgccatcgacccgaccaaaatggcattcaatccgggacttcgactcatcgccaagaccttggcgaactctctttggtaattatttttattttttcttttaaaaataactttaattaaaaggggaaagatggcacagcgcgtcggctacactgagatcaaatacacgcgcactccagcggagtttcacaagctcctggaggacccgacctacgacaaaatggactttgtccatgtctctgacaacatggaccgagtcgtcgtcaggaagcgccccgagtttggcaaggccccggcaaccaactgcctcccagtggccatttacgtcacatcgtacgcccggctccacttgtacaactacatggagcaggttctggccctgggcaatgctgagctcctctactgtggtaatttttcaaatttgtaattaaattacgtaataaaatttagatacggactccatctactacgtcaacaagattggagcaccgttcgtccaggagggggaagcattagggcaaatgaagcgtgagcttgtggaccgccgaattgtggaattcattgccggaggaccgaaaaactacggcatccggcacactgccagagacggaactgatgaacgtgcgaacatcaaaattaggagttttcgattgtcgtacgccactcaacaattgctaaattttgctgctgtgaaggaactgacgttggctacgtataatatcgacggacccatgtgagttgcattatatttgtaaaaatgaaaaaaataaaaatcaagtgatgatgttttggacaacgaagacttgtatgtctatggaggcgctgaacaccgcgccatccccatcagctttcctcaaattggtcgcaatgtttacgccgacctctacactcacgaggctcgcaaggattatcggccctactacgccaaagggcgcgtgcgtcccgggatgcaaacccgcccctttggctatgtagaggaggaagcccgactcattcgccaaacacaaatggtgcaccaacaactgccacccgcatcttctccaccacaaccgaggcccgaacgaagaaagaggcggctaattgagcccgatcccacccaggctggccattctgggtggttttcataa

SEQ ID NO: 61210 - DNA, 1187 bp, Heterodera glycines
  Genomic contig location: Contig_ID=SeqID_69; Location=12625..13811; Strand=-
  SCN-specific regions: Sequence locations=1-46,81-486,514-600,624 -631,653-1187
  Gene Ontology: Mol. function=general RNA polymerase II transcription factor activity; Cellular component=transcription factor TFIID complex; Biological process=transcription from Pol I promoter
atggacttaattcttgctactgattggctgaacaatgcgtacccagaaatggagcaggacaaagaaccgccaaaagaggacccgagttggattagcctcattgacgaggaggaaaagagagaaccactcggggcaattggagaggagccaataacaagtttgaataaattttcttattaaaaaaaaaatgcaagtttagacacgccaaaaaagtgttcttgcaatgagcatcgccaacgcccaatccctcttgtggaccacttgtgcaaaaaatttgaatgctccgccaacgaattgcacgtgctcttcaaggatttgacaaagcgccgcaaaattgttgaacatttgcgctctgctcaattgcgaacctcccaccttcgacccacaatccggaacttccccgttcgatgcaatgatctctcgattctggatgcccactcggctccagcttaccgagggtacctcggaatcacggtaatttgatgcaaaatttttatttatttggaaatatttaggtgagaatgcattactacatcaaacatgggatcagattgcgtcatcccaacttgccatgtgttgtagaatttggaggcggagatcacaaaacattttttccaattgaagttttgtctattattatttagatgatttccatatctaattgtactgctgtttttaaaataaatgttcgtccgtttactcctgaacagtttttaacaattgctcaacgtggaataaatactgagtataaccctcgccgttttcatgccattatcatgcgtgttcgcacttctgccaaaactgtcgcagctcttatttttcaatcagctcgggttgtcctcaccggtgtttcccacccagacagagccaattactttgctcgaaaaattttaagaagaatacaacacactcaaaacaacacattgaaaattcatcagctgcgggtggtcaacattgttggtgtgaaaacttttgctcaacgaattagagtcgaaagacttttgacaactttgggtggcatttacgacccatcaatttttccggccttacgatgtaaaatggaaaatggaactacttgtttaatttacatatcgggaaaagtgattgtcaccggcgccaagaatattgaagaattgagtgatgcgtttaaatttttgtcaaatattattccaaactattttcgttaa

SEQ ID NO: 61211 - DNA, 1058 bp, Heterodera glycines
  Genomic contig location: Contig_ID=SeqID_69; Location=22936..23993; Strand=-
  SCN-specific regions: Sequence locations=1-520,542-1006,1048-1058
  Gene Ontology: Mol. function=protein tyrosine kinase activity; Cellular component=integral to membrane; Biological process=receptor guanylyl cyclase signaling pathway
gcaaattgcggaccgtctgaagataggccaaaccgtggagcccgagcagttcgatacagtcaccgtattcttctcggacattgtccaattcgcggcactgtccaaccaaatgcggccgctgcaggtggttaatctgatgaacgaactgtacactacgctggacgccatcattggcgagcatgacgtgtacaaagtggagtccatcggtgagaaaacacaccaaaaattatttggtttaattccccttaattacaggcgatggctatttgtgcgtgtcaggactgccaaagcgaaatggcaatttgcacgccaaagagtgcgcggatatgtgagcagcaattactaattgaattaattgttaatagtcatcaatttgctcaggtcattggactttttgaaagcgtttcacactttccgaattcccgaccttccaaatgagcgcgtccgtctccgaattgggctgcacagcggcccatgcgttgcgggagttgtcggtatattctatgaaaatggtataaaaacagctgacgatttaataaaaggcctggccatgccccgctactgtctgtttggtgatacggtaaacaccgcctcgcgaatggaaagctcttcaagccgtcagttttgtttgtcaaatattctcattgggccatttaagctaacaaaattcacatctccaaagcgacgcacactttgttgagcacaaatttcaacggttatcttttggagagcagaggcgaagtgatcattaaggtcgatcagaccgataaactgttaattaccgatgactaatgagaaattttacgagtaaatgcattcagggaaagggcgtcatggagactttttggctgcttggccatgccgaaagcggcacgttgccggcacataattcgcatgaagggcaatcgatggcacaaagaaatgccgaagaagacgagagggaaatgtacagaacttatagaaagacaatgacaggacaggacaaagatggggaacaaaaaaatggagatgaacagcagaaaaagcagcagcagaacggaggaggagtgatttattga

SEQ ID NO: 61212 - DNA, 840 bp, Heterodera glycines
  Genomic contig location: Contig_ID=SeqID_70; Location=226..1065; Strand=-
  SCN-specific regions: Sequence locations=1-149,171-183,225-239,262 -403,427-840
  Gene Ontology: Mol. function=protein tyrosine kinase activity; Cellular component=mitochondrial inner membrane; Biological process =cGMP biosynthesis
atgcgcgggtcaatcagagatgtgatcttgtccgaaaatgccatggtcaaagatgtgatgttcatccaatcggccgtcaaggagctttgcgaagtgagagatggatttattttgttattgagggtaattaaataaattggcaatttcttaatttaaaattggttttattccaaggaactcacgaaaattaaaattattaatttcaaaattataaaagtaaaaaagcgttttttccccctttccagggccttcagttcttgcacaattcgcccctccaattccatggtcggctgaaatcctccgcttgtttgatcaacgaacgatggcaagtgaaaatctcatactttgggctccgatggctgaaaagtccacaaaaaatgcaagcaaaaggtgaaaaatttacaataattaatcaattaattaattcttttatagatcttttatggctgtctcccgaacaattgcgaaaagcgacggacggtgccgaaataaatgtggccgtgggctcaaaacagtcggacatttacacaatggcattaattttcacggaagtacacaaaatggacattaactcattgtctaaatttgcacatttatttgccatttccgatggtgaacatggccccgtgttgggaggagggccgcgactcggaggaggacttcggcgcggcgcgcgacttggaagagatggggcggagcagaagcaccgcgacgcggcacaccgcaggcgcaacgctcggacgcaacgcggacgaaattgcctatttggtgaagcggggcggattggtgccattgagaccgatgatacggcccgcgttggacaatttgcacccggaattg

SEQ ID NO: 61213 - DNA, 1324 bp, Heterodera glycines
  Genomic contig location: Contig_ID=SeqID_785; Location=75..1398; Strand=-
  SCN-specific regions: Sequence locations=1-23,49-571,594-1088,1110 -1224,1251-1270,1296-1324
atgaacagacggtaatgaattcttttgaaaaattaaattttcattttccatgcaatttttcccatgtttcagttggatttgtgcggatgtttggatggacattctgccatcttttgaccatgcccaactcggactcaaaatggcattgctttcctatcgttttgatgttttggtggacacgcattttgatggaaaaagcgaattgacaatttggagaacaatcagaattgtaaaggacgaaggaccaaatgcaaacgataatggaccaaaaccgaaagtgtctgtacggatcgatggcagttttgtggattttccgttgtcggatcgtcaactgcccaacaaaatttgctttaagaaccttcatattcagtcagtcttaacttttgtgtacgctaaagcattgttctcttgctttagctacattgaccattccgtgatcaaatttttccgctccaagaagcgattctttgacaaaagtggcaccaaattggaagtgtttgtgcattcaattgatacggatgtccaaccgatttgggatgtttttacccgcgaaatttggcctatttttgcgaaaagcattcgtcattttggctttcacgatggcgatgatttggacaatttgcgcagtcgcatttcaccgacacttctcactgatcttgatcaattgatttcaatcgattccggttatctgtgccccgatggaattgctgacgatgggccaaatggaaatgctggtcaagcgttgaccaaatggcttcacactccgacaaaaaatggacaaccaaagcaattacgtttccgtgcttatgtgagtccaccaaatttcgaatgggtcaacaacttcaaagaggtcgtctcgccagaattttcgtcaaattgtttttattttaccaattttgtttagacatttcgccgtgccaccacttctgtcagttaccaaattcaactttattttcgtgtggaaacaatgccaattgcgccatttgaattgatgaacgaagtgacgaaagaaaagctgacactgaaacaggagatcgacgaattcgacttaaatgtgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcagcaatagcatttgaattttatcgaaaaataaaatatttaattaattttaggccattgtcgccaccagcggaagaaaaagaaggagaagaagaagcggatcaaagcaacaaaaatgtcgtctga

SEQ ID NO: 61214 - DNA, 2064 bp, Heterodera glycines
  Genomic contig location: Contig_ID=SeqID_785; Location=4746..6809; Strand=-
  SCN-specific regions: Sequence locations=1-12,42-876,917-1196,1218 -1350,1372-1383,1412-1427,1455-1815,1837-2064
atgaaccgacggtaaggaaatttttgaaaaattaaaattttcgtttccaatttttcagttggatttgtgcggatgtttggatggacattctgccatcttttgaccgtccccaactcggactcaaaatggcactgatttccgaccgtttcgacattttagtggacaaacattttgatggaaaaggcgaattgacaatttggaatgacattacaattcgaaagggcatggaggacgaggaaaaaattggagcaaaagcgaaactatttatgcaaatcaaggacaacaaggacaaatttgtggaatttccgatgcaggaccatccgttgccaaacaaaatccgatttatggaccttatgattatgtaattcaaaaatttctgtacagaagcgaccaatttgcaatcatttgtgttattgtatcatttcccccttttcaggtacattgaccattctgtgcttgcatttatccgtgtcaacaaacaaatttgggacagaatgggcaccaatttggagttggaagtgtattcatacgaaacggatcaaatttgggatgtttttgtccgtgaaatttggcccatttttgcgacaaacattcggcatttggcctttcacggtgccgatgctttggacaatttgcgtcgccgcatttcaccgacacttctcactgatcttgatcaattgtattcaatcacttcctatggactgtgccccgatggaatttctgacgatgggccaaatgcaactgctggccaagcgttgtccaaatggttgcacacgccgagcaaaaatggaaaagcgaagcgattgcgttgcaatgttttttcaaattccgaatgtgtcatccgatcgatcaacaatttcagagaggtgatctgtcatattttcttttattattattatttttatttactaattttgtttagacatttctccgtgccactgcttcggtcggctacaaaattcgtattgtcattcgctctgtcagttaccatattcaactttttattcatgtggaaacaacgccaattgaaccatttgaattggtgaacgaacggaccaatgagaagctgacactgacgaaggatgaaaatggcactggtgaattcaattggctgttggagagatgcccaattattggggagacggcggcggttcagaaacaacagcagaagaaggacgaaaattcggatgccaatttgaacaaagtcttcttccgcctttacgatgacattgggtgagcagaaaggaggccttttttgtataaaacacggatagtggacggtaattggggtgccaatgccaatttgaaccatatccgatttgatctgtggagtttcagtcaatccattgggtgagcagcaaaaacagcaatttttgatttgtctaaaaataaaaaaacttaattaattttaggccattgtcaccaccagcggaagaggaagaagaagaagcggatcaaagcaacggagattaattgcttttaagaaatgatgagaaacgacagatctcaatttgatgctttttccctgtcacaaatgcttttgttgattcgttcgttccaattatataaaacatacttttgcctcaaaatggcattgaagaccaattttgtttggatttttgctgaaaatttctgatgtaacgtcgcgcatgaagtttttcctgtcagttagtgttttgtcgtctaagttcatttgaaaaatgatttcatgcccagtaatacgaaaacgcgaatacattaaacaattttaaaatttttcacattcgaaaaaaacttgttttgagtgacaaatgcgctcactcgaaaaaagtgccattgtaaaaaccaattgttggtcttttgccatcgggtccactgcgtttcggcgctcccgtttcggcgccagcatgtttttggctataacttttttctttgtaaaccaaatccaacattgttggtgtcgttcgaaagctaatcaatttagaagctttttctaagctattgctttgcgattagacaattatcaaaaaagttatgcatgaaaattgcgaaaagtcaaaatttttgaagttttttcttaataaa

SEQ ID NO: 61215 - DNA, 1341 bp, Heterodera glycines
  Genomic contig location: Contig_ID=SeqID_785; Location=7176..8516; Strand=+
  SCN-specific regions: Sequence locations=1-265,301-352,374-395,417 -666,689-1341
atgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaatttagcttttttgagcccaaacccgaaaaaattttcaaaaaatcattttttcgccaaaatttctcgagaatattgaataaatttaaattttcttaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgcgatttttggtccatattttatggccatatttcgcgattttagatccatatttttggactccctagtaatttcaattacatatttatttgtttatattaaagcatttttatttattttttcagctacattgaccattccgtcattaaatttctccgtgccaacaagcaaatttgggacagcaaaggcaccaaattggaacttgttgtgtacgtagacgaatttgaaaatgatgaacagccagtttggcattgtttttcctatgaaatttggcccatttttgcgacaaacattcgccatttgagcatttataatgccgatgctttggacaatttgcgtcgtcgtatttcactgacaattctcactgatcttgatcaattggattcaatcaattctggtgatctgttccccgatgcaattgctgacgatgggccgaatgcaaattcttctggccaagcattgcacaaatggttgcacacgccgagaaaagatggacagccaaagcgattgagttcctggagttgctcgtgttttagtctcacaagaataaacacatggttctacaatcataaacaggtcgatgattgatcatggaattttttctttcaatttctttttttactgtgctaaaaatgactaaaccctcaagaaactgcgcggctaagcatttaaaccgctttttgggaaggtttaaaactcgaaaaatggacaaaacaccaaaattaattggaaatcctaaaaaaaaaaaaa

SEQ ID NO: 61216 - DNA, 848 bp, Heterodera glycines
  Genomic contig location: Contig_ID=SeqID_785; Location=8752..9599; Strand=+
  SCN-specific regions: Sequence locations=1-358,515-848
atgttaacaacgcaagttgagccatttgaattggtgaatgaatggaccaacgagaagctgacactgatgaagaaaggaccatatcattcgctgttgaagcgatgcccaattattggggagacggcggcggttaaatgggaagacgacgaaaattcggaccatttgaatgcatttttcatccgtcttggtgaaaattgcattgggtgagcagaaaggaggccttacttttgtatagagcacagacaggatttgagacagtattctctgtacagtactttctccaaatcttggcagggccataggagtccctgttaaaacgggtgcccccaaaatcacgccgccgaaatgacgccgctagaaaattaaaaaaatatttttaaatttagaaaaaatttttataagaaaatttcaagaaaaattaaattttttggaaaatttttcgaaaactgtaatttatataaaattttaaaaaaaacactgaaaatttttcaaatttttttttctttaaatttttcttattcgcttcgctctttggtttgtctgtcctattataatggtccatcttgggaaaactctggtcctaaaccagggcttcgatatctgaggatttttcctcattttgtggtcttttagagggtcaaagaggattttttttgaaactgacgatttgcggatttttgtggtattttgagaaatttgaggatttttgtggtcttatgattttttgaaaaattaggtatatttggcaaaatgttcgaattttttcgtcaaatcttatttctttacgaaaaatcttcattttgcaataaattttaattaatttcctttagatgattttacaaaaaaaa

SEQ ID NO: 61217 - DNA, 351 bp, Heterodera glycines
  Genomic contig location: Contig_ID=SeqID_786; Location=202..552; Strand=-
  SCN-specific regions: Sequence locations=1-351
atgaatcgacggtaaggaattttttttaaattacaaaattttcatttacccatacatttttttacgaatctcagttggatttgtgcggatgtttggatggacattctgccatcttttgaccatgctcaacttggcctcaaaatggcattgctttccgaccgtttcgatgttttggtggacaaacatttcgatggcaaaagcgaattcacaatttggagaacaatcagaattgaaaagggcgaaggcccaaaagcgaaactgtctgttctgatcgatgacaaatgcgtggcatttccattgccggaccatccgttgcccaacaaaatccgttttaaggaccttcagatttag

SEQ ID NO: 61218 - DNA, 59 bp, Heterodera glycines
  Genomic contig location: Contig_ID=SeqID_786; Location=1..59; Strand= -
  SCN-specific regions: Sequence locations=1-59
tggactgtgccccgatggaatttctgacgatgggccaaatgcaactgccggccaagcgt

SEQ ID NO: 61219 - DNA, 946 bp, Heterodera glycines
  Genomic contig location: Contig_ID=SeqID_786; Location=1084..2029; Strand=-
  SCN-specific regions: Sequence locations=1-14,52-350,379-894,916-946
atgaacagacggtaagcaatttcttttaaaaaattgcaaattttcatttacccaattttcttatgtttcagttggatttgtggtgacgtttggatggacattctgccatcttttgaccatgctcaacttggactcaaaatggcattgctttccgaccgtttcgatgttttggtggacaaacatttcgatgcaaaaagcgaattgacaatttggagaagaatcgcaattcgcaaggacaaaggcccaaaagcgaaactgtctgttctgatcgatgacaaatgcgtggcatttccattgccggaccatccgttgcccaacaaaatccgttttaaggaccttcagatttagtaaatcaaaaaatatacagaaaaccaatcttcatttttccccttttcagttacgttgaccattctgtgctcgcatttcttcgttccaacaagcaaatttgggacagaagtggcactattttggatttgaatgtgtatgcatttgatacggatgtccaaccaatttgggatgtttttacccgcgaaattttgcctatttttgcgacaaacgttcgccatttgtgctttcctaatgccaatcatttttacaatttgcgtcgtcacacttcaccgacacttctcactgatcttgatcaattgaatttcattaattctggtggtcttttacccgatggaatttctgacgatgggccaaaagcaactgccggccaagcgttgtccaaatggttgcacacgccgagcaaaaatggaaaagcgaatgaattgtattgctgtgcttatttttgtgaaataacatggatcaacactttcaaggaggtgatcgagctacttaattgttcattaaacgattgactaattattgattgattgcatttgattcgtgaccggaaaatcggtcagtggaaaatgcgtcagtgatacaaatattttaaaataaa

SEQ ID NO: 61220 - DNA, 1921 bp, Heterodera glycines
  Genomic contig location: Contig_ID=SeqID_6343; Location=897..2817; Strand=+
  SCN-specific regions: Sequence locations=1-213,235-382,404-455,477 -662,687-728,750-770,811-910,1038-1236,1259-1426,1474-1639,1704-1921
atggaatatttcagctctttcgttgactcttcagcaatggaaatgcaaattttgagcaaacaaagagagaattatgaagattttttctatttcctggcaaaagttttgagcaaatttggtggaaaattgacaaaaaatgagaatagggaacaaatcgaaattggcatcgatggggccaacaaaatattggaaagtttgaaaaattatgccgagaaaatgttgataaaaaaggctagagaatggcacccgtactacgagtgccaagcgaagaaaaaattggagcagcaaaatttacaaatggcagccgtcgaaattatgtgcccaaattttgtggacagtgccgaaatatttgaaattttaaacgggcaaaatgaattgtttaaatctgtgccaaaaagtgaaggaaatgatgaaaaagttgaccctaaattggtcaacaattcgcaactgttcaatttgttgtattcatttgtgacacgaattgaggcgataatttacggcaaaaatgccgatgggacaattattagagaggaaaaagcggcaaaaaaaagagaaaaaaatggaagcagaaaaacatggtgaaacgcccgtgaagagaatccatgcgtttattgctaccacaaaatgttttcaccttccatatcagcaaagatataagaaacttaggtcaaatatttcatccaattgagcgaatattaatacaatgtttaagctattaagggatgcattgaatttttatattaactcttttattaaagaatgttgattagttattttaattaaaaaattatttatacaatttaaattttagtacgtttgactcttcgattgaaatgcatcaaattaattcaaaaaaattggtagttgcaataaagaaggaacaaaaagatgttaacaacatcaaccaaagtaataatttgtaataaaaaaaagaatcaaattcatttaaatgtatcattttataagttgaaaatcaaattaaaataattcgataaaaaataaattttcatttgaaaatagagaaaattaattttaaacgatgagaattttagatacttttattttgctgaaagagctaaatgcgcaacaattttcaatttatgaatcacaaaaattgatcagaaaactttattgtcgggcccagcagaattgcgcaacaaaatatttcactgatttaaaaatgctttcaattcttcaaaatttattcgaccaaattcacaatgagcacaaaggtctcaaattcaaagtcaatttttgggaatgcttgtttgcacgatttgccaaaagaatttcctcaaaacttgccaaaatgctccacgaaaatgggattaagccggaagagcatttgctatcgaaagctttggagaatcaaaaagaaatatttgaaaatacttttgttgccgaccattgcaaagcattgcaagagttttattttctataaataaatttaaaaataaatattatatttaaaatctgagaattctaagttttgaatttaagaaagaactcagaagacgaaataatcggtcaattgaataccattcgatatgatttggttattaattttgaatacaatgcgcgaaaaggtggttaatgtaaaatattaattgatattttaaacagtgagtaattaaattcgtttatttaattaattacgattaaataagtttttaaaaaatattattttttattaagatttatatgaaagagcagacgatttgttaaaactattgtccgagattaacataaatgaaaatgatgatgagaaaaatgccgatggaacaacaattatttttggaactgttaaacaaattaattcttttggacaacgcaaatggccaaatgctaagggaaagaaaaagcgaattggacaaattgctggtcgttagccggctaattgagaagacgaaaaaggatttaa

SEQ ID NO: 61221 - DNA, 2044 bp, Heterodera glycines
  Genomic contig location: Contig_ID=SeqID_6344; Location=1394..3437; Strand=+
  SCN-specific regions: Sequence locations=1-63,85-91,113-160,192 -219,241-903,925-1170,1194-1520,1545-1570,1592-1657,1683-1884,1906 -2044
  Gene Ontology: Mol. function=RNA helicase activity; Cellular component=bud neck; Biological process=cell growth
atgcgaaacagctatgatcggtacgggtgagagctttgttcaattgtttccattttaaaagttcagaggtgggaacagaagtggcgggggatttggcggaggtggtggagcttatggacgaggtgccagtggtggtggttacggagcgcgcggaggcagcggcggttatggaggaggaggaggagcacctcgtggtggatatggcgccggcgggggaggttttgggcctccgccttctggctacggagcgcctgaaccatattatggaggatatggtgcacctccgccctttggcagcggcgggggagggtacggaggcggaggtcgcggaggaggcgggcctggtaagtgataactgaagtttaccgtttgctgatacaaacaatcatggcgaacttattcttaggtggcagacgtttggacgacgcaggctcaaaattaagacctgtcgactgggcgaggcaaaatctgaacccaatcaagaagagtctataccacgaacatgcttcaatttcgcgtcgaaaccaagccgagattgacatgtggcttactgaaaatgagtgtaccctacagggcaccaatattccgcgtccaattttccatttcaacgagagcggatttccaggtttggaattgcattttctagctttgcctaaccttcattcgctttaagacccgattgtccatcttctttctgtgcattatcacattccgactaccatccaaagcatttcgtggcccgtcgcactcagtggacgcgatttgatctcaattgctaagacaggctcaggcaaaacccttggatttattctacctgccatcgttcacactatggcccagcctccacgtcgaccaaatgatgggcctggagtgcttgtgctgcttcctactcgcgaattggctgtgcaggtggagcaagtggcacgagaatactgcaagctgatgaaattggatgtgacttgttgttacggtggagcaccgaaagcaggacaggcaaacgatttgcgaagaggttttccgaaaaagccatgacaacacccatcgttatctagtttaggcgtcgatatttgcgttgccactccggggcgcattctcgactttatggaggccaataccaccaatatgcgtcgctgcacttttttggttttggacgaagctgaccgtatgctcgatatgggatttgaacctcaaattcgcaagattgttggccaaattcgggttcgtaattttcaatacggcatacaaattgacgttactgaggagtttttagccggatcgtcagtctctgatgttctcggccacttggccaaaggaggtgcgctctctcgctgccgatttccaagtgaatccggtccatttgaacgtcggttcgttagagttggcggccaaccacaacatccaacaacacgtggaagtgattgacgagtactccaaacagggccgtctcttcgagttgcttgatcacattatgcgccaggtaaatggggttaatggttgttgatcggtgaggagacggcgcttttctcttttcttctcactcctaccattggtgagagggtttagcaaagcgcaaaaacaaaagggccaaattgcaaccgttgttagctttttttctgaagctttcacgtacttatttctggccacattctttttatgcaaatggcattttcttaattcctgatgtttagcgcgaatgcaaaacgctgatttttgttgaaacgaagcgtaaagccgatgacataacgcggaatatgcgacgcgatggttggccggcgttatgtatccacggggacaaagaacagaaagagcgcgaatgggtgctcagcggttcggattttttaattggtttatagaaactaaatgtgatttattattgttaactctttaaaaatatgaaagaattaaaaagaatttttgcctaattcagaattcaaagaaagcaaaacgcccattttgcttgcaactgatgtggcggctcgtggcttgggtattattttacggtgtataaaacgaaaattccctttgtaattttatatagtttgga

SEQ ID NO: 61222 - DNA, 1152 bp, Heterodera glycines
  Genomic contig location: Contig_ID=SeqID_30822; Location=408..1559; Strand=+
  SCN-specific regions: Sequence locations=1-495,525-716,738-899,953 -1038,1062-1079,1118-1122,1144-1152
atggtgatgtgcctgctctcctacggtgccggccttgacgagcaggcggacagtggcaaaatgacggcactgcattttgcggtgtccaagcgcaacctgcagatcacacgcttgctgctctgcctgggcgccgacccgaacgtggccaatgcgcacggggacacgccacggcatttggccgccaaattgaacgagtaattattatttttttttggagttatttattcattttggggctacaatgttcattatttttcacccataattggggacgcgacttttgagcttgccctttcgccccgttgaaaaattaaacagttctataaattattcaaatggcaccaattaaaaatttcacctaatcaatgtcataactctctttttatccgcttaaacttgtcaatttttttagggttgatttgctgaaaagtctgatcatatgcgatgctcggcgttgtccactcaccaaggtacaaaaactataaattttgtaccatttaattttaaaaaaaaatacaaaaattcgtttttttccccgtattttaggttggctgtgtgtccggttgtgtcaacgagaagcagttgaacaagctgaagaggccgtccaccagttccatgccatcatccgccaccggcaacaccacttcaacatcgacgagtgcatcgtcaacggcgtcgttgtcgtcaagcagtagttcaacaacattggcagcgtcggccgcagctgctgctgctacggcaccgccaacccaaccagcaaactcctcacaaccaacggctggagcatcaacaacggcaccaaagccggccagctacacgtcggtgatggtggaggattttgagaaccgggcatttgacaaggaacagttccgcttcaacaaactgttggacattcagcacaatgtaaaaatcagtgtcattattttgcatgttattattattttttgctttcctatatgccgggagcagtttaaccttgtgatttttttttcaattttttaggaaattttcaaaaaacttattgttcgaaagtttttataagaaagtttaaagaaaaaagtagaaagaattttcaagcgttttttttaattatcataaattacttaaaaaaatttatccccgtttgaaaaatttttcatgaagtttttttta

SEQ ID NO: 61223 - DNA, 369 bp, Heterodera glycines
  Genomic contig location: Contig_ID=SeqID_30825; Location=1632..2000; Strand=+
  SCN-specific regions: Sequence locations=1-80,115-186,363-369
  Gene Ontology: Mol. function=structural constituent of cytoskeleton; Cellular component=intermediate filament; Biological process =epidermal differentiation
atgagttatcagcaaagggaacagggaggttatgatcgccgaagaggaggcggtggcggtgattatggcaacagaaggggtaaatttatattattatttttatattatttatttgaaatgtaaacataagatgatcgcaatggaggtggtagctacgggcgaaattctggagggtatggccgagacggaggagggggacagggaagggatggcggaggaggatatggacgggaaggtggaggagggtatggccgtgatggtggaggaggctatggacggggcggtggcggtggttatggccgtgatggtggaggaggtggcggaggatacggacgagacaggggaggcggcggcggtggaggtttttga

SEQ ID NO: 61224 - DNA, 2017 bp, Heterodera glycines
  misc_feature (1669)..(1669): n is a, c, g, or t
  misc_feature (1678)..(1679): n is a, c, g, or t
  misc_feature (1681)..(1682): n is a, c, g, or t
  misc_feature (1695)..(1696): n is a, c, g, or t
  misc_feature (2008)..(2008): n is a, c, g, or t
  Genomic contig location: Contig_ID=SeqID_30825; Location=1..2017; Strand=-
  SCN-specific regions: Sequence locations=22-24,201-272,307-384,435 -464,488-554,586-633,657-755,782-820,896-912,974-992,1122-1122,1170 -1172,1228-1233,1266-1278,1319-1371,1411-1473,1509-1536,1558 -1735,1785-1902,1945-2017
  Gene Ontology: Mol. function=small GTPase regulatory/interacting protein activity; Cellular component=actin cytoskeleton; Biological process=actin polymerization and/or depolymerization
tcctccacctccacccttcaaaaacctccaccgccgccgcctcccctgtctcgtccgtatcctccgccacctcctccaccatcacggccataaccaccgccaccgccccgtccatagcctcctccaccatcacggccataccctcctccaccttcccgtccatatcctcctccgccatcccttccctgtccccctcctccgtctcggccataccctccagaatttcgcccgtagctaccacctccattgcgatcatcttatgtttacatttcaaataaataatataaaaataataatataaatttaccccttctgttgccataatcaccgccaccgcctcctcttcggcgatcataacctccctgttccctttgctgataactcattttaaaattcaaaatttttaactaaataagtaaaaaaatttaaaaaaacgcggaagtgcattaagcattatgcactaaaatttagatctaagaaatgaacaaatccaaattacgaatatgcaaatggttgaaaaagaaaacagattaataatttgtttgggtgaaaggaaggaaaatggtcaaaatggggaagcaaaaatttgcctccccaaaaaaaaaaagaaacaaaaccctaaagggaaagggcgaatttggaaaggggaaaaagggaaaaaaaaaaaataaaaattgggggggggggggccccccttttgtttttttttttttttttaggcccaaaacccaaaacccacaaaaaaacaaccccggaaagggggattttttcccccggttttggataaaaaagggggggggggcttttgagaagggggggtaaaaaaaaaaaaaaaaaaggggggggaaaaacaaaaagaagaaaaactctttttttttaaaaaaaaaaaaaaaaatattttttgttttttttaaaaaaaaaaaaaaaaaaaaaaaaaaaaaaaaaaaaaaaaaaaaaaaaaaaaaaaaaaaaagggggggggggggggggggaaaaaaaaaaaaaaaaaaaaattttttttttttttaaaaactttttttaaaaaaaaaaaaaaatttttttttaaaaaaaaaaaaaaaagttttttttttaaaataaaaaaaaaaaaaattattttttttcggcccccggtttttaacccccttttttattaaaaaaaaaaaaaaaaaccctttttttttttttttttgaaaaaaaaattccttttcttgttttttttttttttttccccccggggaaattttttcttttttttaaaaaaaaacggggggggggtttttttgggcgggaaaaaacccccccaaaaaaagtttccgggaggggcccaaaaaaaaaacccgggaaaaggcccccgaaagggcccccccccccaaaaagccccgggaaggggcccaaaaacaaattccccttcaaaggacccctgcaggggggccccccccacccaaagcccccggcagggggccccaaagcaaaagtcccggagaaggtcccacaaatataaatatatacccaaatttttatcatattatacctgataaattgatcaaattaaaaagactttcgttcagttcggtaaacgacgtgaccatcttattttgattagtgtttatttgaatgactattcataaattaacagggtttctacatatagccaaactcaaacccgacnagagttaanncnnggaaaattttaannttgtacagttttaaatggtttttacacccaaaaagtgacaaaattaaatattttatttattttttttattaattatttgattaattttgtcggtcctttgtccgtgtgtcttttgtctttgtgagtcatctgtccgtaggtcctttgagagtgcacttctaattcaagggtgggacctattcagtaaatactttaaatgaaattcgaaaaattaaaattaaatcaaaaaaaaatattttaaattttttggaacctttcaaaaagctatcgccatattgtaagaccaaaagcattcgataaaaattttcccgncgttgatgg

SEQ ID NO: 61225 - DNA, 826 bp, Heterodera glycines
  Genomic contig location: Contig_ID=SeqID_30826; Location=757..1582; Strand=-
  SCN-specific regions: Sequence locations=1-388,426-653,675-826
tgcttcatctcgtgtcaatttcatcattgtcatttttcgtttgagtgactccgttgtgccgttcgatttggtcaatgaattgactggggagcaattgacgttgaaaagtgccaataacgatggtgcttttttgctgattcgttgtccaatttcccgagatgagaaaaatggataaattgggagaaggaagcgattgagttgaagtttagggaccatttgaacacaattcacattgcaattaatgaggaaggaatcggagacgagtcagtaaattaacacaattaattatgatttataaatttccattctttcgttttagtctaatcgatggcacttccgaccaaagtgatcatcagcgcaaatgtattgttgagaagtgattgatcctttgaattattaataggaaaaaagttttagtttattttgtttccttaatatttgtggtattttaaatgatttctttgaattacatgtttttcttgtatacatatgtttatttaataattctctgccgccactatttgcaaatttggcaatggtgtgaaattgtggtcccgacggaaaaaaatactaaaatttcaaaaagcattttttctggggctaaagtgcgctgatcacaaacctgaactcagattttgaaaagcattgattttgtctatgatttttccatcaagtactagattttttgaaaatttttaatcttctttaagtattttctttccaatgagtttagggtaaaaaatgtgctgatcacgaatctgaagtcagatttgcaaaatccatcattttgtctatgattttccagcaattagcataaaaaaataaa

SEQ ID NO: 61226 - DNA, 504 bp, Heterodera glycines
  Genomic contig location: Contig_ID=SeqID_30828; Location=132..635; Strand=+
  SCN-specific regions: Sequence locations=1-504
atgccacatgtccacatctgcctaattctggactgggaggcaatgcgcgtcggaggaaagactcgaacaccagaggactacatcgacgagtacatctgtgctgagattccaccaaaacctgatgaaagttcaagggacgagcatcaacaacggaatctttacacaaccgtgacaacaaaaaacatccacacttgtgctcaaaatcgttgcctggtagatggaaaatgcatcaaacattttcctgtaaatttctttattgaaaaacaaataaaaaaaagcaattaaaatatagaagccgtatgagtatgacaatgtctactcggagaatgcttatccgcgctatcgtcgacgtcctcctcctccaagtgccgaagaagctcaacaaaatccagagcaatttggccgagtgttcgagtataaagaccgctatggaaaactgattaagaaggacaatgcacatgtcgtcgcattcaacccatttttgtccgccaaatacaaatctca

SEQ ID NO: 61227 - DNA, 960 bp, Heterodera glycines
  Genomic contig location: Contig_ID=SeqID_6346; Location=75..1034; Strand=-
  SCN-specific regions: Sequence locations=1-73,116-277,299-327,349 -649,671-960
atgaaaaatgatctttttttctttttgcttaccattcctgttttgacctggagctgttatggtaatttagtggtaattattaattatgaacatgaatatttaaaataaatttaaagcgttttaattacttaaattaaacaaattcaacaaggtttgatctgcaagagcggctactcattcattcgtaatgactatggattcagggaccaaattggaaatagaacgtgcccagatacggtcgattactgtgcagctataatctgtaccaaaggtcgaattatttattttacaattaaaacttaactttgcctaacatttttggattggttttttattattgtaacaaatagcatacaatttatgctcgggagttcattatgagtgctgcaaaaaaattcggaaattttgggagtgctttatgaaattttcaagcctaaaacaaacaaaatgaaaaaaaaattcaaaatccttgcgatggcttctttcgctaatgaatatttttctaatgacttctctcgtgaattaatcactcattggctggaaaaaactatcgttaattttatcaaaagtcttaccgaattttggtataattatttcagccggtcttaacggtttgtcggcaattttttgggcttgtgcctcaatggatatgaaagaaagcaaagaaaaatggttcgaagattattatgagaaaaatttgagtgtgccaaatgtgcattgccatgccgaatttggggaaaaggacaaagactttggcaatacgcacttcaaacgtccgcgcgtgcccgatgggctgttgtgcttcgcgggggaggagttcattaaattggatttttgtgaggacgatgaccatttttgttacttggccaaatgcaccaaaggttggtgttattaaatagattataagaaaaagtttttaaatcgaattaataagttttttttggaattttagtgaataaa

SEQ ID NO: 61228 - DNA, 263 bp, Heterodera glycines
  Genomic contig location: Contig_ID=SeqID_6348; Location=546..808; Strand=+
  SCN-specific regions: Sequence locations=1-263
atgccatcatttgagccatgtacaacagtggaaacgcacaaggaattgttcgggattgtactgatgtaagcaaaatcgcgccctttgccctggataaattcatccgtgtcgtactctctttcagtacagccccattccgtgatgatttcagattgatggctatccttattgactgaaagtcggatcaaaatttagattggacgacaaatattccgaaccgtaaggatttccatgaaaaattgtcaaaactaattctacgaaaa

SEQ ID NO: 61229 - DNA, 766 bp, Heterodera glycines
  Genomic contig location: Contig_ID=SeqID_6348; Location=941..1706; Strand=-
  SCN-specific regions: Sequence locations=1-37,59-176,217-410,434 -438,460-613,635-766
atgaaaattaacgaaatcattatgtcgaaaattggtattattatttaaatgttaccgagagtctcgttctcgagtatcactcgaaaaaagtctcggcttttttgggtctaggtctcgatgtttcgttctcagtctcgggtctcggggccgagtctcggtcttgagcatcactaatgtaatatataatgaatttattaaaaaataatcaattattttggttttgaagctgcaaataaatcattcgatttggaatttggcttgttgactaaatggggctgcaccgacaaacaatccaatgaaagtcctctgactgatcccaaagaattgatcgaccaaaatgatacaatcaaaatcatggaccatttttgcgcgcacaattatagtgaagcggatgtgtcaatgtccaacgctgcaatggctgtgccaattccaggcaaattaatttaaacaaaaatttgtttataattatgaattgttttagccaaagagtgcaaaaaggcatacttttcaaagatgcttggtcataatgaaagcagcgacaacaaatgtgaccaatttaagcacttttgctacatgttgaattgttccacaggcaaatgacttttaaacgcacttttttttattttaattaattggagtccatcttggactaaatttttcaccccctcccccctcgggtgaattctaattcagggagaggattgaattcaagaaaaactttctctatttttatggtaaattaggcacaaatttctctataaataaa

SEQ ID NO: 61230 - DNA, 470 bp, Heterodera glycines
  Genomic contig location: Contig_ID=SeqID_6349; Location=472..941; Strand=+
  SCN-specific regions: Sequence locations=1-57,79-227,249-334,391 -440,463-470
atggccacctttgcaccaatgggtggtaattgcttaaaatggcaaaaaaaacttccaacatttcttaacaaatttgttaaaattgtacaggcattgaagattggcacttccttgttaaggtttgacatgtctttgttctttttgccaacaaaataattgcaggtggacttgaaggacgggctttcgagccaattgttccgttttttaaaatcatcataaaatgattccttcttcacactgcatccccactctgttttgaatccgacatagccttgatatgacgaagaaactaaaattttgtaggaaaaacattagcataagtgctgcaagcttgtaatattaaaaaaaaaatttttaatcatgtattaattattaaaatacattattattgtaaaatcctgcaaattttattaacttaaattaccatttttttgaaaagtaaagatcattattttgtaccaaatttttga

SEQ ID NO: 61231 - DNA, 1481 bp, Heterodera glycines
  Genomic contig location: Contig_ID=SeqID_6349; Location=1674..3154; Strand=-
  SCN-specific regions: Sequence locations=1-78,112-144,166-175,197 -414,436-439,461-486,513-551,573-873,905-1064,1116-1163,1186-1481
atggtccacggctctcgacattttgcccccgaggggttggagagcaaccctaatttaatcatttgacaaaattgagccattaattttaaaatgaatttttatttaattttagaaattgtcatcctggaaaaattatttgtgttctactggaagaggaaggagatgatgaatgttgttccccaaactatgaaacaatatgttaccaaaactacaattttgtaagattttaattagtaggaatggaaaattgagctcaatacacttttctcgatcataaaaatttacacgaccattaagaacttgacaatttaactctttgtttcatttaaatgatccaaattaaaattcatttggctttaaaaattaggatcaattaattttaaaacccttatatggctataagtttttgaatttatttctgtttaatttaaaacattgctaaattattattttaatttttgtaatccctcataagtagggctgtcaattttatgtatgtaaatacatatttgttaaagaattctccatgctctaaatagtaggaagaacactttcttttttgtgttttctaacaaaagttgggacttttatttacatttttttacattttttttttacaaattttgggattttcttacatatttggtattattttggattttttcatatattattttttttacatattttgaggattttttacgaaatttttgcaaatccgttcggtttgtacatattttcaattttttttacatattttacaatttgggatttttttgtacatatttcgtgatttttcttacatatttatgtacatatttttactactttttatatatttttgacagcccccctactgataagtaagtgttgaattttataaaaaatttaaatttctaataatcgcattatgcactattttgaattttgtcgattttttccaatttcatatattttttcaatttttaggtgcatactatactttctgaccgtttcccggaatacaaattggtacaatattgtattcaataaaaaaaatagtgatttgtcattcttacaattagataaataaatttaaattaatttttgttttgtttactataaaaaatttaaaacataaacatatttagaaatatgaattgtacaaaaattccgaaaaaatggtgccacatgtggaaggtgcattcaaaattgtggatgaacaaagcaagaatagagaagtgaaggaaggatgcaatccggaacgagactgcaagcagtgcggcggtctctattcatgcattccaattccggaagtatggatgacgtattccggctgctgtgggcctgggtacgaaatgaaatgttgtgttacggtacggtttatcagttgcaatactgtagtttagttagtctgatagaaatcactcaaatttatggtcaatatctcaaatacagtaaaggtttaaatttttgctaaaaaacaaaatacaaaaaataaa

SEQ ID NO: 61232 - DNA, 290 bp, Heterodera glycines
  Genomic contig location: Contig_ID=SeqID_6350; Location=28..317; Strand=-
  SCN-specific regions: Sequence locations=1-85,107-290
atgcttgtaaaatgtaagcctttcattttcggcattctttttgcttgtttgattcccagcattatcaaaactgaaagtgaatatgtgaaagctgcattcaaatttaaaaatgatgatgacggcaagttatttgaaggagcagaattgggtgcttcgattggtggcgcaattggttcattagcaggacctgttggcactttttttggagttgtgattggaattgctgcgggggctgttgatgcagcagtgcaaagcgataaacgctacgaaagttgccttgcaaaattgaa

SEQ ID NO: 61233 - DNA, 981 bp, Heterodera glycines
  Genomic contig location: Contig_ID=SeqID_30832; Location=314..1294; Strand=-
  SCN-specific regions: Sequence locations=1-436,467-810,843-981
  Gene Ontology: Mol. function=protein binding; Cellular component =synaptonemal complex; Biological process=transport
atgatttcaattgtgtgtgataatgcggagacgggcagagaatgcattgcttatctgcgcgaacagcactatccgcccgagacattccttccgctttctgagcttcgcatggaacagatcaaagagcatttgcgcgacattcgcgaccccccgggtgtcaaattggtgtttgacgtcattaatgtccttggcaacgcgcaacacgtgcgaaaggcattgcaagtgagtttcattcttttaatccaacaatattacataatgaaatatcttaatgaaagattaatgttgtgatttggctttagtttgtttgcggaaattcacttgtctgtgaaacgccagaccacgctcgtcagcttgcttacggaaccgatggtcgttcagaacgatttcgagcagttgctttggacgggactcaatttcaggtgctgactttttcaaaatttcttttattttgtattttagccaaatggtgttataagcggcggaggtgccgacttaaaggcaaaagcgaaaaaatgggatgaaaatgcaatcagaaagttgaaagaccgtcgaacggcgttgcaggaagaattgcaaaaactgcaccgaaccgggaaaagggagttggatgttgagatgaaacgggaacagatcacttcactggaggcacgtctacgcttcacacagcaagaattgaagaagagcgaaaatgaaacgctgcgccggttggagcaggacgcggaggtcgaaagtgcggagccggagacaatcgaagtaattaaagccaaattttacaatttaagggaaaagcagcatcaataaacattcatttattataaatatttaacattaaaaatttagacgcgaattgaaagccgtcgaattgaaattgaggagcgtaaaatcgaaatcgaacgcttggaacaaaacaagaatgcaattgccgacgaaatctttacagaattctgtgcaaaaataggcatcaaacacattcggtag

SEQ ID NO: 61234 - DNA, 864 bp, Heterodera glycines
  Genomic contig location: Contig_ID=SeqID_30835; Location=119..982; Strand=-
  SCN-specific regions: Sequence locations=1-380,402-459,533-841,863-864
atggatgatgatattgaatatggcaccgagcagaaaatattgaggccgaaccctcacaaagaaagggtaaacaaaaatatatacatagtaagtgctccaaaaaagtcttaattcaaagaggcaaaatttggaatattaagttttctagctgaaggataaaataaattctctttaatttacttttttctatagctcttttcatgctctatcagatgctgctttttcttaaaaaataaaaaaagcgtttcttagggttacatttttaatttttattgctttaaaaactgtttagtagatggaaaaataatgaaaatcaattttcatgtgtatattcgttgcttagctaataaatgagtagctaaaaatcaataaattggctaaacccactatcttattgatcattttatacaatttattggcactaaaaaatttgttttagaaaaacgaaaaattttttccaataaaatcattattttgaaaaaatgatttattataattaacatttttttaataatataatttataaatttttgcatctaatttcaatttcaatgccactttctaaactaacagaattttaccagaaaaatctttgttcatttttataaattagcaaatttagataatttttgactttgagtacttttctcacctattacaatcacttattgtgaaatttaattcttttttagataatgcagaagttattctttccactagtgaatctttataaggataattgcattaaactgatgcacgaaaagctgaaaaaccaacaattggacacttgggaacaactgcaaaatgccattttgaaagaaaaggaagcgaggtaaaaaatgaagaaaaattattattattaaa

SEQ ID NO: 61235 - DNA, 778 bp, Heterodera glycines
  Genomic contig location: Contig_ID=SeqID_30836; Location=216..993; Strand=+
  SCN-specific regions: Sequence locations=1-355,378-382,405-778
atgcacacgttttgcgctcgagctatttatcatcgggcttgtcaatccaaagcgaaacaaaaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaaaaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaatttttggtgctctaattaaccgcgataaaacattcgaatcattaaatagcttctgagataataaggtttatcataaaatttcttttaaaa

SEQ ID NO: 61236 - DNA, 593 bp, Heterodera glycines
  Genomic contig location: Contig_ID=SeqID_30838; Location=125..717; Strand=-
  SCN-specific regions: Sequence locations=1-314,345-534,572-593
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttaaccggttcagaattcaataaa

SEQ ID NO: 61237 - DNA, 3494 bp, Heterodera glycines
  Genomic contig location: Contig_ID=SeqID_6351; Location=893..4386; Strand=+
  SCN-specific regions: Sequence locations=1-533,555-677,699-851,873 -1201,1223-2249,2272-2369,2401-2629,2651-2684,2706-2917,2946 -3121,3143-3494
atggaaaatcagagcaacgcatcggtccatagcagatcagagcgcgaagaaaatggagcggacgcagagagaaatgcggaaaacggcggaaatggaggtttggatggtggcaatgagcatgcaccgattttgggacagaatttgaatcgaggtgctgatccgcgtcacccacagccgggacgtcaccgatacaatctccgaccccgccaaaacaatttgttttatggcctcaatcccaatgagtctgccgacagttttcagccacacggcgaaaaccgccaaccaaatcgaagacagcaagcacccattcaaaatccgggttttttcgaaaatgttgaaatgggaaatcccctttttgctcagaaccaaatcgtagaacaagtcgttgagaattcacattccggcattagaaatgaaatacagcatccaattggactcgaaattgagcggtacggacgcccgatcgctaattcctctccaatcaccagaatgggaagttcgcataacgagccacacaattcttttgaaaacgtggagtttgaagagataaggcaatttcgggccaggcaactttacgaaaatccacgcggatttcgtgaacaaaattttgtcggggaacaacgagaaaggatgaatgaatttgagcaaaaccatgctccggtcccaaattttgaaagaagaaatgtatttgttggtgatccgcacggaaatcagctaatttttgggaattttggaaggaacatggaacggaattttggacattttgaaaattttcccggactcgcacgaggcggaaaccaaaatttgaatgttgggggaccaagaatggaacaaattcgagacccacacagagaaagaaatcagtacgaggaacggcaattcatgccaattcccgaaccaaatatgaggcaaattgatggacaaaaccaaaatttggcttttcgacaagtgcagagccaaaattttcaagaaaacatggcgagagtgatgccatacaccgaaggaattcctgatattattcttgaacttcacaaagtcacactttcaaatcagtacgcaaatgtccttagagaaattcctactctttttggcactgaagggagggacaaaatcaacgattttttcaccactcttgaattgtgtacaggagattggagacccgagaaaaagttggaaattttgagagcgaaattaaaggggaaggcatccaaagcattgaatttgtccctacgaaaatttggtcaccaagtgccattcgaagtcattaaaagggagattaagaccattttacgggaaacggattataaagaggcaagcgcatttacggaattgacgcagtttggaaagcagaaagtcggtgaggatattgtgaaatttggtgagcggattcagcagctggtcagctgcgcgtactatgggatcgaagaagaacagttggacgaaatttcgaaaaaatttttcatttcgaatgttagtgatcccaatatgtcacgttttttggaatgccaaaccaaacaatcccagacattcgacgaattgttgatggtggcaaaccgattgagtttaattgagtcaaaacgaaacgtaaaccaatccctgaaccaaaattatagagaaaacaattcacagttttctcatccgcgaaatcagttcaaccaaaaccgttttttccaaaaccaaagttttgaaccaaggcctcaaaataatcaagttagattttttgctgatcgaaatttcacccgacaaaatttcacggataggcagcagccaaacacaaatgagaacagaaactccggctggaaccgaggcggctaccaaaattcaaatttccaaaaccggcaaaatttcccaaatactgataaccgaacccaaaatgtgccgaatccacagcagattcaatcatcttctggcacacgaaccaacacgaatacgattacagtcacggaaaagaaccaaaacgagcagaacgaattggttttttgcaataatatttctcaaaaagaagttcaggattttgaaattttttttaattgcctaactactaaagcatacgattttccatctaaaaatcccgcccaaccaaaaacatatgaatgtcttaaattggtaatgaaagtggaaggtcaaaatgcgaaaactttgggagactctggtgccgaaacgaatattgtcaaccccgaatttctttataatttggcgaaaaaattgaaattggatttgataaattggggttttaatccgaataaagggctaacgagaattccatttgatgttgcttcgttttctggttcaaggatttccattataggcgtaataaatatcccaatcgaaacatctggttttaaaacaaatgttccgtgtttgatttcaaaagaaagatttaattttgatttggttttgggcactggtgcgatggaaacactcggattttaccttgcaaactcatttacaaatgaaataacttatttcacttcaaaagagcaacaagaaatgtcaattcctctcataaattctgttaaagtcgcatcttttacggtcataccccctatgtcctcgtgttttgtcgattctagaattgaaaaccattctaatctacccaaaaattcccattttcttatagaaaactcggaaaaatcaattttattaaaaatgcaaagcgacgaagaccttatggactacgacgaaacagacaaagtcgaaatggaacggctgagaaaattggacaaagtggcggagcaaaaggaattggaaaaactgggaataattgtgccggagaccaacattggacaaaaatggaatggaaaaagagggcacagtgaaccgcccattcattgcactgatgcgaaaatcccagtgcatgaacttccgattatcgaaatggcgttggcaacgtcggagccaggttcatttaaaattttggttcataacaaaaatttaacgccaatattcctcaaaagtggcattgaaattgcaaaagcagaaattgttgaagaaatttatgacccccatatcgaacttcttcctgaaaggttctggaaatcccaaagattcattagaaactttggtgttcagaaaaatggagagcgaatttcgcaacttttgtctgtcattaaaccaaattttgggcctttaaataatgaagaaaaaagtctgttggaggaaattttggttgaattttctgatgttctagcactcgaagaatccgaattaactcaaacaaacttaaccgaacataaaatcgatactggaaacacacaagcaattaaaataccaccgcgccctatgccttttggagttagagcaaaagttaacgaaatgttggacgattatctgaaccgtggcataataagaccctcaaatagcccatgggcatccccgattgttttggcggtcaaaaaggacaaatcgataaggctgtgtatcgattatcggaaactgaattcggtcacaaaaagagactcgtatccccttccaaacattgacggaattttaat

SEQ ID NO: 61238 - DNA, 118 bp, Heterodera glycines
  Genomic contig location: Contig_ID=SeqID_30842; Location=1093..1210; Strand=+
  SCN-specific regions: Sequence locations=1-91,113-118
atgctttttatattggttcttctattaattgaaaaattgttattagcaaatggagctcctctttcgacaaaaaatgatggcatcgaagcaaaacaaaataaattcaaagaaatgacag

SEQ ID NO: 61239 - DNA, 1571 bp, Heterodera glycines
  Genomic contig location: Contig_ID=SeqID_30843; Location=124..1694; Strand=+
  SCN-specific regions: Sequence locations=1-147,169-178,255-297,321 -503,554-691,713-803,867-919,988-1151,1173-1295,1317-1379,1401-1571
  Gene Ontology: Mol. function=transcription co-activator activity; Cellular component=nucleus; Biological process=regulation of transcription, DNA-dependent
atgagtttgttgagcagcacaacaaagtacaaagtgagcattggtgagattcaacgtcgtatcaacccgcctgaatgtttgaatgcatcattaattggcggtattttgagaaagtcagtaattttgggggtgacaaattttgtgaatataataccaccttctaaatttagtgtaagacaaatttagtaaataattgtatttttagagaaaatttaattaattttgtaaaaatttattaaaaatttttatattatcaagaaatgaaaatatttttgtgctaaataataaaatcccacatcataaaaaagaaaattatagaatgtgagtaaatattttggaatttcgttttactcaaataaaagcccccccccacccctcaattagaagctccccccctatatgccaaccttcgaggggggttgaaaaatagaaaatactctgaggcttagtttcagtaaattttgttgttcatctttttttttttggtttaatgagataaaacctttaaaaaaaactaaataattgatcattattttattcattttaattaattgccattaaattttttccctaaaattagggctaaatccaaggacggcggcaaagcattgagggaatcgttgaagcgaattggcctttcattgccggccggacgccgaaagtcggcttgtgtaaccgcattcactgcattagttgaggaagaagccctccatatggtcggcattaattaaaatttgtgccattaaaaaacaagcatttttaattttcaaatttatttgtccaaatcaattttaaaaaatgccaaattttatatgatttattaaaatgacaataaaatttttaatttaagcttttttaattttatagacattaaaaggagaatatttttttacgccatttaaattaatttctttagcagtttattaatttcaattattttttaaataattttattattttatttaaaatttgaatttactaatttttgattacatagtatttttgacactttaaatttttaacatttaaggccaatgattttaatgctgttctccaacacgatttcccggccaaggacatcggttttttcctcaatgcgcaattcctcagatatgttggccaatcgccgatggattccgaattggtggccagacgtcgtacaattttaaattgttcaaggtttttattgcaaaatccgaaccttatgattagtggatttagctgtccttggctttcataaatacatacatctcccgtatttaaaaaggctaatttgtaaggaatattatcagaggttttgaaattgagtttttattatttgtactaatttcttcatctcttattaatgcgttacccatattttcgtaaaaaaaataaataaagaaattacaaaaattgcattttttaggatttttatcaaggagatcaccagccttttggctgcggaccgaagcccaatttgcgatcgtcgacctgaattgatgttggacccgagcatacaaaagcaactcacgcatttttcaatggcaatttttatgggttttttgtaaaatttttgaatcaaaatctta

SEQ ID NO: 61240 - DNA, 555 bp, Heterodera glycines
  Genomic contig location: Contig_ID=SeqID_30846; Location=88..642; Strand=+
  SCN-specific regions: Sequence locations=1-267,326-555
gttggcatttcaaccaacggttggaccttggttctttccgtttctcatttctcctattatttgtcacttccgactcagtttggaaaactgctgatcaacagctggctaatggttcaattctttttagtgtttgggttatgtgttcaattcatttatcgttttttggtgctgaacaggtaaaagcgcataagtctttcttttgacctacgggagccatttaccattaattaatgtcattgcgtttttttatatttgctaagattcatctttatattaatataaatatttaatttttctcttaaatgagattttttaataattttatgatgcttaattattttatttaggggcttaaaaataacaatgaaaaaatatgttgcaatgctttcatttgcattttccatcgctattttgacttggacatatgattttattgtttcaaatgaccatataaatctttccttgcttaaagccgaagaaatatttcaaattgaacaacttttgggtggcaatctcaacgactttgtgacatattgtcaacgaaatgtgagctga

SEQ ID NO: 61241 - DNA, 1121 bp, Heterodera glycines
  Genomic contig location: Contig_ID=SeqID_30847; Location=133..1253; Strand=+
  SCN-specific regions: Sequence locations=1-346,368-421,443-530,552 -591,617-759,789-942,964-1121
atggctgttctacgccctgttgatgctgttgttgctcttttccggctacacattgtacggcgatcgacgccttcgtttggccggcaacaaaacgcaacagcaacaatcggtggaggaaattgtgccacaaatccatggaaaaccggaccgggagcagttgttgaaactgaaacgtaaggcaaaaaattaagggtatagaaaatgtttttaactgctatccttaaaagttgcctatttccctaaaatttacctaatttatcccccccccctctctcctcacctcccggtttaatggcaaaacgtataaaaacgcatagcatgtttgtttaaccagttactaccaagccacaaaaatttgaaaatgaaatttctgggactttcaccccctcctccctattccatccccggcaaaaaaacaatcaaaggggcaaacaagaaattttgtagaaaatcagcggttctttccatttatcccatatttgtcctttagcatccgatgaacttcatcagacgcatttggcccagcccggcacaccaaaaaaggacattgtgatggaccaaccggagctccatttgacgcaatcgcttcatccttcaccgccgccgccgccgcgtggcgaagtgccaattgtcgacgaaatatcggcacaaccgcaattcatctacaacacgacaacaccgtacagcttctacgaacatttgaccagagctggccaatccgtctgggaattgatcggtataacattttaatgttttcccaaaaaaaaaattttttttaataattttttctcgacttataatatttttcttttttcagttgacacatttattggcacatacgaattgttgaagcgcatttttttcgtcatcggtatcggtatttgtcattgtttattaggtcaaacaacaaaaacaaaaaaaattggtgtgtctcaaatttgtgactaaaattttacaatttttctttgggattgttcaatactcataaagggatttaatttaatttcatcatttccagtcagtatgccgatcaaatttgcaaaaatgttcgcccattttatgagggcggtggtttcttctgtttggctttcgctcaaatggttggcggaacaaattggtga

SEQ ID NO: 61242 - DNA, 297 bp, Heterodera glycines
  Genomic contig location: Contig_ID=SeqID_30848; Location=1006..1302; Strand=+
  SCN-specific regions: Sequence locations=1-297
atggaacctgttacggtatccaaatccaatgctgaacctgtcactgtatcgaaatccaaagctgaacctgttacggtatcgaaatccaaagctgaacctgttacggtatcgaaatccaaagctgaacaagaacggtatcgaaatccaaagctgaacctgttacggtatcgaaatccaaagctgaacctgttacggtatcgaaatccaaagctgagcaagaaactgtatcgaaatccaaagcggaacgatagtggaggcggtcgaacaattgaatccaccttctccaatgaaaaatga

SEQ ID NO: 61243 - DNA, 186 bp, Heterodera glycines
  Genomic contig location: Contig_ID=SeqID_30848; Location=1406..1591; Strand=+
  SCN-specific regions: Sequence locations=1-107,130-186
atgggcactgataaacaaaacgaaaagaaagccatcgatgtgcaaaatgacaaagctagtactgataaacagattcacaaagttggcacagatagacaaaatgacaaaatttctgatggaaaagatgccaaggttgacactgatacacaaagtgccaaatcgggaattaatggactaaatgccaag

SEQ ID NO: 61244 - DNA, 500 bp, Heterodera glycines
  Genomic contig location: Contig_ID=SeqID_30851; Location=33..532; Strand=-
  SCN-specific regions: Sequence locations=1-500
atgagggatcgtaagttttccagtgctttttcttttttacagtacacttttaccgtatttttggttatttactgcttacagtatcattcgactgtaatttgccattactattatgacaaagaaataattttccatattttcagacatcgcctcttacttccgtctcgacaactcttttggcttgacagaagtccaatttcgcggggaacttactccggagattttcgaaattcaatttgacgccatttttgcgactattgaccgcaacaatctccaggacatttcctgggcacaacaatgtaaaaaaatgccaattaatgagcgataatgtggataattaagtcatccaaacgcttgccaatatctttgagggctatgtggacgaatatttggcggcaaatcagtagcaaatttaagatggtttgatgtgaccttgttgacatgaaaatgctaaaaaacgatttttttaaaattttcagtgttgttattttaaaattaaa

SEQ ID NO: 61245 - DNA, 1294 bp, Heterodera glycines
  Genomic contig location: Contig_ID=SeqID_6352; Location=749..2042; Strand=+
  SCN-specific regions: Sequence locations=1-160,198-525,554-675,700 -1294
attttccttatcttccccaattaccgtcgcaatgtttgctttcgcattttgttcacaaatggcgtcaccgactgtcttcagttggccccgttactcatcttcgccgtgcttaatctgatcaccgatcaaattcccatttggttccaaatggttgcttttcattttaattttgtttaatttcaatttttttttaatttggcaatttgttcttcagtttggcagcagcattgtgctcaatgcgtggaaccttctcgtcatgcagcactttttgctggccatcaaccgacttattgtgattttgcgtgcccgataccttggctcgaaattcattccggacgaggacaccgaagcgatgtgtttcaatgtgaggggcattttgaaaaaggcattcaatcacatgatcggattccatcccatttttttgtgtcttgtcactctgtactgatcagtagggctgtgaattttagtgactaaaaacttgcacaaatcgccaagcggaattttctaacacagctcattgttttcgaaagagtttaaaattttgcatgaaaatactttggtataaggcctagcatcttgccaaattctagaattttttatgcactcagagatttttaaaaaaatccgctttttccagcctgaatgccaagtttgtggtcaagttttgaaaacaggtggttttttgtaaaaaagttttaacaatatgaaaaattctgaaattttgcagggtgttaggtctcatgccaaagtattttcatgcaaaatttcaagctattctgataactctgaaccgaattacaaaaatcaacttgagcaaaatttaaacttttattcactaaaattcacagccctactgatcagtccccctctgatcactttgctgatcgtactctgtcatcttttttccatcttctgatcgcactgctgatccttctttcagattgcgcatgtgttctgctggacggtgtacttcgtcattgtcggtctccaccaaaccaatttgatgggtgggcttttccattccggcaccagccaattcgtcttcgacattggaaagccgtggactcagacgatgcgcgaagtgttcaaatatttgaccatcgcaatgccaatcatttgcctggtcatttacattgtgatcattgcatttgccaaactggtaaatcgttttaatttaaatgcctttttaaaatttgttcagagtcgcgctggcacccgccgaggcgacgactttaccaaagccaaaacgacggcgccgcttttgaacgattacgaacagcgactgctcatccaa

SEQ ID NO: 61246 - DNA, 90 bp, Heterodera glycines
  Genomic contig location: Contig_ID=SeqID_6352; Location=2767..2856; Strand=+
  SCN-specific regions: Sequence locations=1-90
aattgttctcaattttgaatagcaattataatataaccaagtgcatttggcccattttgttaattaagatttttattatgtcattaaact

SEQ ID NO: 61247 - DNA, 1331 bp, Heterodera glycines
  Genomic contig location: Contig_ID=SeqID_6353; Location=1..1331; Strand=-
  SCN-specific regions: Sequence locations=1-258,282-556,583-714,736 -1331
  Gene Ontology: Mol. function=extracellular matrix structural constituent conferring tensile strength activity; Cellular component= collagen type XI; Biological process=morphogenesis of an epithelium
attaatttgcatatgacgtacaaaggatgtcaaaccggagatcattcctttcatcccgtcctttgaaagggctgtaaattcacttgaattggttggaattcaaaattcgtccttcaccgtttctttcgctctctcccgccacgcaaaccccgaaaatgcgcaaattcatccggttttatgttttgtcccccccccctcaccccttaaaaggctttgctattgccaatcacaagtcacttattcctcgtcttcaaattcaaattttaaatgggtttaaaagttgcggctgccacttgcgcggcgttgggcattttctgcactttgagttgtctaattggcgggccaatgctttaccaaaagatgagccaaatccgcacggaattagccgaagagatgctgctatttagagtaactttctattttaatggttgttcattaaaataactgccaatttgtcaggtccaatcggatgaaatttgggccacggtaatcgaagtgaatgggcaacggcgaatgcgacgagacgcagctgaaaattcgggtgaaaaaagcgccggagtggagggagaaaagaaagaaaaggcggccgaccaaaaggaaactgggagcacaacttctgctgaagggacagaccgaagtgccacgcaacaatcgccgatggccaagtgcaattgcgccgaacgaaaatgtcccgccgggccgaaaggcccccgcggggcacccggagagaaaggcgaagccggcgcagcaggacaggtcccccttgttaatcattgggcatggattcacgcgattatttttattttcaggatggggtcgctggtgtctctgctgaagacgttctggcacaagtccagcagctggaaaagtgtttccactgtccaatgggtcctccggggcccctgggtttgccgggtcggcctggcccacggggaatgcgcggagggaagggccaaccgggcggtaatgactcattttcgcattttcaccgtgttattaatgatcttttaagtacctggacgagatggacagcccggattccccggaggggtaaaaactgccgaccgattgttgcctcttccaagtatttgttttagttgggtcctcaaggaaaagcggggtccattgggacggtcggagaacagggaataccaggagaggacgcaaagctcgttcatggaaggcccggactgaagggaccgccgggcgcagtcggagaccaaggggacgcgggaccgcaggggccgcagggcggggtcggtgcgcaggcaagcagccgagtctgaagcttggatcaacattcattttaaggggccggaaggggaaaaggg

SEQ ID NO: 61248 - DNA, 353 bp, Heterodera glycines
  Genomic contig location: Contig_ID=SeqID_30854; Location=515..867; Strand=-
  SCN-specific regions: Sequence locations=1-317
atggacctccaaattgataaaaatgagtactccgggattatttctctaaaatacgacaattattgggtattttatttggttagccgacatttgcggaccgacatttgcggaccgacatttgcggaccgacttttgcggaccgacatttgcggaccgacttttgcggaccgacatttgcggaccgacatttgcggaccgacatttgcggaccgacatttgcggaccgacttttgcggaccgacatttgcggaccgacatttgcggaccgacttttgcggaccgacttttgcggaccactatttctcgatagaactgtctaaataaagaaaaaaataataagaaattttaataaa

SEQ ID NO: 61249 - DNA, 78 bp, Heterodera glycines
  Genomic contig location: Contig_ID=SeqID_30857; Location=684..761; Strand=+
  SCN-specific regions: Sequence locations=1-9,31-78
atgaacgattggctgctctcctcagctgcccttcatgaaaacgttgttcaaaacggcgacaccgctgaaaatggaacg

SEQ ID NO: 61250 - DNA, 583 bp, Heterodera glycines
  Genomic contig location: Contig_ID=SeqID_30860; Location=1..583; Strand=-
  SCN-specific regions: Sequence locations=1-237,259-426,526-583
atggccaccgaaacaatgagtgcccaaataaggactcaaaatgccgaaagtgcggcaatgttggacactgggctgcgatttgtaagacaaagcagggcccaattggccaaaaagcaagggaagccagtaaaccaggtcaacgctgaaagccaaaaagcatacgacattgggacactggtcaagtctgaagagatcaaatatatttcagtgccaccagcaatgataaccaaaaatgcttaatttgattgataatgaacaaagttatggttcaaaaagtcttccgacgacgtttcggccgacaacgttttagagtgcaccggttcagcgatgctcaccaacactcaaccaaccaaatgttcagcaattctcatcggtttattgcactttccaagcgacgccatcgaacacataaagaaaagcggagtcagagaaagagagaaaaattgttgaaagtaatgagaaaaaaagagtgaaagagaaagagagataagaaaaattgagagcgagcgagagtagaggaggaaaataatatttcctagttatttgcactaaattaacattaacgcacgataattataataaa

SEQ ID NO: 61251 - DNA, 477 bp, Heterodera glycines
  Genomic contig location: Contig_ID=SeqID_30861; Location=64..540; Strand=+
  SCN-specific regions: Sequence locations=1-134,168-210,232-352,417-477
atgtggccgaccgatggtcaatgcgtttgttgtctcgttatgatggtggtgcgggtgaaaattttgtacaacataatgccaaaaaaagggaaaatgggcttgaaatttttttacgaattttccaattcattcccttaaatttacttttttaaaaatatttttaaattgacattaacttttttttattgtcaatggaagagttttcacattttttggggcgggaaattaatttttgagttctaagcctttttcgactgaattttaagcaatatttaaatttaccaattttttaggtttatcaagctttaaccctggtttttaaggtgcttttagaatggggcctatgcttatcttaaatttatttttaattactttttaattttttctataaattttttaaaattattttttaaattgagtactttttaatgctaatgaaagaattttcacagtttttgagattttttgggactgtaa

SEQ ID NO: 61252 - DNA, 1468 bp, Heterodera glycines
  Genomic contig location: Contig_ID=SeqID_6355; Location=344..1811; Strand=+
  SCN-specific regions: Sequence locations=1-296,399-652,681-709,759 -1003,1066-1215,1265-1377,1405-1468
atggtggcgttgtgcattactcctcaaattattgctgtggtgtttatggtgttgtttttgagtggattttttaacggtatctaaagaattttttgtaaaaaaaatatattttacaaatttgtcatattaatactcattgtaaaaagggggacatgaaattgtggagatttcaatgtcaacagtttcgtcggaacgaatctggcaaagttgggcgattttttcaattgcctttttgccgatagacccaccccccccccccttttcggcattttctccgctgaaattcaaattttgcctttaattaatttttaaaatttcaaaagaaaaagtgattattttaaggatttaaaaaaatttaattctgtgcaaaaaaaattttgttttttaaatttttttttgcctaaaattaaattggcattttttgctgcaaattttgccagctttgggaattaacaaacatgaaaatgtgatcattcatcgcttaactcaaattaggtggcgtaaattcgtcaagtggaaaaagtgtcttcctctcaaatgttcaacatccgccggcaaacattccgaagaattcaaatgccaatttgctgcagcaaattggcgtgactaattatcaacagcagcagcagaatgccaacaaaacattgaagggtaattaatgaaaataaattatattttttggtagctttcatttcagggaaaaactcgcttaaattttttattaaaattttcttattaaaaatttttttaaattttttgtgaaaaatttcgtttttaaaattttcaaagaaatttcggggtggaacaatacgggggcgcggaaaatgagcttctcctatgctcgagaacatttggtctcgatagggtaaaaaatttctcggaatatttgagtctcggtcttgaacttgggggtaagtgctcggcatttgtctggtgggttcaattcttcaaaattaaaaaatactcttctttcaaaaggttaagatgtttttgactgtctgacaaaattttgtttttactttaatatttcttaaaatttctcaaattaaaaaaatatatatatttccaatgaaagtttttttatgggaaattttgcataaaaatatatttttttcaaataaaacatgaccaaaaaccatttatgtatgacttgattcaatctaatttattaatatttttggtgatttttcatgaattcaaaaagaaatccgcgacatttattgtttttaattttaaaaaataataaaaaataaaaataaatttaccttttagagagtgatcgagaacaaaaaacaacgtaagcaaaaaaaaattgatactcatggccagcaggcccctaaccagaaaaaaaactttggaggcttttgcctctaaaatttttcccaatgtaatttttaatttttcaacttttcttggcccgcggaattaaactcgtatttttgaagatattttttcgcgaaatttgcta

SEQ ID NO: 61253 - DNA, 599 bp, Heterodera glycines
  Genomic contig location: Contig_ID=SeqID_30863; Location=1132..1730; Strand=+
  SCN-specific regions: Sequence locations=1-413,459-599
atggcgaggacaacgtatgcaaaaactgcaaaagctgcacactgttgtaacaaagtgttcacgagtccgtacgttcagtgtcaaattccgggatggcgtgccaaagggtacaaaggcaatgtgccggtcattatcggagtgccaaagaagcgtgacgttggtatgccaatttcaaaaagcaggatgtaaaaatgtcattttaaatgcctatgaattcttttttttcattcttcctctccacttttgtaacattaaatgggattctcattaaagggccatttccttttttagctcaatttgtattttccagcacatgcttaaattacctttcaaaacgggattctggttcacaatttaaaacaaatttatttgttttcgttgcaaagatatggaaatattggaaaaacatttagtaaaattaactaaaaattctaaaatatttattaatttaattttaaggctgttccaatagcaatccgtgcgcaggaaatggctacaaatgtgtggcctataagaagggggacgacaaacttctgctggagggtccgtatcgttttggcgccgacgttttggcgccagcacgagttttcggactataa

SEQ ID NO: 61254 - DNA, 411 bp, Heterodera glycines
  Genomic contig location: Contig_ID=SeqID_30865; Location=100..510; Strand=-
  SCN-specific regions: Sequence locations=1-130,163-270,292-411
atgccttttgccccatgctttagtttactgtatcttttgtcgagcaaggaacactgtccccgctacatcaaatggcttgacgaggaaaagcgttcgtctgtttcgttggggaccggacctgacgaaaaatggcagaaaaatattttttccccaaaaatttcaggcattttcaagctgatcgactccaaaatagtgagtgtatggaggatacacatatgcaaaaccattttagatttcttgaaataaatttttggtatattttcagcgatttttaggaaaaatttgaaaaaacagcattcatcataagatttcgaaaaacgttagtttggacgactggcaaaaaaattgctttcgaataatttgtacactaattgactaattagcgaacattctcactcatcgatgattaaa

SEQ ID NO: 61255 - DNA, 1297 bp, Heterodera glycines
  Genomic contig location: Contig_ID=SeqID_30866; Location=541..1837; Strand=-
  SCN-specific regions: Sequence locations=1-55,77-185,207-1029,1051 -1297
atggctaatacaattttacaaacacttgcaattgaacatcaaaaacatttacaacttcaacaacaacagcaaatgcaacaggaagatgatggggaattcggtgcacaacagagaaaacgcaagaccagttgtcgggcgagtattgcattgaatatggagcagaaaatgcgactgatcggtgagtcaataaattttgtttaaattttcaaccgattgattttactgtattccattttactgttttgcctttgacattcaccatttttttcaatccttcactgattgtgataatgcctctatagttgagttatataaagattacatccacgaaaggccacaaatttgggactgcaatgttgagggattccgcagcaatcagtcgcgtcagtccgccttcaatgaggtcgccgtacttctttcggatgacattgaaacattttcgagtagggataattgaatttgggtaaaagaaaaaaacattttttagggatacaaatccaagaggaatggggcaaattgcgctactgtttcacgcgcattatgaagaaattgttggaggaaggaggcgggagaacggtcgacgaggggcagctgaacaccatttcatggccttattggaagcgaatggagtttttgctgcccggcgttcgggcacaactcgcgcaccaaccgacatcgacggagagtgaatgtggcaatcaagagcaggggtaagaccgaaaagcacaaaatggcaatgtaccgtaagaacatttgaatcacagttcaccaggaaaagaatcgaatgtgtccgtcacggcgttgccgaaagtccgtaggaagcgcagtgtccggaagaatagcgtagcaatggctgagagacaggagtgagactttgtgtcattgtttatttgtaagttatttttgaagagttcaaacgaacggtcccaccactgctacccgtgcaaaaacaccgccccaaccgtttaccactcaagactttttaatggccaattttgctgcactgaaaacttcacagaatttgctcggccaattccaacaacaacaacagatgttgaataattgtcacgcatcgaccgctattcagcgtcaaagatccattgattatgacacggagcgggagaagaacagcgaaatgggaccaatgacgggcggagttgggacagcgatgtcaactgccgatttggtcaccgcacttgggacaatcaaagcgcagaacaacagcagcaatatcggaacggacaaatgtgaggataatgaaaaaacaagaaggaatttgaggaatttcgttaagtaa

SEQ ID NO: 61256 - DNA, 570 bp, Heterodera glycines
  Genomic contig location: Contig_ID=SeqID_30867; Location=793..1362; Strand=-
  SCN-specific regions: Sequence locations=1-109,131-570
atggttaagcaattgcaaaatttgactttcactgctggtgcctttgaaggaaattctgccaacaaatggcttcaaaagagtgccattgaatttttgtgcaatacaaaaattgaaaagaatttacaaaaattggaaagtgataacaaaacatatggcaaatttgtcgtgaaaatggaaaattttaaggcaattttttgccaccaattggaaaatggtaaaagttttgaggaaatttcacagaatttggtgcagccaatcataaaagaattgcaaaatttgaacatttttgacccaaatttaattggaagcctcagaagaattgccgattttcaagcttttaacgatgaaaacagagaacaaatggccaaattgatggaccattttatggctggacttcgctcactttggcacatcataaaaagtcgggaatagatttgattttatgaagaaaagtgggtgggtattcattgaccctgaaatgagaaattaaaaatttttgttccaatccaatttagcgtatttcctaaaatatatccctgctccctaaattagagccgcactggaaataaa

SEQ ID NO: 61257 - DNA, 220 bp, Heterodera glycines
  Genomic contig location: Contig_ID=SeqID_30869; Location=123..342; Strand=-
  SCN-specific regions: Sequence locations=1-19,41-220
tatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaa

SEQ ID NO: 61258 - DNA, 767 bp, Heterodera glycines
  Genomic contig location: Contig_ID=SeqID_30870; Location=235..1001; Strand=-
  SCN-specific regions: Sequence locations=1-767
atgaagtaccgcgccttccctgtgggtctgccgcgggtgctcagcgcagagcagcttgaccgcgacgcgggggtgcggttgccgtggacgagcgcggagcagaaccccttccgcggtttcctccactgccgcgtgctgccgcccttgcccgccgagctgggcgaccgccacgccctgttgccctaccggacgcgcacggggcggctgacttttccgctgtgcgccgcgtgcgccgagtgggccaacgcggacaagaaggtgcagcgccaccatcggacggtgccccgctgtcgacaccgggcggcgcaacgtgcctggacgcacgcctacaccgatgtggagctgaacgcggcgctacagctcggctacagggtgctggcgctgtacgaagtgtggcactacgaccgctgggcgagcctggaggcgggcaaaagcctgttcgccggctacgtcgacacaatgctccggctgaaggtggaggcgagcgggtggccggccgactgccagacggtggagcagcgcgcgcgctacgttgcgcgctacgcggaccgggagggcatccgactcgaggcgggccgcgtgcagccgaacccggggctgcgcgcggtcgccaaggcattgctgaactccctgtggggcaagctggcccagcgcgcggagcgggacgacgtgtgctacacgggcagcgcgcgcgagttccacgagctgttgggcgacccgcgccaagatgtggtcgactttgtccacctcaacgagcagctggaccg

SEQ ID NO: 61259 - DNA, 1298 bp, Heterodera glycines
  Genomic contig location: Contig_ID=SeqID_6356; Location=1943..3240; Strand=+
  SCN-specific regions: Sequence locations=1-301,324-450,480-692,714 -733,756-762,805-820,864-962,985-1298
atgttggaatcggacactttggcccaaaatcagtcggcaagcgtttcgcccggatggaatgacccgccgccgttggccaacccggcgacaacgacagctgcggcacatgccggcctcaccaacggagtggctaacggcgcaggtcggctgcatttgcagcgacagcgaaggcccgtggacccgtccgtccaggtttttggggaccaattctggtattttttggcactgtaggactaattttggattttcatccatgaaattaaaaactcggaaatttttgccaaaaaatttttgttttatggcgttttgcttttctatggccccttaggcgtcaaaaaacccaaaattgtcggatgaattaatgctcattctccaaattggctttagagtgcggaaaactttgtccaattgagaggcaatacgtcgtccgcagcaaatttgcagcccgcccaaccgcaacaacaacagcaaaaccatgtaaaacactatttgaaagaatgcgggaggaaaaaatggcatttttagcccaatttacgacggattttgcacaaaaaatttatcccttctttttcttttgcctttcattttcggcattttctcaattttttcatttttaatttaccatgattaaaaacgatgaaatcaactatcgaatatcatatttaactttggttttcatattattcttggtattttatatttgcaagtaaaaaatttgaccaattttcgaagaaattatggactcaaaacattttgggatactcagtttttctaaattttgttcaatttcttttaaattttgggcgctatttaaaaagagtaaccttttgaattctatcaaaaacaaaaggggggacccttttgttttgcaaaatttttttgagataaaaatccatgaaaatttgttatccgagggttttagaggtcgctgatcacgaatctgacatctaattcgaggtcttggacccaaagaaccccagggaataatttttcatgactaaatattaaaaaattttgcaaacaaaagggtcccccctttttttgtgtttgctttttgataatttcaaaaaggccctctttgcaagtagcgccgaaatttttactagggtcaaaaaaattttcctctggtcagattttcttaaaattttgcataggcccatattttgaccccctctatcgaatcacagtttattttttagctgtctagtttttaactcgagatcggctcttgtgtttttacaagggaaaatcccctaaaaaatttaagtatcgcaaagttttggcgttctgattacaaa

SEQ ID NO: 61260 - DNA, 65 bp, Heterodera glycines
  Genomic contig location: Contig_ID=SeqID_6357; Location=56..120; Strand=-
  SCN-specific regions: Sequence locations=1-65
atgaaactcgtaggcctcgactcacactgtttgttccgaaaaacgagcaaagaaagtttgaaatt

SEQ ID NO: 61261 - DNA, 595 bp, Heterodera glycines
  Genomic contig location: Contig_ID=SeqID_30872; Location=696..1290; Strand=+
  SCN-specific regions: Sequence locations=1-200,230-247,272-287,322-595
atggaaagcccaattgggcttgaccagtaagaaaatttgtatttaaaaaatgtaattaattaaactaaagaaagataaaacgctaattaatttattttaaaccagaaaaaaaacactgatgaaaacagacgcaaaattgtaaacaaatatatgaaactaaaaaaagtcatcgctggtaaacggagaagcaaatagtgcgcaaaaggggggaaaaatttcaaaagaattggcaattcataagagaccgattaaaaaatggaaagcaaaatttggactaaatgataatgattaaaaatacataaaaataataaattaattaatcaattgaaaagaaaaaacattttgcagagaaccgtcgttacaatgtacacaccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaaatttttaatagttaaaatcataaagcaaaaatcatttttttaaattttattccaaatttaaaaatca

SEQ ID NO: 61262 - DNA, 506 bp, Heterodera glycines
  Genomic contig location: Contig_ID=SeqID_30878; Location=106..611; Strand=-
  SCN-specific regions: Sequence locations=1-56,78-244,268-506
atgtgcttctcgagttcatggacttctatgactacggtattgaagaacaacagggacgaagaggaggaggccaagggcgtagccagacccttggcacttacttagaatccatgtgcagaaaaatgcaattgatgggatggaggaatggggggattcggggatggcaccactcggggaaggggatgacaccactaggggaaggggatggcaccactcggggacggggatggcaccactcggggaaggggaacttatccccgaaaaatgccaaaatgtcagcaaatggagcaaacctaacatattttaaaattgcaataataaacacctcacaaatcgttacagtaccttgtcccactaactgcagttgtggctcaacaactagagtatttagcccgggaacaaacagtagcggagcagagagcagcccaagcgtaacacggccggcatttgcccaccttttggtagtgcggttcatcatgtcacactcaatctttaacaaaattaaa

SEQ ID NO: 61263 - DNA, 1408 bp, Heterodera glycines
  Genomic contig location: Contig_ID=SeqID_30880; Location=25..1432; Strand=+
  SCN-specific regions: Sequence locations=1-1,52-96,118-403,425 -506,529-646,672-972,998-1003,1025-1057,1087-1175,1207-1208,1234 -1240,1265-1361,1394-1408
atgcttcttcttctgttgctgcttctgctgttgttgttcgtgctgttgttggagtgtgtgtgtgttacatggcaataagccttggacagacaacggcggacggggacgcgacgacgcaaaagaaaaagcatccattcattcattccgaaattccaatcacccgggggcatctctatctatctcatccacccgccacattcacccactgtccatgattgaagaaatggaagggatatatcgatatcgatgttcattcgtcctccggctgatcggatggggggggaatacggacacaactcagcagtctttcccggctcgaccctactgtctgcgttcccatccaaggaattttcaattttatgcttttacattattatatcggagattgagattcattaatcaggcattgattttgattttttagaacctaaaaattgcaaaaaacggcgtgtaatagaattacactccaaaaaatccaaaattttgtttattctgtattattgttgcacaacaattcacaattggaatatttgtagaattctgactttttcggaaatataaatttcgacaattgtcgattgtttcattttaaaaaaaagttaatttttaatggatatatttttcaaaaatttggtcgtttattgtggaggatatattttatttttatttgagtaaatcagtaaaaaaaaatctaatcccaagtcatgaaaggatcatctttttagtctttatactgtatcacaaaatatcctattaaagttcacaaacccacaataactactgtataccgtacatattgtcgttgttcattgttttcctatctctagaaaagggttagtgaatggatttgtttgcaatttggagacaattaaatagaaattgataagcaatgttaaagtaatccatgtgctttttcctgggatgaattgtcctatggccaattccgatcaatcgatttaaacacattttcgtttctcttctgtcatttgtttggccaatgttatgtgtatttatctatttgtttatctatctatattcatccattaagccaatcacttttccctccagcagcagcagcagaggcaagggaaaagctgccgtccttaaaccacacaatttcaaagccaaaaaacaaaaacaacaaagtagcaaattgacaaactgagacaagcaacaaagcaatttaaaaaattaattcataaatggcccagcaacagcaacaacaacaacaaccggcggcacaacaaccggcggcagagcaacaagaacaaggattttggtcagaaactaaaaaaaacaaaattttttttttgaaacgattaaatccgtgctgagccgaaccttaaaaaagcatcaatgacattaatatttatatttaattaaaattttatttgaactctgttttcaa

SEQ ID NO: 61264 - DNA, 740 bp, Heterodera glycines
  Genomic contig location: Contig_ID=SeqID_30881; Location=784..1523; Strand=-
  SCN-specific regions: Sequence locations=1-740
atgataaaacttcagctgagtaaaaaggcgacagatttcgaattggactgtggcgcagatgtcacactcatcaccaagaatgattggatgtccatcggaaggccgaaacttggacaaacttcaggattgatggcatatggaaaaaagccgatcaaagtccttggatcgttcaaaacggatgtggtgtacaacggcaaagaagtgaatgccgaaatttatgtcgttgacggcgaaggaaaaaatttgtgtgggagagatttgattggtgaattgcaaatcgatctcaacaaagcgttcggaatccgatcgatcaatgaagtcaagtgcaaggcagtggatcgagagctggaagcggtgcttctaaagtacggtgaggtcttcaatgacggactcggccgatgcacaaggcaaatttcgctgaaatttaagccggaagtgcaatcgaagaagtgcaaaccgcgtcccgtgccttttgcattgagacccgaagtggagaaagtcatcgacaagtgggtcaaagatggagtgttggagcaggtgacaacttccgattgggcaacatcgttgtgattataccaaaagccgggaacaaaattcgcttgtgttgcgactacaaagtcactgtgaaccaatggcttgacatccatcaatacccgttgccgcgcccggaagaattgttcagcgtattgaatggaggcgaaaagttttcaaagctggatttgaaggaggcgtatctttaa

SEQ ID NO: 61265 - DNA, 1030 bp, Heterodera glycines
  Genomic contig location: Contig_ID=SeqID_30888; Location=1..1030; Strand=-
  SCN-specific regions: Sequence locations=1-31,53-273,295-323,345 -408,458-751,776-988,1010-1030
  Gene Ontology: Mol. function=transporter activity; Cellular component= integral to membrane; Biological process=embryogenesis and morphogenesis
ttgcccgactttcttcaggctgcttgcaccactccctttttctgctctcctccctggccgaccacctcggccgctccaatatggcacacatccaaagctcttctttggccgggggaatagcaattggtgccgttgccaatgtgatcctttacccgcaccatgccattatcgttggtgcagctgccgctttaacttctgtgcttggccatgtttatgtgacggtacggtacggtatattactgtcagggtggtcattttgtcattaataatggcaagacaatgaagcaaaatgaccacatagaacaaacaacattcagccaaaaatcctggaaaagcgcctctccatcaacgacacttgcggcgcccactctctccatggccttccttcgcttctcgccggggtaagagttaatggcaattcgtataacatttttaaatgttttttaattaaaaatcttatacgagttacgatatgtacgaattgtcatgccaccggcgtcccaaatggccaattttttactccactcgcttttcttgaccatttttccttcttcccattctcagttccttagtgcactttttgtacttctctatgaaccggaagagtacggagagaactttgtggagcagtacagtgccatttaccccaaatggcaaggaaatgccaatgcattgaggccaatatctcacaatttaggaagggagctgcggctcccggtgccacccgcgatttgcgcacgcagggtgagaaaatgggagaggaggggaggggggcaagcggatccggcacaatccccgtcaattggcacccctcccctctgcagcattcttccaacttgccgggttggcactgacttttctgatggccgtcatgggcggtctcttctccggttgggtgatgaattggtcaatgcttaaccaagtgcagccgcggccttcttatgaggacaccaattactatttgcacgccgaaatgaatctctttgccaaagcaagtcattgtcaaatgaacaaaatgaatgaggagaaa

SEQ ID NO: 61266 - DNA, 291 bp, Heterodera glycines
  Genomic contig location: Contig_ID=SeqID_30890; Location=1..291; Strand=+
  SCN-specific regions: Sequence locations=1-291
agcaacaaagcactttgatctgtgccggtttgcctctgttcaaaagttcggacgacgcgagcgatttgcgcattcaaatggcactcatccaattcattctttcgctgggttcaatttacagggattgaacggccaccaaacaatacgaagggattgggagttccctcccaagcacatttttaataaattggatgaattattcaatcgtttcttcaatagatattatttattgtagtatttgaggagccacacttttgtttaaattgacgtgataaatatttcgatgccaat

SEQ ID NO: 61267 - DNA, 548 bp, Heterodera glycines
  Genomic contig location: Contig_ID=SeqID_6362; Location=701..1248; Strand=+
  SCN-specific regions: Sequence locations=1-109,131-229,287-303,329 -398,421-505,529-548
atgacaagaaacaaaaagatcagtaaaatgttaaaattttgtgccaaagaaattgccaagagacgggtgcgaggccgcgaagcggccaagccataatagtcatttttatcattcataatacaacacaatcgtactgcctagcgggggatgcgccgaaggcgctaccccgctagttgagacaaaaattcaaatctttttggaacttggaggcaaaaactgaaacggtgtgtaaattaagtaattagaaaataatttgaatctttaaattcttaaaaataaataattagaactaatttgaatctgaatttaaaaacaaataaaaattcagtccgccgagagtgccacatcatattcaatgattgaggacattggcattgccactgtcacattgggaccatgggacaaagacattttggaaatgtttttgcaagagcatttttttaacaaattaattttcgacacgcaaaaaggcaagtttcactgttgtagaatggattatttgttcttattaatttaatttaataatatgggcaaacaaaaaaaaatga

SEQ ID NO: 61268 - DNA, 522 bp, Heterodera glycines
  Genomic contig location: Contig_ID=SeqID_6363; Location=1799..2320; Strand=+
  SCN-specific regions: Sequence locations=1-150,172-181,208-247,291 -341,363-522
atgcgactctctcaaactaataaagagagctttctttcccctaaagatgtgattgaaagaactgcaagtgggttccctgtgtagctcagtggttatagcatccccgatgggttcgaatcccaccgcaggctgtctcatgtttccaaaaacatttgaaatataattctgtttttggacaaccttaattaaatgtttattcaataaattttggcttcaccaattgaggcaattgtttcgataccttcggattatatataaatataatgtatttatatattattgtataaattcaatcttataggggccgttcatggaaatatggatataaatcgcgaaatatggaaaaatatggaaaatatggatatagaaacccatcctaggagcttcaaaccaagctaaaaacatgtttttcgtgcgtttcaggcctcccaaagtccaggaaaaaaaatatggatttccatataatttcatgccatagtcatcatattcttcttccaaatgtcttttgacccaatccaatta

SEQ ID NO: 61269 - DNA, 1950 bp, Heterodera glycines
  Genomic contig location: Contig_ID=SeqID_6364; Location=89..2038; Strand=+
  SCN-specific regions: Sequence locations=1-113,135-237,276-456,482 -674,728-1241,1263-1926,1948-1950
atgtcaattaatgaaacaattttgcaattggcaattgacacagcgaatgaatatccgaaaaaggaaactttagacggaataattcgacataaatttgaaaagaaattgaaggatttgtttaaaaaggcagaagaaaaggcaaaaaaagataatccacggagagccaatgagataaatgatgacataaataaaatacttttgggttcaaaattcaatgactcatatacatgggtaagcaaaaattatattattatttttaattaaaattaaatttagttatctgacgccttactttcggtctttgtgaaaggaaatgtgacgaagtttaacaaattccttaagcgactaaaacactaccaagcggcagcattttaccaagatgaaagtgatctttgcattgggtatgagaattggcaatgtgacaaaatcggggagaaatttgaaggatatgaacagacagaaacccaaaaatataataaatatttggacataatattcgaatatttattcagacttaatgtccaaggtttgacaaaattattagggtttgaaattttattttaagaaaaagagtaaaatatgtacacaataaatttgtaaaagaaacaacaacagaattctcgaaatatagaagaaacatgtattcaaaaaggcctaatttgcatattttatgctatttattttttaaaaagatagcaattatttaagattatataaaaaaaaatttgttgaatttctcaaaaaccataaaatatattagaaaaatggaaacatatacgaatcgtttagaaaccagtcaaaaagtccctaattattagaaatttttgattttgaataataaagatttgctttttgaaggtaaaaacgctgaattggcatatcatttgccagcagtgaagccaatatttatgacagatgatggaaacgtttctttaattcaatttatccgaagccttaatgagaagttgaagtataaaagtgtagacaaattggatttggattatcaccctcgggtgaatatttatttgttaaatgaattggatttgaattatgcaattaaagaggatgaaaaaaagaaagaaaagccattaaaaaatgcattggacacaaaaattgccaaaatccgtgaagaatttgaaggaaaaatgaaaaatctttgtgataatgtcaaggaaagaacatcagaagaaagggaaaaatttgtagaagcattctattttggcactttcgattcgtcgccattttcataaaaattctctttttcattcaatgtttttcttatactttcctattcttttcccactctttatgcttctgtcttttttcttttttcaactattttatgtgggctaatttttgagtaagtaaaattttcattgctaacaaaagtagtgagtgatttgtcgaaaattataaaaagccacatggacaacaatttagttgaattccaaatccaaaaaaaagatagaacatctttgccccgttgtaaaagctcgcgtaatttcttcagttcatcccagttatttcccttcaaaaacattggcactagcatctcccgggccatttggtcccttctacaaacgcaaattgattttctcggatcggcagacttttcaagtgcttcgatttgcaaataagtgatcgattgatgatacagaatgtctctcgcagagacaataatcaaaatcgaaaaatgcttttcaaaattccacaaagtgctgacaattaacggttttaatgcgtttttgaatggatttttttcacattggaagtgttgaaatttccatcttttcccctcttctcgctcacgaaaattttccgtttttgttaaactctgagaaatttcctatcgctttttttctttttgtctccaacgactttgttccataaaatgaattaactgatcaggaagaatgaaagatttcgataataataatgagaagaaatgaa

SEQ ID NO: 61270 - DNA, 876 bp, Heterodera glycines
  Genomic contig location: Contig_ID=SeqID_6365; Location=88..963; Strand=-
  SCN-specific regions: Sequence locations=1-128,151-204,234-526,553 -818,840-876
atgtacaaaaaagcggaagaaagggcaaaagaatacggttattggagtgccaaaataaatgatgacaagcataggataattgtgggatcgaaattcgatgatcaattgacatgggtgagaattaacattcaatgaaaatttaataaattcaaaatttagactgaagatgctttcttttcggaatttgtcaaaggattaacgacaaattcaaagaaattttttaaaatggcaaaagaatattcgaattatttacgtctaaagaaagagaaaggatattatattttctctgatgaaaacacaatgatatcttttgggttatacgaaattgagaaaatgaaaatgcatttgacacaaaaatataaagcccatcttggcattatgtatcagatgaaagagaattggcattgtgataaaattgggaaggaatttgaagaagaatgccaaaaatatcgaaaatatttggacattttgtacgaatatttattccgattgtatgctgaaggtttgtttggatttattaaaatggtaataataataataataatttattaagctaaagatccgaaggtgtcgaaacaattgtcaccattggtgaagccaatatttatgtatggaaatagtagtccttattgtttaatcgatattgtgagatggctgaatgcaatttcaaaatatttttgggaaaaagaggaaaaagtctatatttggagtatcaatttggtaaatgaagaggaattgaattacgaaattaaagaggagaaaaattggttcgataaaaataaacaattgaacggaccaacggacattcaaagtatttgggaacaatttgagcaaaaaatgggtgaaattgccgaaaatgcaaaagaaaatgcctaa

SEQ ID NO: 61271 - DNA, 425 bp, Heterodera glycines
  Genomic contig location: Contig_ID=SeqID_30893; Location=354..778; Strand=-
  SCN-specific regions: Sequence locations=1-425
atgcatttttgtacctcttctgccatttgttgtacctacttctctcttttaatcactgttgtacctcttctaatcactgttgcacctcttataatcactgttgtacctcttataatcactgttgtacctcttataatcactgttgaacctcttctaatcactcttctaatcgctgttgtacctcttctatttactgttgtacctcttctaatcacggctgaacctgttctaaacactcttctaatcgctgttgaacctcttctaataactgttgtacctcttctatttactgttgtacatcttttaatcactgttgtacctcttctaatcactcttctaatcactgttgaacctcttctaatcactcttctaatcgctgttgtacctcttctatttactgttgtacctcttctaatcacaaaggg

SEQ ID NO: 61272 - DNA, 287 bp, Heterodera glycines
  Genomic contig location: Contig_ID=SeqID_30896; Location=1244..1530; Strand=+
  SCN-specific regions: Sequence locations=1-91,120-172,204-217,240-287
atgtcgcatgaagaagcaataatctacggcaaaattgatcgctacctaagaatcggactctacgacaacgcctgccgtgatttgccaacggtatttaatgttatataaattataaaaatgcattataagtagggttgggaattatatgcatagagcccggcgggatcgggacttaaaaaagttaaatttttaattaatattttcgaaaaaccaaaaattcaattttttgaaatatttttcagtccttagaggtcaaaaaggccgttttaaagggggggccgttttaa

SEQ ID NO: 61273 - DNA, 503 bp, Heterodera glycines
  Genomic contig location: Contig_ID=SeqID_30900; Location=341..843; Strand=-
  SCN-specific regions: Sequence locations=1-124,153-293,315-388,417-503
caagttttttacaaccacttattgccaatttaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactc

SEQ ID NO: 61274 - DNA, 78 bp, Heterodera glycines
  Genomic contig location: Contig_ID=SeqID_30901; Location=967..1044; Strand=+
  SCN-specific regions: Sequence locations=1-78
atgcagtccccactggttatatcaattatatcaatcgaattgaggaacgaattcccgttctcggctcatcaggccgaa

SEQ ID NO: 61275 - DNA, 2014 bp, Heterodera glycines
  Genomic contig location: Contig_ID=SeqID_6366; Location=1347..3360; Strand=+
  SCN-specific regions: Sequence locations=1-298,320-539,597-702,724 -859,885-1509,1531-2014
atggctctactccgattcgcagagaccaaaacaaatcgtgggaaaattcttctatctcgtagcggatatgactacactttcgaggttaaaaggctaatttaatttcgtgaaaatgttaaacgaaaaattctaaggctgtttcgaaaactgaagacggaatggagtattggtgttgcccaaaccgtccaccttattgcccagggcgtgcttgtgtacaaggccgttgggaagtcgatgccgatgggtcgcgatataaaattggacgcactaccggacagcataaccatccacccgttttggggggtcatatggtagaaatttaaaatgtaacgggtgttaagtagctaattaggtgagacaagcatctgaacgtctccgacaagaggcgcaaagcgaattcccgaccacaagccgtaacatcatcagagaagttcggtcgaaccttagtgatgagattcgggcaatcagtgcaccctctgcagctgatatgaggcgaacatataattatcagaaacggaatcatcaggaagaggcaaatgataattagataattaaaaatataaatttaataagcaaaaataattttaaaaataaatggttaggtcggcgatgttggattggatatcttacccgcatctcaaatcatcataccggacagattgcgtgatcgtacgatttatgatcaaactgttaatggagaaaaaatgatcattttttgttcttgttttggccttgatcttttggcgaattatcagaatgaagtggcaatcgatggcacttttgaggtgaataactaaagggcacttttagctgatagtggcgagaggcatataaaatgtgccgctaccaatataccacaaaataagtaaaattgtttttatcttagacatgcccaaggggatttactcaagtctacacactggcagttgtcatcgatcattgtgcagttccggcagtttatggtttactgcccagcaaaactctcgccacatacacaagattcttcgaaacaattcgtcagtctgttggcaataattggttcccgtaccgtattatgagcgatttcgaatcgggagcgatcactgcagctggcaacgtctttccaaattccataagaaccggatgcttgtttcactttggacaagcaatttggcgaagaattcagcgattgccaaatttgctcacgcgatatcgtgacgatgaagttgtcagaacatccttgcggtctctacaagcgctggcttttgtccccgtcgactttgtctacaactatttttgcattgccatgtcaattcttgagccgactcctgagcttcaagagctgatcatctatttcattaacacgtggatcgggcctcgccgaatcatgcaaaatgaagaagttttggttcacgatgcaggcggagtagctgataattggattcgagggagaattgaggcgcttaatttggcacagactgacgctctttttccaattgaattgtggaatgtggtggacagagtagcagaagggcttggaagaacaaacaattcgcttgaagtgtggtgggatgtgaccattttttcatgtcttttcttcagggttggcattcaacttggaatgtgcaccttagggggaaccaacgaccgagttcatttgctcggaaaatgatcgaggaagatgaactgtggagaattcgggttgcagattatcagattgcaccggctgacggcattaaagggcctcatgaaacgagaaaggccaaatacattcgtcaagaccaaaacttggaagcacttgtgcaggattttttcaatcgtgatccgatccaatttcttcgcgcttgcgcttatcatctgcacttttaaacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatgtcggaaaacagtaaa

SEQ ID NO: 61276 - DNA, 663 bp, Heterodera glycines
  Genomic contig location: Contig_ID=SeqID_6366; Location=3558..4220; Strand=-
  SCN-specific regions: Sequence locations=1-74,96-489,511-663
cgtccagaaatttttagactaatccgaagcaaagcacgaatgaattaaagaggcgaaagaattcacagtatcgtttctaatagggaaatattgacaggatattccgctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaaatacaaataattcaacccatctattctatgaccacattctgaaaaaaatcccagaaatacgaggaaagatatgcttggtcacaacaaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactc

SEQ ID NO: 61277 - DNA, 319 bp, Heterodera glycines
  Genomic contig location: Contig_ID=SeqID_30904; Location=6..324; Strand=+
  SCN-specific regions: Sequence locations=1-319
gagcaaaggggacgccgacttcgaggagtgccttttctccacttccatcgaacggattgaaaggctatcgcgcgaagaggtgcgccaaaaccaaggggaaaaggattaattcaggggggggggagataaattgacaacgatgacatttgtcggcaataatctaattgttcaggttaatcgggagttgctgctcgcagaccgtgacaaccgaatgctgaagcaacgagttacgctgctaagagacagctaccagcaagtccaagaagaaaatcgaaaattgaagagccttttgaacgacaacggaatgaattctctatga

SEQ ID NO: 61278 - DNA, 716 bp, Heterodera glycines
  Genomic contig location: Contig_ID=SeqID_30906; Location=404..1119; Strand=-
  SCN-specific regions: Sequence locations=1-665,687-716
gagttcaatcactgggactttattctcctgcgtttcaatcactgggactcaaccctccagcatttcaatcactgggactcaaccctccagcattccagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcactgggactcaaccctccagcatttcaatcactgggactcaattctcttgcattccaatcactgggacctaacctcaccggtccttcggcattccaatcactgggactcaattctcctgcatttcaatcactgggactcaaccctccagcatttcaatcaccgggactcaattctccaggacttcaatcacggggactcagtttttatgcatttcaatcacagggactcaacacaccagcatttcaatcaccgggactcaattctccaggacttcaatcacggggactctattctcctgcgtttcaatcacccggactcagtttttatgcattccaatcaccgggactcattctcctgcatttcaatcactggtcaattctcttgcattccaatcactgggacctaa

SEQ ID NO: 61279 - DNA, 701 bp, Heterodera glycines
  Genomic contig location: Contig_ID=SeqID_30908; Location=310..1010; Strand=+
  SCN-specific regions: Sequence locations=1-157,184-262,309-374,397 -512,534-701
atgtttttgttcgccatttcaaggagaattttgagtgggaccatgactaatggcattttctatttacaattcgtaatcattctttaattactgagaaattaaaaccttaaagattggcatttcaaataaacgcaattcggcaacgctgtctcaatataatttgaaattcattaaattggcaaatgcatttgtcatttcgaatgctttttgtgtagcaattagagtttaattaaagttgaaaaccgttcttacttggtgtttcatttaaatataataatatttttaattaaagaaattctttaaaaattcaacaagtactatcgcaacgcattccgcacaaagtttccatttcattatatttagtaatttccattttaattattatgttattacatacactctgactaaacttgccataagctaaatagcaaatcagccaaaaaaaaaagtcaaaatggggttttgtgaatcaaaatgtggcaaaaagatacatgcattcaagtaatgaaatcttcagatattgtatttttcagttcgttttaaagatggaacaaatccgagtctggaagcacgaactctcagcatctgaatcagctaaactagaaaatcaccttttatagaaaaaaatacagcattttcaaaaacacatgctaatgaggctttggcggcagcgccgactgaaaattatattccgatttgta

SEQ ID NO: 61280 - DNA, 804 bp, Heterodera glycines
  Genomic contig location: Contig_ID=SeqID_6367; Location=414..1217; Strand=-
  SCN-specific regions: Sequence locations=1-9,40-230,252-804
atgcagttgtcgcaggcgcttcgcctcgtcaatgaacggacgcttgtcagcttcgtccaacagcttccactcgtggcccaactgtttggagatggtcgaattgtgcattttcggattgtccgccgccattcgctttcgcttcccgcgcgaccacaccataaaggcactgacaaatgggcacacttttcaatgattaattcaggtgaaataaaaaatcaattattttattgtaaaattcaagaaaaacccaacaaaaattataaattttgttacttcatcggccttttcacgtgctcatccgcttcttcgctgcagcgatggcttacaacagcagcagttgctggtggtaagcaattcgcttaaaaaaccgtaatatggacattttctcccactgttaaatgtcgaacattccataaactccgcttccttgggtctttttttgacctcatctagaatagtatttggtggcaaaaaatcgcctaaaaggtactaaaattaaaaaaagatgaaagggcaccaaaatggaaaaaatgcataaaaaactgaaaatagccaaaaggcaaaaattcttttggaaaagggaaaaattttaacatttaaaaaatgatacggaatgtttttttaatttgattaatattattgtttcataaaatgttcactttgagcattgtccggttctttgattactttttccattgccaaactgtacagttgtgccgcgactgatcgaagacaatggaatttgtttttgatgttgtgtaatgagtggtagcattaaaatgacaattaataatcttaaataaa

SEQ ID NO: 61281 - DNA, 346 bp, Heterodera glycines
  Genomic contig location: Contig_ID=SeqID_6367; Location=874..1219; Strand=+
  SCN-specific regions: Sequence locations=1-93,115-305,336-346
  Gene Ontology: Mol. function=transcription factor activity; Cellular component=cytoplasm; Biological process=cell fate specification
ccagcaactgctgctgttgtaagccatcgctgcagcgaagaagcggatgagcacgtgaaaaggccgatgaagtaacaaaatttataatttttgttgggtttttcttgaattttacaataaaataattgattttttatttcacctgaattaatcattgaaaagtgtgcccatttgtcagtgcctttatggtgtggtcgcgcgggaagcgaaagcgaatggcggcggacaatccgaaaatgcacaattcgaccatctccaaacagttgggccacgagtggaagctgttggacgaagctgacaagcgtccgttcattgacgaggcgaagcgcctgcgacaactgcatat

SEQ ID NO: 61282 - DNA, 578 bp, Heterodera glycines
  Genomic contig location: Contig_ID=SeqID_6369; Location=29..606; Strand=+
  SCN-specific regions: Sequence locations=1-412,435-493,515-578
aaaatttcccattttcatggcgtcgcatttgaccatgttgagctgcacttctacaagggtggcgtgccgatttggactggtccgatcaaagcgtccgctgttggacttgttttctacccgtgtttgtgcattgatgagaattgtgttttggatatctgcttcagtgcggctaaatttagcccaaaagcgccattgggctatcaggagataatgtctgaacagacattgctttaatttttttggggcaaggacgatcccgggggcgggggaaaattcttaagaaaaaaaagcaaaaaatgatgaaagattttttttcctacgtttacctctccccaagccccaaaaactaaaccctagaaccatctctgtctgtggacaaaataaccagacaagttgccacaccgcctagcttaaaatgagaattaaagggaatttgtgggttaagttcgtttaaaaaatgccaaacttcatgcaaattgatttttttttaactcctttcattttttcaaaatggatttatatatattttataacaaaatagcataaggcttcttaaaaatttcagtatttttaatcaa

SEQ ID NO: 61283 - DNA, 1184 bp, Heterodera glycines
  Genomic contig location: Contig_ID=SeqID_6369; Location=775..1958; Strand=-
  SCN-specific regions: Sequence locations=1-43,65-775,886-903,926 -1125,1153-1157,1179-1184
atgaactttcatttgtcttttttatttgcttgctttaagtatttggctgctctttgctacttaataattgctgtgttgccaaagtttggcatcacaaatttgaaatggatggagctttgctttgttggcattactgctagtctcgtacttagtctgatcggagctgcaaaatgcactcaaattgttaggctttcataattaatatcaaataaaattctaattttcatttttttaactcagaatttaattatttgtttttttcatcaggtcgcgtgccaatttgcccatgtgattttttctttacaatattttttgacaagtaccatattcctgtatgtttttttttatgttttatcaatgtctaatttaattttaatgttttttagaatcatcccgtttggtatcagttgggcagcgccaaacaacactgtagatgaagtagcgttttttctaataaaaaaatagtttaaaaaaatgggtttgtgccgtgatgataagcgcaaacctgagaatttgaaagttttatcccaatctatcgaattttttttgttacaaaatggcaccaattttggtcaaatttagattgtttttttagcattttttttttcatccgtgacgaaagcgctgcctgggaaattttaaaagttttggttctatctatagacaaactttttttttgttacaaaaaaaggctatttttggattaatttttttatacaaatttcttcacaatttcaaaatccatttcccaaatcgaggtggaacataggaaactaattaaatcaaacaaatttaaaggaagtttattaaatcaaataaatttaaaggaaactaattaaatcaaataaatttaaaggaaactaattaaatcaaataaatttaaatgctttttttaaatttcagtggtcttcaatctttaaatattccgcagtgtctcttgttgtcggagcaactgtgttcaatttgacattacgagttgagcctcgaccttggactgaaatggatttcaaaaaagaatcaaaaagcgatgttaaaaactcaaaaaatgaacccattgacgaagagatgaaagaattccttagctaattttctattgatgattttgtgtacttttgagaatacgggattttatttttaattattttaaaattagtgtgaatttgattatattttgtgtaaataaa

SEQ ID NO: 61284 - DNA, 452 bp, Heterodera glycines
  misc_feature (304)..(304): n is a, c, g, or t
  Genomic contig location: Contig_ID=SeqID_30912; Location=829..1280; Strand=+
  SCN-specific regions: Sequence locations=1-301,366-452
atggcaccagagacaagcacgaaaacaatggaagtggttaccacggctaagatggaaaatgattcaattggtgagtgtaggacaaatagtacagaatagggagcttccgcaagtcaaaacaatttgctggaaatgcataattccggtgccaaaaagtgccgtaatctgtccctcctcattgaggaagctcgggaacttcggccccttttcaccgagaaatttcatgggttttttgcgttcttggcattcctttaaaaatagtcaattttgctaattttcgttcagatgacgatgaaatcagtanattaattatttttaattgtttttatattacattattaaatgaaaatcttacaaacattctgtgtgaagctctcaaaaatatttcgcaaattaagaaaatggtattgtgcgcccagccatctcgaacttatccattgttgtcatgctga

SEQ ID NO: 61285 - DNA, 261 bp, Heterodera glycines
  Genomic contig location: Contig_ID=SeqID_30914; Location=121..381; Strand=-
  SCN-specific regions: Sequence locations=1-261
atgtatggatttatcactatgagagtagttcgccaccctgttcataacgtcctttttgcacggttcgcattgcgaattgcaactcgcaatgcgacacatttttattggcgttctttggcatccgacacaaaaaattcgatggtcccacccgaaagtacaaaaacaccagcaatgccgtccgaaaacctgatcaaaatgcttcgaaaagacttggaggaacagttgaagctacagaaaaaagagcgggaacgacttcaattg

SEQ ID NO: 61286 - DNA, 739 bp, Heterodera glycines
  Genomic contig location: Contig_ID=SeqID_30914; Location=940..1678; Strand=+
  SCN-specific regions: Sequence locations=1-164,188-552,574-579,617-739
  Gene Ontology: Mol. function=carbohydrate binding; Cellular component= integral to endoplasmic reticulum membrane; Biological process=ER -associated protein catabolism
atggtaaggtttacaggggggaaaattatggtaagactcggacgggttcgggtaccactcgggcatttaccgggccggtcgagcacgggctaggcaaattttaatttaaaaaaatgctaattgtaagatttttccatgttttttttaacaattttccagaaaattgctgtccttgttgcactgttttggagaattgcaagcatctttttgttctgcaaactcttcgcaacggcccaagtccaagcaacacttcctaaattttcctcccataaaagcgaatttgcaggtgtttattacttgaagaggggggggggggggggttacatattagtaatctgactttaatggcaaaaaacctcaaatttgtcttggggcaaataattccgttttatgccaccaaaaaactccgtgatcttttttatacgtttttgtggggtgtatgcataaaaccaaaaaatacctaaatttttttttacagaaaaatacagctatatcgaaccagaagatgttgaaatggcgcgtgaccaggcacgggaaatgtttttcttcggatacaataactatatgaagtttttgtcgaatttatacaaaaaaaaatttaaaaaaattttttttacttaggcatgcttttccaatggacgagttggacccaattcattgcataggacgggggcctgattatgagaatccggcaaattggaacatcaacgatgtgctgggtgactattcactaacttta

SEQ ID NO: 61287 - DNA, 93 bp, Heterodera glycines
  Genomic contig location: Contig_ID=SeqID_30920; Location=1012..1104; Strand=-
  SCN-specific regions: Sequence locations=1-93
gccttaaacggccaaaatttggtcatttttagtgaaaaagtccagttggtacccagcagtggaaaaaaagttattggttaaatagcaaaaaaa

SEQ ID NO: 61288 - DNA, 936 bp, Heterodera glycines
  Genomic contig location: Contig_ID=SeqID_787; Location=602..1537; Strand=-
  SCN-specific regions: Sequence locations=1-96,179-384,467-572,594 -706,728-776,798-869,917-936
atgacaaatttaattgaaatgacacataattttgaatggaaaaaattgctacatgaacaaaataatgggtttatagaaaaggcacgaagaaaacacaaatatttattatttaataattacttgataaaaaaatgttcaaaattaaaaaaaataattaatatttttaataattaatttagtatacatattttgtgctgatcaattgtgtggctgagcaacaaacgcaaatttttgacaaattttgtcagttcgttgacgggcgaatccgtcggcaaattttatacgatttggacccaaaaaatgggccaaacattggcacacatttgtaccccgacatttaccagcacaactgcgaaatggcaaatgaatttttggcattggcatttaagtaaacaattttataaattggataataataaattattaattaaatttatttattaatttttaaattatttaataaatttaaggcccaatttttgcaaagtttggcttattggcataagttcgaacgtaaacagtgcacaaatgaacccattgttggcacaatttgacgccacaatcagaaaagattttttgaaattcaatccattggaaaatgccgaggagaatggaggcaaaaataaaagtaacaaaaaattcaaaatgccaaaaatggaagaaataagcgctaaatttgacgaattcaaattggcattcaaatccattctggtcaacaaatggaaaatgtttgaagcgatgtaaaattaatttacataaaaccttttttttttgcgaatttttaatgcaaaaattttagagagcccaatgaataagaaaaagccgatgtaaaaatgtgaaagaatcttatttattacaatcattttcactataaaaaattgtaatattttatttttttgtgtataaaaattttaatggatattttaacaaattaaa

SEQ ID NO: 61289 - DNA, 395 bp, Heterodera glycines
  Genomic contig location: Contig_ID=SeqID_787; Location=1573..1967; Strand=-
  SCN-specific regions: Sequence locations=1-291,313-395
atggtcagcaaaattgtgcttctctatccaaatgcttcacttccatttttaatccaaaaattcttccttttttattcgacaaggtaaaaatgtataaatttttgtcatttaatgggccaaaaaaattccataaattttcgggagtgtggagtcgagaatttatttttcaattttaaatttttagaccaaattttatgccagttcaactcagtgaattggacaaatccaacattgtcaacccattttttgtacaaaatccagaggaacaggaaatgcctgtgtatacgccaatttttcctgaattaaatgtggcaagtttggtcacaaactgcagtgccaaagtgatacaaaatgaaatgatcaaaggcaaaaaaaatttttacaaaattttttaa

SEQ ID NO: 61290 - DNA, 725 bp, Heterodera glycines
  Genomic contig location: Contig_ID=SeqID_788; Location=789..1513; Strand=-
  SCN-specific regions: Sequence locations=1-28,111-455,548-620,642-725
atggcaaatgaatttttggcattggcatttaagtaaacaattttataaattggataataataaattattaattaaatttatttattaatttttaaattatttaataaatttaaggcccaatttttgcaaagtttggcttattggcataagttcgaacgtaaatagtgcacaaatgaacccattgttggcacaatttgatgccgcaatcagcaaagattttttgaatttcaactcgattaatggaaataagcaaactcagagtgaaaaaatgccagaaacatttgaaattgttggcaaatttgagaattttaaattgcaactcaagtctattctcgtgaacaaatggaagttgcttgattttcaatttttatgtggttaaattctgaaaaaagttttccaattattcgcaaaaattttgtttattgttttgtggtgttttttaagttttgtttgtgattaattttttataaataattatttcatttttcttttattaagctagtatttataaaataatttttaatgtttactgatattattaattaaacagttaaatttgaaaaacaaaacaaacaaaaaactggaaaatacagaaaaaatggtgctgattcattacattaaaacattaaattagaaattttggaaaaaaaattattcatcactttaactcaacaaactaggttatctagacattaattggtcataattttttaaaatcaaataaa

SEQ ID NO: 61291 - DNA, 4180 bp, Heterodera glycines
  Genomic contig location: Contig_ID=SeqID_788; Location=2553..6732; Strand=-
  SCN-specific regions: Sequence locations=1-264,286-780,823-961,988 -1044,1080-1116,1153-1171,1229-1448,1480-1547,1642-1806,1849 -1936,1967-1984,2006-2531,2559-2567,2589-2607,2629-2789,2850 -2957,3031-3239,3284-3445,...
  SCN-specific regions: Sequence locations=...3468-3495,3527-3717,3740 -3878,3900-3969,3999-4008,4076-4086,4108-4120,4148-4180
atgatggttttttggccttttgaaaaccttggaaaatcagggtccggccgttcagtcaggtagctgttttttatttgttgaaattgcagcgaaatttgaaaaaattgcatagcttcaaaatgtatcgtttttttcttaccccatgcacaaaaaaccacgcggtgaagatgagggtactccttaagtttgggtcccatagttaagcattcgcatttatgccgcacgaataattgacatttttaccaaaacccatcaaattattaaatggaatgacaacagtggtggagaagaatttgaggatttaaaggcgctcattcattttgcatggcgccgtggcatcgtcagcactaatgccaatgaatgttggcaaaatgccaactttgacgaagcattggcacccgtccggtggcgatggctgcgactgatcattttgtataaacaaattaaagatttgtccgaaaatcatccaatttgggttgactcggtggatgacaatgtgcgcaatgcaggcgatcaattggtggaagattatgcgaataaaatgattaggtgtgataaattaaataaatttggccaccaccgaaaaaatggcttaaatgggatggccaaatttttgtttttttttcgacaaaacatggcataactttgctgaaaagcaatcaattttacattcttgacatcttctgaaagcccaggtttttctctattagcctgtaaaattgcaaaaaatttagtcaaattttcgaaaaagttgtatgaaaataagtattattttctgccataatttatatttaataatttgattattttatttgaaaatttgcgggcaaatagagaaaaatcgttactactaaagcgataccaagaatgtgtaaaatttgttacttttaagcaaaattatgccatattttatcgaaaaattgctaaactggcggattttacgaaacgacccatcaatttcaaagaaaactttttgcttcttcttttagcagatttgattaatgagcctttgatcatttttcaaaactaaattgttaaaattggtatataaataaattatttaccaaaattataaaattgaaatccaaaaaaatggttaccatattttgagattagctttcctttccttttctctttaattctctttaaaattttgtgcgcttatggttccaaattattattttttatatatgacaaaaaataaaaaataaacaaaaattaaatatttggtttttagaattatccctttttttgttttaaagtttgtgcgagacggaaaatgttttcagtaattatctgaaaaatgcattcacccgcgaaaatggtgctgaaggaattcgatcattttttaagtcaaagtttaatgaaaatccaattttttacgaaggatttgtggaaaaatttcctgagattggcccagtcaaattacgacagacttttgaaaatggtaaaataaatttaaaaattaataaatttaaacaaattcaaatgagaaatttttttagcaaagatacaaatgaatttgacaccacacttttttcaaggtgaaataaatttataataaaaaataaataataataataataaaattgttttttatagaaaaaattacttttttaaaataataataattctttaattggaaaaacatttcaattatttgccacttataaacatttctattagcatttttggatgactcatttttatatggaaaatatgctgaatttttatcctcaccttgggctgattaccaaattgtactgctcgacatcggtgcctatgtgaatgaaattgaaaaacgcattcaaatgtgggaacaattgcaaaaaatggaaagaaaaattttcccaaaatttgacacttttgatcagtcaaattcgttgattttgatcaaaattgaatggacaaattcacttacattacaggtacctagtaaattttaaaatatacaaaagcagaacatagccagccgcccttcccgaaataaaaattttaaaaatttcaagaaaaaataggtttgccataccccaatttcaacttattattttttgaaaaattgaccacaaaatgccaaaaattggtgattttttagcaaaaaacggctaaaattcctgctttttctgcccggcgctgataatttctgaaattcctgtgaaaatttttttgctttaatatcaaaaaaaggtcttcgaatcccccccccccccgaaatttttattttaggcctgtacaaaagtaacaagaaattaattttaccatcaataatctgttcaaatttcagcctatatatgtggaggaactgcataattttcgaaaaaacttgcacaaaattttgtgcaaaattttacaatttacggaaaatgtaaaatttggcagtgaagaagcatttgattattcataccaattaattaggacgaaaattcatgagagaaaaattttgtcggcattttttgccaacgacaaatgccaaattggtaatgaatggacaaaaattggatacaatttgcgcgaaatgttttgtcaaaagttatttctaaagaactatttaaaattttcaacattaccaaagaaaatggacacacaaattgcacttggcaagtttcgattaaaaattttaatttttttcgtaatttttaaacatttttcgaaattcctattttttagatattgaaattttcaataaaacgatacctgaaacagaacaaaacaattttttgcatccaacttttccgaaaatatcacaacaattgcattttaacgaagtaaataattcggattcttttgggataattttaaaaagaaatttttatttaaaattcattaattttttagcaaaaaaattatttgacggaaattgagcatgagactatggcggaatataacattaaaataaaaaattctctcaaaatcatttacacaattgtcaaaagttgggtaagtaaacttttttatccaataaaaaaatatttattttgctttaataaatatataaatatttaattttatatttatatttataaatttattgtagtctaaaagaaaagccaggcttttgatttccggctcatattttcttaattcccattcaattgactcgggcattgaccttttgtgcattgtgccagaaaaaacaattcgaatgaacgcattttttggcaacgagaaaactaaatgccaaaaaaatgtctgctcttcaacagccaataaaacgtcactttattcgcttctttttgaagtaaaatttttaatgaatttattacatttattttaatttaaatttgcaaaataccataatcaaaatttgttaattttcgattttggttcgagttcgggggattaggaatttgtcaaaatagatgtcagattcgtgattagagattccgcaaatctccctgaacaagattttatcagctattatcacaaaaaaaatttgcaaccaaaaagatctgtccaccctcctccttttggttttttttaaaaatttaatcgctctattatttatttattttgaataaattaaaatcacttttttccagaacaatgaagtgacaaatttgcgaaaaatcattaatggcacaatttttttgatcactttcaacttgaatggcattaattttgatttgtcttttgcggcaatttcggacaatagcgaattaccgttagtcattaatcatcaaattttggataattttattcaaatattatggccattcactgatgaaacgcaccaaaaaatgattcgcgcattgtcaagtaggtgtccttcaaccaatttattaacttggggcctattagcattaattagtcggcccattagcattaataagtcccgcgaaagcatgacttgttgggcgccgccgttttggtcccaaggctaattaaaataaaatttatttctcaaattttggcaggatgaaaactttataaattacactgattggttgggcccagccaatttgggtcctagggctaattttaaaattttttcaaattttggccgtgacgaaaaatttaattaattaattatttcagtttattaaaagggattcattaatttttttttattattttaggccatcgttcgttattttttattgtcagtgaattgcttgaggacaaaaataatggaaattgggggaaaatttttgataattcattctccgtttctcgaaataaa

SEQ ID NO: 61292 - DNA, 2052 bp, Heterodera glycines
  Genomic contig location: Contig_ID=SeqID_789; Location=920..2971; Strand=+
  SCN-specific regions: Sequence locations=1-934,965-1153,1218 -1221,1247-1484,1513-1516,1538-1780,1804-1964,1986-2052
atgtccgtcgctgctggccatgaattgctgcacgcgctcggctttgatcatgagcaaagccgaagtgatgcccggaattacgtcattttacgggaagatgacggagtaattaacaaatattttcactaatttttcatatactcattataaaagcaatcgaaaattaatccaaacacgcaaaactttgacttcgcttacgatttcgggtcggtgatgcattattatccatctgggggcgaccatgaaaagtaagaaacagttggattttaatgatcaaaaattggatttaaaggggcttatacgatcggatcactttgccacggttttaccaacaaacgattggccaaaccgaacgaatctctttcaaagacgcggccataattaaccgaatttattgcgaaggcaaaaatggtcgaaaatttcaggaaattttcatttgtttagactcatgcaaagaccatgataacaagtgccaaaacgggggctatttgaatccgaatgattgcacaaaatgtcattgtccggacggatacggtggcgaatactgtaaagaactcgaagagagtgagcaattaattgattcaattaagatgggattaaattttataatttcaagatttgaattgcgaggatttgagtggaattccgagagaattggtggccaatcagtcagcagtgttattgaagacgaaggccaaatgtggggggaatttgccgtgccgatgccattggcgaattaaggcaataaataatatttttgaatttttaggttttttaattaatgcaaattttaattgtttttagcctgaagtggggaaaaaggcgcgaattcagttcaaaagtttgagcaatttgtttgaatgcacacacaactgctcatcggcgtatgtcgaggtcaaataccgagccgacaaaagggcccaagaaaaaagacaaataattaattttaattaattattaattagcataatgatggctcattaaggtgccaaactttgttgtgccgcatcactcactgatctgaaagcaaatgaatacaaaaattggattgaggcggaaaagccggacatggacattgtcatttctgcgcacctttcaccaaaatggaccgtaccatccaccgtattcgaactgacgtatgaatcaggcaaggaaaatttttaaattaattttatttgttttttaaatttttttttaaatatttattatttttaattggctttatttaaatgtttttccaaccattacaaaatggaaaattaattgttcaaaaatctgttaaggcaacgccaaacccataaattcgagcaaatgcgtaaataccgataatttgtttgccgagaaaaggaaccccggcaccagcggtttgaagtgttatgacggggtcaaacaccaattttatgactgctcctgtcacggtgataagaaatgcctcgctgaagaaaaatgggcacacgacgcctttctttgtccaataataaaggtaattaattaattatttatttatttattccaaaagacaccgccacacaaacctttcatataatataggcaatttaatttttaggcactaaaaattaccattttttgtatcaaaaaagcggaaataaggataaatctggcaaattataaaaactctatttgattaattaatttgtaaattcaaggtaaatggaattcaaatccaaggaagccgacaacgagtgtttactgacccaaaggattttcgatacgattggactcggattgaggttaattgttatgtgagttgggtcttctaatttcaaaaatttgtttaattgactaattttacagaaggccgaagcaggtaccgtaagcttttggggctacagtaagccggagacaaacgaaatcattcgggtggacgaaatccactgtttgacttataaagctgctggagtgccaaaacggttcaagagtttgcaagtcgaagaacagccaccgatgaaaaaactgagtccaagtccattcttggccaataatgcttcatcacttatccatgtgttcgtgccatttgttggccatccatga

SEQ ID NO: 61293 - DNA, 449 bp, Heterodera glycines
  Genomic contig location: Contig_ID=SeqID_789; Location=3701..4149; Strand=-
  SCN-specific regions: Sequence locations=1-398
tccattgcgtcatttaaacggaccaacgaattgactggagatcaattgacattggcaccgattcatgaaggagcaaatgtttttaagctcatccgttgtccaattgcagcagaaggaagtgaggaaacattggaaaaggcgatgaatgacgcaatgctctgtactgctcgacaaaacgcaattgatattttcatcgcggacgacggagtcgacgatgggtgtgaagaaaaacttcaaaaatccaaatgataattttttttaattgtttttcagtcttctcgacggtttgccagggccgagtggtgatcactgatcagaaacagtaaaagtgaatcgattgattgattattgatgtgattaggtacatatgtgatccaaatgttcaacttattgttagccatttaaatgtttgtgttgttgtattgatttttgtttacaaattcattaaa

SEQ ID NO: 61294 - DNA, 1890 bp, Heterodera glycines
  Genomic contig location: Contig_ID=SeqID_790; Location=632..2521; Strand=+
  SCN-specific regions: Sequence locations=1-186,215-461,485-1200,1224 -1831,1853-1890
atgagtctgttcaagtttggagatgggagtatcaaaatgaaaatggtgatatcacgccattctatatggatccaggaaaacgcgtaaggtttgttattgttttttggtatagcaatgatttgaatttttctatattttcccgcgtgtgctaggcattcattttttcccggcccgtctattagctccgccgggaccctcccccaccccttctcccggtctcaaattttaagaaattatccaatgctttaaaaaaaatcagctgaaaaattagtaaaaactttaaagaatttttttttaagtttttctaggttaaaaaatccatttagatttttttttaatctaaaaattaagttttagttgaaagttcttagaaatttttttttgtacgagttgccattgacccgtattttctgtgctttttcggctagttttgaattatttaatggggtagtaaagactcatttattgacaattcttttacaagctagaaacgagtcaagaatttgttaccgcttttctacatttatacattctcccatgcagttttctcaattaaacattcaggtcaatggacgtcctttggagtttattcagccagaaattctgcgcatcaaacttcaagagccaattctaattgcgatatgccctaccttaaattgacttttcttttgctgtcgcttccgttcggttgcccattaagctttgtcaatcatcgtcttgaccaaccgcagtcagcagtcacttcgggtagtccccctgttgtcccaattgcctcacttctcttgtgccgctttaagctgatcgcacatgtcacttaaatatgttcctttgtcgtgcaacgcagcgttgcatccctcgttcgtgggtgtgcgaccaggagaacgattgttcggatgggcaggacgagaagaactgcggtgcattttatacctaatggtttcgttggacttttctttttatttgtgcagagactcctcaaaaacgatgctctgaaagtgaatacgaatgcaaaaacacacaatcaatgcaacggaatgcaaatgacaactcttggctcaaccacttggcccgcaccggtttcacacacacgtgcatccaaagaaatgggtttgcgacggggaggccgactgtgtggagaaggatgacgagttgaactgcgaaggaagtgagtaactgacgaaaattcgtcgatcacaattcttttttggttattcttttctctgatcggcctttctgcacatgactttttcaaatttgtcaggtttctgtttttgatatttcagagcttaaatgtgacgagaaacactttgagtgcaaaggcttttgacttgcattctgtgacttcgtgcattccaatcgaatgggtatgcgatgggcaggtaattctcgactaatattagaggaatagggtcaattgttctgctttcatttaggctgattgtttggacatgaaggacgaagcaaactgtacagctaaagaaacgaagcctgaatgtgaaaaggactgagtttcggtgaatcactcattaatcaattcttttactccaattgattctcaaggtgcgattctggtcaatgcatttacaaaagttggcgctgtgatggggacagtgactgtatggatggaagtgacgaaaacaactgcaaggtggacacgtgcggttctgttgacaagttcaaggtcatcacgcgaagagtccacctgaaaatgcaaactgacagttttagtgcaaatcatcgactttctgcattcccaacaaatggaaatgcgatggcgaaccggtaatttaatgttggaatttagaaatttgtttatcaaacctaatttcaatttttatgtgttttgatagctaagtaatgcaaaaaattctttgacaggtaaaagtcgaa

SEQ ID NO: 61295 - DNA, 1409 bp, Heterodera glycines
  Genomic contig location: Contig_ID=SeqID_6370; Location=25..1433; Strand=-
  SCN-specific regions: Sequence locations=1-375,400-586,608-1257,1279 -1349,1387-1409
atgccgaaaagttggggcaatgccaatattggcggcggtgccgccccaacaccgattccatcgcccaaaaatcagaagcaaaaacagcaaaagttggtcaaagtttactaaagatggaagttttttgagggtttgataccaatgacattcgttttttgggtcagatttttgaattcaaaaattcgaattttgtttcattttaagatctttgtggtcaatgtttcataattcttcgttaaattcttttattaaaatagacaaccttcaaaaactggacaaaagaatgcaccaaaagctgatcagaagaaagtggcaccaaaaaatcagcaaaatgggaagccgaaaagtgaccaaaacggtgggccgtcgccgatgtccaaaaaagaaaagaagaagcaacagaaacgtgagaaaaaggagaagatcaaacagaaacatcaacagcagaaacaaacggttgacaaaaggaattgtaaattcatcataataatattgtttatttagggtcaaccgaatgaggaaaatttgaataaaaacggtatagaaaagttggaggagggggaatttgtaactttttgaattttagaaaagaaaaatcacatgaaattggcgcgagagtcagcggagcgactggaagaagcggtcaaaatgatacaggcgagaaaggagggcagtgaaaaggcgacgggggaagaaaacgtcaaaaaggacaaagacgcggtgtacaacatggtaagaaatggggttggacattgcatataccacctatctatttgtctaattgtacagtttatcaagtccaccataaaagggggaagtccatacaatcggaaccgactttttccgctcacgccaaaactttttcgattacccctataataagtttaaaatatcatctatatagagtaaactttaatgttttggggccctgatttgaaattaaaaaaacagcataaaaacaacgaaaagacataaaaaatgttcgcacaaagttcaattgatttggaatggttaatttgttttaaacagcccaataaacgtaatttcatgctataaatagtagtgaacagttccaaatttaacttctttgtcaccttcatttcctttttaacagtttaaatgctattttcccctttttaggtggcttcttccctggaaactttgctgcccgtccgcttcgtttttggccgacttcgctcctccgctcggctggttgccaagcagcacagcagcaacattgtgcaggcagccacactgttggagccaaagaagttcaagcagttcgtccagctgttggacagcagcaatgtcgccaaaaagggtggtgttgccgaagcgacggaggacgacgaagaaaaagcagagcgaaaggaggcgggggaggaggacgaacaacgcgttttggcact

SEQ ID NO: 61296 - DNA, 2552 bp, Heterodera glycines
  Genomic contig location: Contig_ID=SeqID_6372; Location=1..2552; Strand=-
  SCN-specific regions: Sequence locations=1-253,275-317,355-655,702 -794,838-986,1100-1270,1317-1436,1458-1525,1554-1611,1633-1734,1763 -1987,2010-2021,2043-2159,2181-2242,2264-2362,2397-2462,2493 -2501,2523-2552
  Gene Ontology: Mol. function=GABA-A receptor activity; Cellular component=integral to membrane; Biological process=synaptic transmission
tttaaaactttggtacccttttagcggttgacgttggcattaccattcacgtgacttcgatcagtgccgtttctgaagtggacatggacatcacattggatttttatttgcgccagacttggtccaggccctataaaaaaaccccgaaaaattttcctaaatttttttttaggtacgacccgaggctggcattccagcagttggacccggagttggcacggcgtatcaaaaaactgacagttggcgtcgattatttggaaaggctgtggaaaccggacacttttgtaatcattggaaatccattacccaattaacacattaataaattaatttataaagtaatttttttaatttcccaaaaatgtcgaggagaggggagtaaaaccctatttgaactgaccataactgtaatttacagttgaatgaccgctaatcttaatcaatttatgattaaatataattatccatcattcccctagggatttaatcgctaattactccattttaattagcccagccccaaccttccaaattgaaattaaacagcatcatttaatttgtcctcacatttttcagtttcccaatgagaaaaccgccgtctttcacttggccaccactcacaattcatttctccgaattgagccggatggccgagtaaataaaatttaattttttataataattttaaattttttatttttcacagatttacacgtcccaacggctgacagtgaaagcgatgtgccaaatggagctgcaggtgatttttcgtcacattctcataaaatgcaaacattttttaattaatattttggcaattaataatttttttaaattggtttcaattttaattttagctgttcccaatggattcgcagacttggtaaagccatttttacaccaaaattcatagattaattaatttagcaaacttggcctagaaagctatggctacgacgtggaggacattggtaggagaaacttacattttaataataaaaaatgaattaattatagctaaaataatttaaatttcaaaatattttaattgaataaattttttatagttataaatgatttatttttgaatatttaaaatgatcaaaagccttcagattattattggggcgaacggcgttcggacgggcgacggcccgaagacgcagtggcattcgacgtattctttttgccacagtttcgacgcacgggttaccgcgtgaccggcacacatatcaccacagcatcgggtccgaaatttcgtgtttttaaatgctttttaaaatttgaaaatgttctggtgcctgctgggaactgagactgggattgatcagggcaaatacatttggtattcgcggaatccgggaattcatcagtgatcaggacagatcagtgcctgacacaaatttttttcatttctcaaaaaaaaggatttttttctatagaaaaagttataaaaaattttgctaattttctgctaattttttcaaggcaactttatttcagattttttgagaaaaagttcatgttttaattgaaaatttaatttaaaaaaactttacgaactgcaatgacaccctaatcaacagtttgtccgattaagattaatttccctataaaaataatcattattgtttttgtcaggtaaatatgctcgcctctattttgaagtgattttgtcacgtaatctcggcttctatctgatgaacattgtcattccggtagggaatttgtttgaattttaataatattaattgattaattagtctttaatccctttcaaagtccatgctaattgttgccatttcgtgggtgtccttttggctgagccgcgaggcgtcgcccgcccgtgtcggtttaggcgtcacaacggtgcgtttgcaaattgagcaaggccgaaagcgatttattaacggcacaaacccgtgactatttttttaaatgttgggccaagtttttacacgaaaaatgaccttttgtgagatatttgtcccaaaatcccccaaaaaattgtaacaaccctttctagacaaaacaacgaactttctgcccatggaaaagttaagccgtgaacggggagtgggttattagctgtccattaaattatttgtttgttcgaaatgttggcatttacgcaaaattaattttattcgttaagcttttactccgtcctcgggtctcaactcgagaaattctcgaaaatctggttaaacacgccttttcggaatttggcaggtgctcacaatgacaacaccgatcaccaccaccaacaacacaatggccaaaggtcagctacatcaaagggttggacgtgttcctcaacttttgctttcatcacggtctttggtgagtctaattttgggggaaatttaattaaattaaaaatttatttttaatttgtttaggccgctttgggtggaattcgcaattgtcagctattggaataagaggcaaagcaggcgaaggcaaaataaattcaattttttggaaaaacattggttaattaataaacataaaaacaaaaatcagtcatttaataatgcaaaataaaataa

SEQ ID NO: 61297 - DNA, 1136 bp, Heterodera glycines
  Genomic contig location: Contig_ID=SeqID_6373; Location=52..1187; Strand=-
  SCN-specific regions: Sequence locations=1-48,70-89,111-112,409 -465,493-592,614-631,921-945,1003-1034,1056-1136
gacaaaaattggcggaatgttgcgccacaaatacaacaattcttcttcatcattttccattgtgcttttgttcatcctcgtcagaagcgaatttggaggtgttttaaaatactattaattatatattattttaagtttttaaataattttattaaaaaatatttagaaaaaataattttttttataaatgaatgaaattttcaatttttaattaaattgaaaatattatataatttagttttaaaattattatataaaagaattcaaaaataaaaatttattttcaaattaatttatttttaataataaatattttaatttatttaaaatatttttaaaatttttaataataatttatttaatatttttccttaaaaatatttatatttttgaaaattaattttttaaggtgtgacgggcacacttttgagtaccgaaaatgagcagacaaatggcgttggcgaatcgcagcagcagcaacaacaacagccgatggtccaatggtcggacgcgtatcagaaccaaccgcaacacaaccagcagcagtacgacaacaacgggttcaacaccacttacatttcacaggtggaggaccaaaataaatgaatgaatttgggaaacgaaacgatggatttttattttttattttttggtattatgtataatttttaattcttaaaataatattatttgaaattaattgggaataaaataattaaatttgagaattttaattttatttggcatattataattttaaataattaggaatttattaaattatttgatcatttaaatttgttttattggtaataataggaattatttgaaatttgaatgctgaatataattattttttttaattttgaaaataataattatttgaaattaactggaaataaaaaatttatatataaaaagataactcgcccgctcgacgaggcgttataattttaataattaaattattatgaaattatttttcatttaatttattttattgttagtaacagtaattacttgaaatatgattgtttaaaaatataatattatttctccattttctcagattctcaatcggctgaccgattctaaaaagtatgacaagcggttaaggcctcggtatggcgaaggag

SEQ ID NO: 61298 - DNA, 1449 bp, Heterodera glycines
  misc_feature (31)..(31): n is a, c, g, or t
  Genomic contig location: Contig_ID=SeqID_30924; Location=477..1925; Strand=-
  SCN-specific regions: Sequence locations=1-582,607-883,906-917,961 -996,1047-1269,1291-1428
ggcgagtggggagaaatcgcaataataattntgagggggcgtttgggcttaaaagaatgggccggcatgggatgaaagcacgcagcatttccaattcgcagcaggaggagaagcgacgtgagcagtgcccgcattgtgctgaccttgcgaatggccaacgttgtccttttgctgctcgtcaatttgctcattttctcgggaattggccattatcaggacaaaaatggcaaccgcatttctcttctcctcacaatggacaaatggtcaaatgcctttccctctgataagcgttctctcttaatgaccttttcttaggacttttcggccgggatttgcttttgacgaacttccggcgactttctccgagattagactttcgtaagtccccccccacttttcgctttcacttccctttccctcaaaatcagtgcccaattttgtgcgtccgccttaagcgtggcgatgcttctcacttccatttcggtaaaataagccgaataaatgagcccaaagaatgccccccccccctttgtcagttgcaaatcattcattgtctccgcttaaaacattccaaatttttggtaattattttattaattattaaatgcctccttttctcctccttttcttttttcttcagtgcgtttgccattcttttggctgtgtgccaatttctctttttgtttttgggctcgaaatgcattacaggtgagcaaagcaaatcaaagcagcgatcggtgatttggcatttgcatttgcagtgcttgcccttggctggacgattttctgaacagacaaataatgcggcgaaattttgcaactatggagaaatatttcgacacacaatgtgggataaacggatgggcattagccggggtaagtggaaaatggccaattttaatttgagaaattcgaacattttaattttataaggttttaaaaacaaaaatatttaattttcatcattttttcttttcatactattcattaatagggataatatttatagtcaaaaaattaaaaaattacaatgaaaaaaaattaaagttgaatgtcttttttgaaggagttgatgataatgtggttcttttatctgtgagtcttctgtgtgcctccgctaaaatatgtttggtttttaccaaaaataagccgaaaaatgaaaaaatttccaaaatatggctgatcacattttatgatctaaaaaaatatgatttaaaaagttggaaattaggaaaaatatgactgatcataaaatatgattcctaatgatcactcactcactgtgatcagaatgtgtcttttggcagggaaaggaagagcaattaaataagcgcaaattgacagatcttttccctgctctcttgcggtttgttcatcagcgacggactgatcgtcactttcttcaaatccgacgaatctcacagcactgagccggagaaacagcagcag

SEQ ID NO: 61299 - DNA, 960 bp, Heterodera glycines
  Genomic contig location: Contig_ID=SeqID_30926; Location=443..1402; Strand=-
  SCN-specific regions: Sequence locations=1-142,166-317,339-412,465 -726,748-960
  Gene Ontology: Biological process=morphogenesis of an epithelium
atggcggaggatgaagcggacaacgacgtgctgttggaagcggctgagacaaaggacaagcggcacgctaagctggaccatttcttccgcgaggcgtattcgcgggtgcgtctactaattccgttaaaggaatttatgcctcaaaaatttttaaaatttatttttgaattgcatattgccagtattatacctggtacggcttaaaaaacatttgcggacggtataaatttcgcagagcgggccttaattatcatgcatttaaattgcaaaaaaaattctatttcagtccctttccgaaaacacctcaataaaactcaaaataaatgtgtttataagaaagactctgcctttactttatatggacttaaaaatcaaagctaaactttaactttaatgagcgtcaaaatgattcattttttaatgttttgttaaaaattaaacttaaattttaatttttaatttttctcatcacggaaaatcacaaaatttctcataaatcaaccattcttggtgtcatccaattgcttcaattgttctcctctattggccttaaaaattcaaaaaaaaaattatagaaagtcacagcccaaattcaaagacatttttaaggcttttaacatgccgcagttgagcgatcacacgaccgacttcaacacttatgcttctgcacaggtaaactggattttcgaggatcgaattttgatacttttggtcaagtctcgatatttctctcaattctcgaggctaaatttcgagcacttagtcttgggaaatttcactgttttattgccaaggtgatgaacatgacgctgaccaaggcggagtttgctgaagcgctcggcatgcgtgccaacgaccttttcgtgcagcggatgttcgcctgcatggcgcacgacgcacaaaacgacacgacagtcacattccaagaatttttggaggtgctacgaaagttcacacagg

SEQ ID NO: 61300 - DNA, 1731 bp, Heterodera glycines
  Genomic contig location: Contig_ID=SeqID_30927; Location=30..1760; Strand=-
  SCN-specific regions: Sequence locations=1-1178,1200-1252,1274-1731
atgggagcaggtgagtgagtccattcgcagcaaaatgtttgggaattgggaacaaattggcaaaatcgtcctgtctataatgataatcattgtttttacagactttttgatccggtttggattaatgattagagatgaatacgttggcagaggaacaacacgacgcatgacttttggtggaaacaaaacgcaaaaaattgtgaaatctccagcacgcctcaacatgatggatctgaatgcatctgtagaagttggtaacgaaattgagctcagtctcgttaagctcattgaacccgcccaaacccaggcacacaaaatcgcaggaaaacgaaagagaccggtaaaaagggctcgcttcagttttcgggcgccaaaagtactcattgggtttttagtagtttttcttcccaatgcttttgcaaatcccgatgtgaataatcaaatctcaattcaattcacttctccttcaatgatttatctgcttatcattcccatttctgatttttatcactatttcagtactgctccgctcaaaacggaattcagaccttccaatgctcccaaatctgaatgcaatttctccacatcacgccgtggtgcagacattgattaactccacacacgtccgctgtttaatggacactggtgcaagtttgactgttgcaccacgatcagttgcagatgagctcaattgtcagacatattcatccgatttggaggcaatgagtgcctcaggacatgtcattcgcctcaaagaatatgctcaggtgaatttaaacattgctgggtacacagtccgttcattaatctattttgtggatgattccgaatttactgtggcccgggattacagtgtaattgtcggttgggatgtctttgagaaattgcccccaataaaattcgatcatttaaacgggaaattttttgttggggagaacgaagccaatttatgctatcgttcggtcctcttacttaacgatttgcgcgtgtcggcagagaaaaacacgctcattccggccgactcccaaatattggtcgatgcttcaatcgaatcatccccaaacccaaaaaattcattttgcattgatcgccctgacataagtcttattaaaaagggactgtcagtcattaatagcgtctcgcctgcgggccagaaacaaataaaagtggcagtagtcaacccaaccatggaaccaaaatggatttggaaaggaacacatttggcatttgccaacgaactgttatgtgaccgaaatgggcttttaaaggaaaatagcacaaaagaaatccttgcccttatttctgaacgaaagaaaatggaaattgacccaacatttgtagtcgacttttctaaggcaatggttgaaggcaaagatttagaacagcttaaagcattaattgaagaattttctgaggtttttagcaaatttaggtatgatctcggacttttcactgccgctgaacatcacataacaaccacaactgaggaaccaattgcatctgcgccaagacgaatgccatacaaatacaaagaggaattgaagaagcacattaatcagcttttagaagctggagtcatggttgagtctgacaccccatgggtaaccccaattgtcattgtgcaaaagaaggacggtggaattcgtccctgtttagactttcgcaaacttaacgaagttacggtgcccgacaagtaccctctcccacgccttgacagcatcatggaaaagg

SEQ ID NO: 61301 - DNA, 471 bp, Heterodera glycines
  Genomic contig location: Contig_ID=SeqID_30931; Location=796..1266; Strand=+
  SCN-specific regions: Sequence locations=1-225,410-417,439-471
atgccaatttgcaaatttgactctgttggtgtgtcaggtgagcgcctcccgccgccacccgtcgcttcagctccctttttctcgaatcaacgccaaaatttgtgtgcccaacagcagccccagcaaatttatgtccaaatgaattacacggcaaattgaggcaaccaaaattttgtgccaaattgccgagaagcgaaaaacaacggacgaacgaaccattaaactgaagaggagagaaaaggaaaagcaagcacaacgagaggacgaagaaaagagcagcagacggagcagaagaagcagcaaatggtgcgaccgacgacgggaggaggagacgaagacgaagcagaaacaacagcaggaggaggaggagagaaaacagcagcaggtgaggagagtaaagagatggagatgagccagggatgggaggagggagctggagcagtaatagaaccaatggaaggtcaaaaatga

SEQ ID NO: 61302 - DNA, 156 bp, Heterodera glycines
  Genomic contig location: Contig_ID=SeqID_6374; Location=100..255; Strand=+
  SCN-specific regions: Sequence locations=1-156
atctgctgctgcgtcgaggatgacaaggtttctacggactggctcgaggaacagatcacaggtaaacaatccaacttcattccctgtaaaaccatcttttaagacttcgaagacctggtccagtcagtcgatgtggtggcgtttaacaaggtttaa

SEQ ID NO: 61303 - DNA, 259 bp, Heterodera glycines
  Genomic contig location: Contig_ID=SeqID_6374; Location=2648..2906; Strand=+
  SCN-specific regions: Sequence locations=1-259
aattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcacatgattccactgttccaagcaccccaccaaaagcaaaagaaaggtaaccaaaatataaggaaaaattttttaa

SEQ ID NO: 61304 - DNA, 1977 bp, Heterodera glycines
  Genomic contig location: Contig_ID=SeqID_6375; Location=175..2151; Strand=-
  SCN-specific regions: Sequence locations=1-190,212-385,407-752,774 -1310,1332-1776,1798-1977
agaagcgatgggccgttgaaaaccaaatcaagggaaattctgcaccaaattgtcactcgctgttacaaccgcgcggttgacaatgaaaaggcactgaataagcattacgaggcattctcatcacaaacgtatggcgagacgagctttgagcggatgaggatgatcatcgacgagttgaggccaacggaggtgggccaaggctttaaatttgattgcttatctcaccacagagggacgttttcgttgatttgggcagtggcgttggtcaattggtcgtccaagtggcgggcggatcgcaagtgcagaaagcagtcggaatagaaattgccaaactcccagctgattttgcgagaaaattggagtccgagttcaaaaggtattttattttttccatttaatataaatttgaattcttttatataattcagattgatgaattggtttggacgtcaatttcgcccttttgagttgaaacatggcgattttttaaatgaacaacacagaagcctgatcactgaagaagcaaccatcattttcatcaacaattttgcattccaatccgatttggagatgcgtattaaacgcgaattgctcagtgacctcaaacaaggaacaagaattatttccaccaaaccgtacgttccgctgaacaaacagggcgcaatcactgatagacaactaaatggtgagcaatactttttggcatcatttcgaagtgtttttagatatttctgtgatcaccgatgtcgttgaaatgaaagcatgccctaacccttgctcgtggacttcagcttatgttccctactatctgcacacaatcaaccggaagaagttggaaatgtatttcacccaaaagaactcttcgcgctgcaaatcgtccgactttggcagccgccgttcgtccactcccaattcgaaggcttcaaattctcgggaatcgagtttggatctcagagacaaatcagagaacggaaggacgaacggagaagatatttggtaagttatacaaaagtgctccatctttaatatgatttatttttgtagttttggtccaacgactcggagaaaatggcatgaatacgtaagtgatctcgaacagcaaaagaagcggaagggcggcgctgggagttcgacgacgcctgacgagcggagtgtcaccaactcttcttccggcacccctacgcccgtcagcgcctcttctgcccctccttttgtgtccacggcacttccaaacaatgccaatgctaacacgccgcttcctcaaaagaccatctgcgttaacaacttaagaagaccttcttcgatcccggaattgataaattctgtaaaggaggaaccgctcgtggagagttcaccggtggtggacatttcagtcggaccagcgaatgcattagttgtgaatcccatccatcagcagcaaaaccatttaataaatgaagtttcaaaatttggtgaatatttttgaatttgaaacaatgggaattctacctcgaatttagagccaataacgccagtcgcaaatcgaaaaaacgacgagggcgatggcaagaaaaacgtggcgaaacggagcaatgaacgcaaggaaaaagttcagccgacggttggcggaaaacgtggaaggcccagcaaagcggacaaaatgcttgggacgcatgcgagtccgaagatgccacggttgtcggacgacgcaaaggatggcatggaagtgatgcaccaaatgactctctcagtacaagcggtaataatccttgacaatgtgagcgtcatgatgtccggttcagggaaagcccattgaccctgcttcaattttggctgacatggcggaggcaaaacgccgttcagtaccaatggacactatcaacatggctctgccctttcccaatttgagcaaaccgttcaccgaccaaactcaatccggaggagacattcaaagccatcattacaccgagagatacccgggcctatcgaaatttttag

SEQ ID NO: 61305 - DNA, 739 bp, Heterodera glycines
  Genomic contig location: Contig_ID=SeqID_30934; Location=246..984; Strand=+
  SCN-specific regions: Sequence locations=1-658,680-703,725-739
atgtacaacacggttccgtgccttcatggaatatgcgggcccggacggcggcttttgcatacggtaataattggatacacggtagattgtggacaaaaaaactgtacactaaataatgcatatggaaatatcgattgtgatagttagtgtacggtagacaaactgacaaaaaaagtggcatatactgtaggaaagaatacgatcgacggtgacaaaaaatgatataatgtagagaaaaacggtagacagtgcccgaaaatgatatactgtatgaaataatacggtagacggttcacagaaatttaaaaaaaaaattcaggctcaataacaacgcggacaaggatttgagtgaggatgagggcatcgatttggaggaggacacgcggagccgaatcagccgatcaaggcacgacggcattcggccagaaattcaaaaaaaaaaaattgccattttaagcctctctgaaatcccggacacgcagtcggcactggtggtgatcggcaaacaaggcatgccattgttggtggaccagcaaacggtggcaaaacggcacgaaaaggtggcacgatgggcgaatggcacattttaatgtcctaaaaatacgagtgtaaaactgcgattttctgaggggggagggggaacaatgacaattcgtacaataatttgtttaaaactgggaaaaaatgcgagcttttttcttaagaattttcaaaaataattgtttgatgaaaaattaaa

SEQ ID NO: 61306 - DNA, 745 bp, Heterodera glycines
  misc_feature (22)..(22): n is a, c, g, or t
  misc_feature (91)..(91): n is a, c, g, or t
  Genomic contig location: Contig_ID=SeqID_30935; Location=193..937; Strand=-
  SCN-specific regions: Sequence locations=1-745
atggaatcgtatgtgcaagtgnaagatcaagattcgagggactccggcattcgtttggctcaatccaccacctcgcagcaaagctgtttgnccaaaatttattttccaactttgttcgacttcgggttcaaggttcgggaattggtgtgtcatccgttaagaactaactttttttatcaaaacaaattctaatccccttgagtcctattcttcaaccattcagcagtattcgcttgacaccgttgaacggccccaagttccgcacaaagccttccgcagcattaacgccgatacgatggccaaccttttggggtcactaacagaagaacagttccaacggcggttcattctgatcgattgtcgctatccttacgaatacgatgcgggccacatttgggtctgtttctgttgtttctccgcacttaccaacatttggcgcttaagtactcactgaatttgtgggagaccacttccattgagaagctcttctacccagaagaggaagaacggttcggcgaaattattgtgcgaactcccatcttctactgcgagtactcgcagaaaaggggacccaaaatgttcgacactccattcctaattttaatccgattcgttttgcagggctcttgcactgcgagaatttgaccgggtccggaacgagtcgcgttacccatacgtggactacaaggagatttaccttctggaccggggctaccgatacttcttcaaggaacgcaaatttggc

SEQ ID NO: 61307 - DNA, 1296 bp, Heterodera glycines
  Genomic contig location: Contig_ID=SeqID_30936; Location=390..1685; Strand=-
  SCN-specific regions: Sequence locations=1-777,806-1142,1243 -1256,1278-1296
atgccaatggaaacagtgtgccgaaggaaaagggggaagcgacgtggagaagacatggccagaaacacatcagacggagaagtgaccagcgatggtgggatgccactggtaaagaagcgcatggtgacgaggcgacaagccatgaaagaggccacgacaaccgctgctcgtccccatcggatgaagcgattttcatcgccgacttcccccgttgcatttgtttcttctaatgatttgcttcaccagctcgatttcggcattgttagcattcagccgccacttttcagtttaaacgatgccgcaactttttccgttctgaaacgaatcggagaagagcaaaagctgtctttggaggaaaggaggttaatctcgggtgattagtgatgaataagcattaagcttcaatttagcggttctttcctcttcagcagaacgccaaaagggaatggtctccgtcatcatggcgatttgctgacacttacacacagaccggatcatattcaagtgagagttaattggggaaaaatatggaatcggaatttgcattgtgattgcactttttaagattgatggatttcgtaatgggaatttgattgaagagacaacggagcgatggcccaggacaattgagacgttgccattgtttatcaaacatttggactgcaaagtgcggcacttttttacttgattctgtgaatttgtgttcttgttgccttgtcccttttgattcacttattttgcaaattttacataaagttcttcatataacatcttcacttaaaaaattaaggaatttttaaactttcgatctttaaagtcgtcaaggtccccccattttttcaaatgctttcccactcaaattgttttagatattcatagggattacaaaccaatatttaaagaatttgttgttcacttacataataagaaaaaaagaaactgaaaaaccgtaaaacgaaggttatttgaccacagccaaattcttattctagcaaaaatataaataacttgctcttttctcttaattacaggcaagggttttttctgatatcgtaattatttcatacagtctccattttcgagaaaattggtatttttgccacctgtcacttgtctcaaaacttgcatatgactgtattaacatttttaaacaaatttatttttctaattattattttataaattacggtatattttttaaactaaataggtaagttaaattaatctaaattatttttaattgattagcagggcttcttttattatgtaagaaaaatcgcgaaatatgtaaataaa

SEQ ID NO: 61308 - DNA, 180 bp, Heterodera glycines
  Genomic contig location: Contig_ID=SeqID_6377; Location=4670..4849; Strand=+
  SCN-specific regions: Sequence locations=1-180
cacagaaatttacggaaacgcttggaaaaataaaaattggtagtttgagttggtccgtgtacgggcgaccgcctcacacacagtgatattgcccctcattagatttcgacaacttaagcctcacacccgagcttaatcgttatgtggttggtgttgtttcatgccgccaccaaactttct

SEQ ID NO: 61309 - DNA, 1923 bp, Heterodera glycines
  Genomic contig location: Contig_ID=SeqID_6377; Location=193..2115; Strand=-
  SCN-specific regions: Sequence locations=1-11,33-429,451-487,513 -571,593-706,729-799,821-1010,1035-1923
  Gene Ontology: Mol. function=profilin binding; Cellular component =actin filament; Biological process=signal transduction
atgtcaaacagtttctttgtgtttttacccagtaatgtgagtgattacccggacaatcagcccaacaaatttcgtgtccgactcccaaaacctttgcattttaatggaacgtgggtgtgcgggttgcacagtatcagttacccctactcgtggtcaaccattggcacattggatgagcaatggattgacattcacttcaccgaccgcagcgctattgatgaggaccgacaaagaattatcagggtgccggtgcccaaggcatcgcatagtagggttgaacagctgcgagactttttgactgctacattgcggaatcatagtggtgcaaaaatgttgccactccctcgtgagttggaagagaatcgaaatcggacaaagcctctcaactcaccaccaccggcgaagagaaacaaaagagatgagtcaccaccagtttttgatgagaacgggaacgagcttggctctcccccgtcttacaatggagataaagaggatgaggaggaggaagggataatttctgagtcaccgcctcattatgaaggaaacgagactgtaacaattgactttccctcatcatacaatgaagattatgaaggtgtgattgcggattcaccgcctcgttatgtagaaacgcaaaacgaaactgtaaaaacatcaaaagcgacctctcctcagccgccgcctaccccaagcactgctaagccggctccccctcctccaccaccaccgtctacaaattcgactcctatttcaataaagacaccggctgtccaaccaccaaaacctacagtatccacccctccaccacaaacaacaataacaaaggcaccaccgccaccgccgcctactaagtcggctccaatagttaacccatcaattacaacaactacaaaaacaatacctacccctccggtaacaaaacctactacaccaacccctccggtagcaaaacctacgacatcaaccccttcggtaacaaagccaacgacaccaacccctccggtaacaaagccaacgacaccaacggcagctcctaaaccgataaagccggcatcgcctgcacctcaaccacccaagccgtcaacgcctgctcctctcactacaacaacaaaaccaccagtcccaagcccatctgttaaaccgacaatttcagcaccaccggctcaacaaccaaaaagcccgacaccatccaccaaaccaatagtgccaaaaaccgacgcgccacctaaacccccacccccggtttctctttccgctaaattgatccctagtgcaccgactccgccattagactctccacctcgttttgaaggagaggaaaataaaaacgtcaaatcatttgcaaagccaccaccaccgccgacatcagcagctcaaattgacccatcgcgtttgattcacacgctcgacccaccaagaatatattttaagactcctccagctaaccaaaaccctttgaactatgtgccgaattcggtgatagttctctttaacaatgatgtggaacgattcaaggttgtgttcaacgaggaaatcatcagtcatttgtccttctcaccgcaattgggctatgtccttgggttcgaaaacccccagcatgtggtgtcaaatgaagttgccaaatacggacatgatttgcgaggtggcatctcaagctttgctgtctactcaaaaggactgaccgagaatatgatcatcgggaacacattgagctctttgctccgggttgtgtctatcagcggtgccacccctggggactacactgagaagatttacgactcaccgatatttgcgcgagtgttaccacgggaaataaacgaaattgagattgaactgcgcacaatggacaaaggtcgattagtgccgttcgcctatgggacgacgatggttgtgttgatatttaagaaagtgataaatttctga

SEQ ID NO: 61310 - DNA, 81 bp, Heterodera glycines; identical to SEQ ID NO: 58971
  Genomic contig location: Contig_ID=SeqID_30942; Location=771..851; Strand=-
  SCN-specific regions: Sequence locations=1-13,47-81

SEQ ID NO: 61311 - DNA, 1130 bp, Heterodera glycines
  Genomic contig location: Contig_ID=SeqID_30942; Location=1..1130; Strand=+
  SCN-specific regions: Sequence locations=37-108,184-191,219-221,344 -395,425-425,509-514,547-805,839-852,899-909,931-966,992-995,1031 -1080,1102-1130
ctaagggcatcacagacctgttattgctcaatttcgtgcttttgaacaccgaaaatccctctaagaagttgtgcccacagatgcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccgaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagt

SEQ ID NO: 61312 - DNA, 333 bp, Heterodera glycines
  Genomic contig location: Contig_ID=SeqID_30946; Location=7..339; Strand=-
  SCN-specific regions: Sequence locations=1-228,253-333
atgatggatgatttgtacacagtttttgagcggcggccagatgaaaaaatttttaaattcaatttaactttcgttaaatttgcgtcggaaattgccagtttacgagtgatcaatggcaaccctgacaccaacttcaatgaccatgtaatcggattagttacctaatattttggggttcgtatcaacaaaacttagaatacatttcctgacctaattgcctgggattttaagtttttcttaatttaaataaaaccttcaagtatcaaaattttttaatttcagatgcttcatcacaatttagcgaggaacgcagccactgattttgatggatga

SEQ ID NO: 61313 - DNA, 304 bp, Heterodera glycines; identical to SEQ ID NO: 51570
  Genomic contig location: Contig_ID=SeqID_30949; Location=468..771; Strand=+
  SCN-specific regions: Sequence locations=1-304

SEQ ID NO: 61314 - DNA, 1211 bp, Heterodera glycines
  Genomic contig location: Contig_ID=SeqID_6378; Location=98..1308; Strand=-
  SCN-specific regions: Sequence locations=1-143,167-321,344-561,583 -704,726-1035,1080-1211
atggcttcatccaaatcacccattttccttctcaccgtgctgctgatcatgctgctgatttgtccatgcttcaacaacaatgtcaacaacagtctctttaatcccgcttgttcgtttatttagaaattaaatccttaatggtcattaattaatttttattatttttcagcggatgattgtgttgtggccgttcgtaatcggtctgagattccagatggtgtcagtctgtatagttttgtgccattttagggcctctgttttggaaatatttgttcccgtaattatttcttcggttctttcgcttggcaaaattccaatacgtgctaaaaaccaaaaattcttcgaatacattgtgccaaaaccacagggcacggatttatatatatttttacatgtttttagtttggactttttggggtttttagcgaaaatttcgaggcttttctagcaaatataaatccgggccctggccataactattttgttgaaacacttggcaaatttttacattgcagctttatgagtacgtgtatggcactttgcgtacacctgaactgcgggaagcagccaaaaaggcggacattttccgcaacacatttacaacggattgcgtgccatatggcgaatttggcacaatttggggcggattttggggttgcctgacatatacctgcaaagatagtcagcaaattagtttctgttcatatgttattaaaagttttctttaaatcttgagtgtttggcaaagacattttccgcgtgaatggatgcttcccaaaaagtgacaaaaagtgcccggcaattttccacgattattgttggttagctactggggatttgtggaaatgtcgtcattgtgatgagttggtcgacggcaaagtgtgcaacagctttgatcagttgatcaaacttgatcagcctgctgacgacttgaagtcgaacagtaacagttacagcaccagcaaagccgagaagcttggcccggcgccataaagttaaaaaaaagagtaggggtcgtttcggcaccagcctaagaatttttaatttattttgttaataatcattttaatttatatttagtgacgatgttcattttatggcattaaactggcgaagaatgaaggtgatatgatgatgtaacgaattgaaaaaaatccaatgcgccaaaaatgaatcatttcgatccaataattgatcaaagccaaaataaa

SEQ ID NO: 61315 - DNA, 691 bp, Heterodera glycines
  Genomic contig location: Contig_ID=SeqID_6379; Location=32..722; Strand=+
  SCN-specific regions: Sequence locations=1-46,68-202,224-297,322-691
ctttatgagtacgtgtatggcactttgcgtacacctgaactgcgggaagcagccaaaaaggcggacattttccgcaacacatttacaacggattgcgtgccgtatggtgaaattggcacaatttggggcggcttttggggttgcctgacgtttacctgcaaagatggtcagcaattcgggaataaatacctgattttaaaaaactggggattataattcaacaaaaacggtaaatataggatcaattttgggaggcgcgtcaaacagattttagtgattaaatatcgtggttttaccaaaaattctttttcatttattttccctgctaaaatataattcaattataaaagttaaaaaatgccatattttccaattgcttggactgtgtcggtgctgaaaaacaatgtaaaattaaatttcttaatctttttaagagcatggtaaagacattttccgcatgaatggatgcgccccagaaagtggcaaaaagtgcccgaaatttttcaacacattctgttgggaagccggtgggacttcgtcaaactgtcgccattgtgacgagttggtcgacggcaaagtgtgcaacagttttgatcagttgatcaaacttgatcagcctgctgacgacttgaagtcgaacagtaacagttacagcaccagcaaagccgagaagcttggccctgcgccataa

SEQ ID NO: 61316 - DNA, 387 bp, Heterodera glycines
  Genomic contig location: Contig_ID=SeqID_6379; Location=826..1212; Strand=+
  SCN-specific regions: Sequence locations=1-107,147-279,301-335,364-387
atggcattaaactggcgaagaatgaaggtgatatgatgatgtaacgaattgaaaaaaatccaatgcgccaaaaatgaatcatttcgatccaataatcgatcaaagccaaaataattttaaaaattattattattatattaatatatgtatgccaaaaattgaaatgattaaagtatatttgttgttgaatgattctaagtatattaacgaaattttaattacatgtcttttttgcagtcaataagtcatttgtataaagggattttattttgcaagattcaattttatccatgtaaaattcgcttgttaggccttaagcaagccgtataaactgtaatttattcaattctataatttcatggttcaagaatagccctgctgaagtaa

SEQ ID NO: 61317 - DNA, 237 bp, Heterodera glycines
  Genomic contig location: Contig_ID=SeqID_30954; Location=197..433; Strand=-
  SCN-specific regions: Sequence locations=1-188,210-237
atggacggagagcacacgggatcaacggattgggcaggcggaacatggatatccaaaagcaaggaacaggcgctaacgtttagcaaagaggcgaaaatgaaaacagcatgcaacggaaaaccgattcgcttgtcggaccaatcgtttggaatcctggaggatgattacctgaagatcgtcaacgattgtggattgggaaaaagagccatccaggaggagcaactcgcgcacaattaa

SEQ ID NO: 61318 - DNA, 571 bp, Heterodera glycines
  Genomic contig location: Contig_ID=SeqID_30957; Location=867..1437; Strand=+
  SCN-specific regions: Sequence locations=1-1,31-382,404-571
atgttttattttttctctgtaatttcttttacaattattgttcatccttgtttaattcgaattttaaatgcgagtccatcggtgagtaattatttgggcaatttaattttactaatccattttaattaattaggtcgatgacaaaatgctaacggcatttatgaaaggtcatcaagaaacgcaaattagtgaatattcaatgcagaagtatgaggcacaccttggcattatgtattatatgagaaataattggcactgtgacaaaatagcaaatgaatttgcagaatttgaacggacagaatgccaaaaatatcgcaaatatttggacattttgtacgaatatttgttcagagaatacatcggtattcacacagtgaagccaaaatttgtgtttaaaaagaaacattttgaaattgaagggccaataatttatgcgataaattgtttggccacaatttcacagttttattgctggaaatatgtatctaaattatattattcctcattaaagcgtttcttcaatttgtattttgcaccaaaattattgaatgaggagggattaaactatgaa

SEQ ID NO: 61319 - DNA, 410 bp, Heterodera glycines
  Genomic contig location: Contig_ID=SeqID_30958; Location=679..1088; Strand=-
  SCN-specific regions: Sequence locations=1-140,162-249,275-410
atgaattggcttattggacctggatggtcatcagaccgtcatatgagagaaatcttattggggctgagcacactgttggaagagccgaattttgagagcccattcaacgaagacgcaagggtataaacggaaataagttctttaaaaattaattttatatagacacaacacacattggaccaaaatgcgtatttcgaaagcgttagaagaactgcagaaaaagcaaggacgaaaaatatggtaaaaagattttatttctttgtaaatttgaaaaatcaaattcctttagtcgcttactgatggctgattatgaagattgtaagcccctggcgctgtaatgaatataagggtgatgtcaaatttttttcgtcgcatcgagataatgttataaatccgttaatgtaaataaa

SEQ ID NO: 61320 - DNA, 865 bp, Heterodera glycines
  misc_feature (53)..(53): n is a, c, g, or t
  Genomic contig location: Contig_ID=SeqID_30959; Location=4..868; Strand=+
  SCN-specific regions: Sequence locations=1-498,522-523,550-611,649 -703,729-841,863-865
atgagccaccatttggcaaatcggtctttttttcgcattaaagaagattcagncgattgcttggagtgtaagtaaaaaaacgttattaattttcatcttcatcattttttggtttaaaaatatatttgaatacttttttatactttgaaagacttttttattaatacagaattttttcaaaatttccaaaaatccgcaatcctgcgcaggatcctgcagattttaaatgcaggattgcaggattaatcctgccggatcctgtcctgtaaaaaattttgaactccaatcctgcaacaggatccgcaaatttgaaatttccggtctctaatgcaaatgccaatttaatgtgccaatagcaattcagtggcatggtgcccacgccaaacccaacgtggcattaatttctctcgccacgtacagaaaaatggcatattattttttgatccattgtttaattttcacccataaatcaggctttagcattgcgtggcaaattgattattagcttttttaatttacgattgaaaaaagcaaaagcataaattaataattatcaaatacctaatctcagtttgtaaatttatatggagcagctcgtttcgccctactcgaaaaaattaaaaaaaaaattaaaagttttaaattttagaaattgatggctttttcaagaaaaaaatcacctttcattacaattctttaatcaatttttctaaatttttatattttccaagaaaaattaaattcaagtattcaaaaaatcaaattttttttgtttttagatctttttatcccgaatcttgatttcgactttcaaaaatccgctctttattcaaatgcatatttaattgcttaaataaaaaatgaa

SEQ ID NO: 61321 - DNA, 230 bp, Heterodera glycines
  Genomic contig location: Contig_ID=SeqID_30959; Location=1143..1372; Strand=+
  SCN-specific regions: Sequence locations=1-230
atgtggaaggtattcatgcactcgcttcgggtggattatttaggaaattgtgatcggaatgaaacgaacgcaatgatcaaaatcaccaaaactggcaccaatgaaacggttggtttgttctgtatgtgccagggaaggcattccgaggggcaaaaaattttcggaaattggaattccgaatcccccgaacatttcggaggtaccaaaatcggacttccgtgccattcctg

SEQ ID NO: 61322 - DNA, 1005 bp, Heterodera glycines
  Genomic contig location: Contig_ID=SeqID_6381; Location=1539..2543; Strand=-
  SCN-specific regions: Sequence locations=1-166,188-596,618-781,803 -1005
tgaaaagaaaatcaactgaagagccaaaacccgacacggacacgaaacagtccaaacctgagcaacaaccagcacaacagaaggaaggaaaatcagaagaaggtcaaaaaccgaaaactggtaaaaaaccagaatttttgttgaaaaaagcaaaacatcccagtagcatttctgtatctgaaagaaaagaggccagagtttactttaccaaaatttttgagcattctgaattgttcaaacgttcagacacttctgattctgaataaattttaattttgtagacacatcatccttgtcaaaggagactcaatttgtcttacaaaaactcagacaacaagaagcaatcgcacaggcaaaagaattgtcaaaagtaataagagaagttcaagcaacaatcaatttcaacaggaacactgaccttattagttattcacgagctttacagaaagcaagccaaattcctgagcaggacgaagccaccgacaatttgaacttccattcgaatttctctccagaaattaacaacaaatttttggaagaacttaactctcttgaatcaacacacgacgatatctacaatcgtgccgtggccgattgtgagagagcagaacaaaagcgtataaactctgttaccaaacaaacgcaaaatatttttgaagccgtgggaaaggctatcaaagctgaaaatttcaacaagggactactcaccgagttggcaaaagccatcaacagtccttcatacaacagtcgcgctggaaaggacaaagcattaatcattgtgaataaactgcaggacaaccttacacatcaccaccgttttttgattggacaacaaaaaacagctgaattcctccgaaagacattcaaaatcccgctagaagacgaaccgtccactagtgcgaacaatttggagaaaaaagattttttttttaacattatttgaggcgatcagataccaagatttttgatcactattgttgatactgtgatcgtattgttaataaa

SEQ ID NO: 61323 - DNA, 853 bp, Heterodera glycines
  Genomic contig location: Contig_ID=SeqID_30962; Location=493..1345; Strand=+
  SCN-specific regions: Sequence locations=25-84,115-157,179-330,361 -380,431-448,470-482,504-853
atgaagaagttattacataaatttaggaaaaattcgttttttgagaaaaaaaaatttataacgctgttctgaaaaggtttttttgaaaaacacgaaattcttcctctataagcttctgtttattctatatttttataagacttttgaaaaaaagtacaaaaataaactgattttggaattcgggatcataggtgggagcaaatggtttttttggaccatgggttcagatccacttgcctgtaaaaatgtttttttagggtttttgggaccactaatcaagaacttggcatccattttgcccaattccaaagctttgatccaaactcgaaaccccaaaaataatttttaaaaaatgttgcaggcatgtggatttgaacccatggccaaaaacccatttttaacaaaacaaaaaatatatttggtataatatttctatatttgcttgaaaattttttagtgattttcatcaaaatcttttccagtgcaatttattaacagaaattttttctaagctattgcttcgctattagacaatttccaaaaaagttatacataaaattgcgaaaagtcgaaatttttgaagttttttcttttccaggcttgaaaatcttttcgcttttggtaaggctaatagagcatatgttaagagctttcgaatgataccaacaatgttggatttggatgtcaaagaaaaaagctatcgtggaaaaacgagctggcgccgaaacgcgagcaccgaaacgcgtgggtcccgtttgtacaattagtctttctaaaatattttacgaatttaaaaaaaatactaattttttcagaaaatttttgtctgttttaaaagtatttaaaatagcaa

SEQ ID NO: 61324 - DNA, 88 bp, Heterodera glycines
  Genomic contig location: Contig_ID=SeqID_30962; Location=1..88; Strand=-
  SCN-specific regions: Sequence locations=1-88
tcattcagcgactttggtttcctggtgcctggccgtgtcgcccgttacatcggcgttcagggcgacttggacccgctgttgaccggca

SEQ ID NO: 61325 - DNA, 198 bp, Heterodera glycines
  Genomic contig location: Contig_ID=SeqID_30966; Location=81..278; Strand=-
  SCN-specific regions: Sequence locations=1-36,130-198
atgccgtcgccgtcctactccaattttggcagatttggtggaggcggaagaggaggagcatatgggggaggagggagggaagagtcaccggaagagtgggaggatgaattgtcggaggaggaggaagagagacggaaatgggacaaatcgaaagggtcggcggaatgccattttggatgggtggcacaatggcggcag

SEQ ID NO: 61326 - DNA, 683 bp, Heterodera glycines
  Genomic contig location: Contig_ID=SeqID_30966; Location=814..1496; Strand=-
  SCN-specific regions: Sequence locations=1-683
atggcttttgctcagttttttgttaattgcaagcttaagtctattgaaagcaccgaaagcacgattaccattgcgtggaaaagccaaagcattaccgatgttgaaatcgagtgctatgaagtgcagtacaagaatgtcaatgaagtttggaagacgataaagtgtccgcaagttagtaaacaaaacagggagtgcaagcaaaaaggaaggcattgcatagcaaaaaaaaactgggctaagcatcaccacacaaaaaatgactgaaaaattcggtatgaagaaaggagggggggagggggggggttggggtggtcgagcccgagccgccctccccatttcggcgcggaaggccaaaaaataaaaacaattgcaaaaatatcctcggtttaaatggatcgacccatttggcacatccacggacaaacttttttaaatcgcgaaatgccgcgtttttcagcacgcgtttgtcccgaaaaaatcttacaccgcagtcgtaaagaatctgaagccggcgaccctttacgcgttgacagttgtggcgctaaataagcatggaaatactgtcgatgttttaacaatgagccccgtcgcaactaagcctcggtttacgtgatttgcttgttttctaaatcctaatttatatctttgaattggtttgttgtcttttgactctcatcaataaa

SEQ ID NO: 61327 - DNA, 72 bp, Heterodera glycines
  Genomic contig location: Contig_ID=SeqID_30967; Location=1268..1339; Strand=+
  SCN-specific regions: Sequence locations=1-72
atgtcccctccggatttcctggtcagcgtcgtcctcctcggcgcttcttccctcctttgtttgggtcccgcg

SEQ ID NO: 61328 - DNA, 595 bp, Heterodera glycines
  Genomic contig location: Contig_ID=SeqID_30967; Location=714..1308; Strand=-
  SCN-specific regions: Sequence locations=1-118,140-193,215-392,420 -457,484-595
ccgaggaggacgacgctgaccaggaaatccggaggggacattcccggataagggccattgccatgttaagcgatccattttctatattcgtcaacattttcacccctctttatttaaactttccatttctcttcattttttctcatttacataatgttttcttcaactccaccatttgcccttttcttttcaatttttctgccattcacatctgcctccgaatttttgtctctttgttcacactttctcagatcacatttttccatttggccattctttcatctcatttttccctttgtttggcattttttctccccgccgatttttgtacccttcggcgtcgctcttttgcatcttaatctttgcccccccccagggggaaaatgttttggttccattccattccattccattccatttggacacacattcacctctggctcttcactcgttctcactcctcaccattttctttctttttgctgaatcattcccaatttttgaccccctcaataatccttatcgcccttcccttcctccaattttcaccatataatccatcaacatctcgcatataatcatccaccaatttttg

SEQ ID NO: 61329 - DNA, 931 bp, Heterodera glycines
  misc_feature (827)..(827): n is a, c, g, or t
  misc_feature (916)..(916): n is a, c, g, or t
  Genomic contig location: Contig_ID=SeqID_30969; Location=1..931; Strand=-
  SCN-specific regions: Sequence locations=1-734,803-822,869-887,916-931
atagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccanatgtctgaacctgcggttcctctcgtactaagcaggattactatcatagcaacaggtctttagtagggtaaactaacctgtctcacgancgtctaaacccagct

SEQ ID NO: 61330 - DNA, 3750 bp, Heterodera glycines
  Genomic contig location: Contig_ID=SeqID_6382; Location=85..3834; Strand=-
  SCN-specific regions: Sequence locations=1-235,257-312,334-444,470 -651,673-753,775-1105,1131-1479,1508-1600,1627-2094,2116-2486,2508 -2719,2742-3113,3136-3418,3440-3750
atggctgcatttatgcaaaggacaaaaaacacagaatatggtggtgacagagtaaacgaaaaaacaattcgaaaacttgattttattattcgaaaatatcatccacttgcaaaagagctaatgaacttccatacacagtaccaaaaaactttggacgagctaggcccagaagctgttctcaattttcgtttgacattggtcgaatctcgtgaagcaccattaaatataagggacccttctctccatccaagacaagccaacttacccgacgagggcaattctttatttgctatctgggctgaaagcgatcagccaccattattaaaaggcatttggatcactaccgatgaaggaaagcttcaaaaatttcaaccacatcacccacaaaccgattctctttgttaccccacattatttccacatggcgatgacggttttcataccaaaattccttacaactacaaaaataaaaagcgcgatgacgaagcaatggaagttaatgtcgaatctgatgaaaatgcttttgattcggatgaaaatggacccgatgacgatttatcggtcacaagttcacttgattcagttgataaaagtggaacacgacagtttttatctgttagaacttatattcgctaccgtatggcgctgcgaaaagacaacaattttcaccatatttggagcgcgggtggaggcctcagtcagaaatttattttagattattcagctcgcattgatacaaacgttgcaaattatttgcgaaaaccagaattaaatttacggagtactttaccagaaaatgcgcttcgctggctttcccgtaatgcggggcttaactcaaccgaagaattaggtagcgttgttatgtttcgcagatctgagcctgggacacgggcatactttcaacataaattttacgatgcgactactattatgtcaaggtttaagaggccaggatttgcatcattctttttaacatttacgacaaatcccagatggccagaaatttctcgaaattttcttcaccaaggtcagaggactgttgatagacccgatttaatttgtcgcatttatgaggacaaactacgacaccttcattatttattggataagaaaaatattttgggaaaaatgattggccaggaatgcagagagtttcagaaaaaatacggcggtccgcatgcccatcgagtttatcataccgatctgctcgcaataccagaaaatgttgacggattgatatgggcacatattcctcccgagccaaataagaatgacaaatctgattgggctatttttatttgtaaagtgcgtgaattattgccaaaatatcagttccatgactgcgggcgccattgcttaaaccataaagggaaatgtaaaaaaggttttccaaagccgtttagtaaattcacaattttacatgatgatcgaccagctatttatttccgtccgagtaccgaagatggtgggcaaacattgactgttaaaagaggaaaaacacaaataacttatgataattcacgagtgtccgcgtacaatccttatattttggttcactttgaaactcaccataatttggaatatgcatatgggcaaagcacaaatttgaaatatttatacaaatatccattcaaaggtcccagtttttcgtacgtaaagactaatgaagaaaatggaaaaacaggtattgatgagcctgcttattatgctagaatgttatatcgttcatcccctgaggcctattgccggatcatgtcgctcaaatatgctaaattatctcataccgttattgcgttgtcactccatttgcccggtcagcaaaagatttactacaaaccaagtgaaaaagcgtccgtcgctcagcaggttcaggcaggcattttgcccgaaacacctttaacagcatattggaaaatgtgtgaaacggatcctgatgttagaaaaattgtttttgagcgtatgcccgaacagtattcattcaacaaatctggtaaattttggaaaaaacgtactttttcagcacgtccagataatataaaaaacagaaaaccaattattggccgaatttacccggtttcaccacgaaatcctgagttatttgcattatatttactgacaaaacatttccccggaaacccgcaacaattaaaaatggtaaaccccacgcatatctgtcaaacatttctggagacagcccgactcaaggggcttattgatgacaatgatgtgtgggttcggacaatggaagagggtgctgcctcgctcaccccagcacaaatgcgtcaattgtttgctaatatactaatttttggagccactgaaaaatgtctcattgatggagccctgctctgggaaaaatttaaatcacaaatgtatgacacacgctgcacagatgctgagcgtactgctcgtattgaccatgctcttgctcttttagaaaaattattagttgcgcaaaacaaacaatgtaaagattatggactgccaaccccagtgatttcaattatgaatgatccacaacgtgggcttaacgagtttttcttcccccagcagttaaatgatgatgatgatgatgacccagttgacacaacagcatttgaacgtggaaagttgaatgctgaacaacaaaaattttttgatatggtaaaaaatgcttttttgaaaacgtcgaattctcgtctattttatttatgtggtgatggcggaactggaaagacctttttgcttaattatattttatttcaactgcgaaaaatcggcgcaaaaatcattcccactgcatcgaccggaatggcttccacccgcttttatgtaggtggcaccacggtccattcggcgtttaaatttggaattaatgttgagcctggaaaattacctgcaattccttttgatagtttctttggcaggcgtataatagaaagtgacattataataattgatgaaatgactatgctggagaggacagtttttgaaaatattgatttactctgtcgccagttgtgcatgcaaaaacggcacttacctttcggtggaaaatgtgttataatctccggtgattggaagcaatcacttccagtcgtaataaattcttatggtagtgcagctcaagttgcagcatgcatccagtcctcaccgctttacccaatattttcaaaatacaaattgacgcaaagcatgcgagttaatccaaacgaaatagagttccttaaatggcttgatgatattggaagaggattaaatggagacacggtcgcaatcccaaaaggcatgctcgtcgattcacgtgaagatcttattgcatgggtgtttgatcaagggcttaatatgccaagtagcgaaatgcttaagcggcttcttttggctacaacaaacagaattgttgatttgaacaattctcaaatttcgcaatcaatgcttggtaactttattgaatatttttcagttgacaaggcaacagatgaaaacccgtttgccgtaaatgcggctgactttgatgtagcacaactaaatcagctgaatccgatgggaatgcccacccatttgctgcggcttaaaattggatcaattgtcgtcttactcgtaaatttaaacacttcaaaaggtctttgtaatggcacccgacttcttattaaaaaattaactgacaatttaattgaatgtgaaaccattggtagcggatcgtctggaaatggtataattattgggattccccgaaaccggcatacatttaaagataaacgtcctgacggt

SEQ ID NO: 61331 - DNA, 609 bp, Heterodera glycines
  misc_feature (586)..(586): n is a, c, g, or t
  misc_feature (595)..(595): n is a, c, g, or t
  Genomic contig location: Contig_ID=SeqID_6383; Location=16..624; Strand=-
  SCN-specific regions: Sequence locations=1-293,316-533,555-609
atgccactcaatttcccagggcattggactttgcttatttatgacataaattatggcacttttttcatggattcgttgcaaataagtgagttaaattttgctcgtgtattgcgtgtcaaagatataattggtgaattgtgtcaaatcaattctgaagatataataatacaaaaacttcctccttccaaactgactcttcaacatgacggatgcagttgtggatattttgtttgcttatatgctgaggcatggctgatgaacaatcaatcgcttattttaccaaacattgatataaatttggaaaaaaggagaattctttggcatataaacagtctttataatcgtgataacgtagtatatcacccgtgctcattgtttgttgccggcgaaaatgacaatttgggttctttacatcattcgcgcgattcatctatgtccattgattcaaacataaatcaaactccagtcaaaagaagaggacgaccagctaagaatcgttctgggtcaggacggccaaaaaagacagaaaataaccaaatattaatgcctgttttttcgcacgaatcttttcatttcaccgaattanattattcangctgctctgattct

SEQ ID NO: 61332 - DNA, 208 bp, Heterodera glycines
  Genomic contig location: Contig_ID=SeqID_30973; Location=311..518; Strand=+
  SCN-specific regions: Sequence locations=1-208
cgatgcaaactttggcgaataccaccgaaaagcgtcgaccaatgagcggcaaaaggaagaagcggctgaaggggcggcggacgaagcggaccaatgttcacacattagcatcccggttcagtaccgcaaacattcgtccacctcggaaacgtcgtcactgtacgaccaaattgtggaagcggaaggcaaagcattaattaacaaataa

SEQ ID NO: 61333 - DNA, 1121 bp, Heterodera glycines
  Genomic contig location: Contig_ID=SeqID_30979; Location=272..1392; Strand=+
  SCN-specific regions: Sequence locations=1-353,375-411,434-620,672 -833,855-907,932-1003,1026-1121
atgattttggaattggcaattgatacagcgaatgaatgccaaacaaatgaaagtttagacggaataattcgacaaaattatgacaaaaatttggaggaaatgtttaaaaaagcggagaaaaaggcaaaaaaagacagtccatggaaagcctataaatacaaacataaaataattattagatcgaaattcaatgatgaaagtacatgggtgagatttaacattccatgataattagaaatattcaaattttagactgatgaagctctattttcggaatttgttaagggattagcgacaaattttgagaatttttttaagatggctaaagaatatgcaaattatttatggcgaataaatgagaaaggatgtatttatgggtataatagacaaatgatcaattttgggttatacaaaattaagaacatgaaaatgtatttgatgcaaaaatatgaagcctatcttggccttatgtatttgatgagagagaattggcactgtgataaaattggggaagaatttaatgaatataaacggaatatatgccaaaagtatcgaaaatatttgcatattttatatgaatatttattccggttgtatgctgaaggtttgttagatttttgattattttgaatttttttgtttattaaataataacgataatattttattaagctaaaaacccgaagatgtcgaaacaattgccaccatttgtgaatccaatatttattggacgaagttatttatattgtttaatttttgttatcaatacactgaatgattattcgaaatttttttggcgaaatgatgatttatgggatgatgaaaacgttgaaatttgggggagttttttggtgaatgaggaggaattaaatgacgaaattaaacttcaaattgctgaaaaggcacgaaaaaataaaattaaaaaaaatatctccaaacttcgaaagcaatttgaacgaaaaatgaaaagattatccgaaaaagccacggaaaaagccaaggtagcaaaggagaaattggaaaaagcaatatcaaaagcaacagatgatgaagcaaaaaaaaatctggaagaagaatatgattacatatttggctcattaaattcgtcgccattttcataa

SEQ ID NO: 61334 - DNA, 49 bp, Heterodera glycines; identical to SEQ ID NO: 51181
  Genomic contig location: Contig_ID=SeqID_30980; Location=774..822; Strand=-
  SCN-specific regions: Sequence locations=1-49

SEQ ID NO: 61335 - DNA, 519 bp, Heterodera glycines
  Genomic contig location: Contig_ID=SeqID_30981; Location=200..718; Strand=+
  SCN-specific regions: Sequence locations=1-107,134-241,295-519
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcactttctgaaaaaatacttatgaattgattttgctaaaaaaataaaaagtaatgaaactttaaaaattaataaaaaattttaaataactactggagttggcatcttttcagtaagcttttcctttacatttttgatgctctcgcaaaatctggttcgcttctgaccagtttataaaaaaaaatcgatgaaactttttaaaatataagcctaaaatttttcgcatatttaaaaagcaattaaaaatttttagattttttattcatctccctttttgatagtgaaagcatctgagtgcctaaaataacttgcaa

SEQ ID NO: 61336 - DNA, 95 bp, Heterodera glycines
  misc_feature (7)..(7): n is a, c, g, or t
  Genomic contig location: Contig_ID=SeqID_30981; Location=1..95; Strand=+
  SCN-specific regions: Sequence locations=1-95
ctccctntttgatagaaaaagcatcagagagccttatttaacttttaattaacatttggtgcgtttcagagcacgttctaaaaaatatttatgaa

SEQ ID NO: 61337 - DNA, 100 bp, Heterodera glycines
  Genomic contig location: Contig_ID=SeqID_6385; Location=1191..1290; Strand=-
  SCN-specific regions: Sequence locations=1-79
ctttttgacggctgattagccgatatgtgaagttgatcggaatacaatggcctcacattgccatctgatccacgaaaactaaaaaaataataattttaaa

SEQ ID NO: 61338 - DNA, 758 bp, Heterodera glycines
  Genomic contig location: Contig_ID=SeqID_6385; Location=2466..3223; Strand=+
  SCN-specific regions: Sequence locations=1-297,319-453,496-677,709-758
atggaaggaaaacttttggtatttttttattttctaaagacagggcaccgattaggacacactcaatcagttcacgctattgttcaatgggtcttgaccctacaagagtctcgagtttcttggaattggtcgtctcggctttgaattctccggaaattcacattcgagcaggaacggaatttctgaaaatttataagctaaaagtcaattaaatgttttttgacaacgaccctaaattgattgatcactctgatcagaggaaggaaattattttgctgatatttttaaggtgatcgccgtttgtttgtttctgcattcatttgtgccaaaagaatattaccagcatttgcgcaatgcttcatcatctcaaaatgctaacagtttcgtggataaacaattgccatcacaacagcattcggtgcttacaaatacggcacggaatacggtaaaatgaatttaaaattgttttatattttaatttaaatatttttaaaacaattttcgagtttctgccctgaattcatgatatacggctttttaaattaaattatcatttcatatttttcaggaagcctcagtcctggcaaaaaattctaattgacaggcagcaaaaaattttcaaaatttttttcaaagaagccatttttttatacaagacatattccaatgagcaaatctttataataattaaataattaatcaattaatcattgttgaccaaacaaattattacaaaatatgaataatgtgaacaacaa

SEQ ID NO: 61339 - DNA, 2140 bp, Heterodera glycines
  Genomic contig location: Contig_ID=SeqID_6386; Location=398..2537; Strand=-
  SCN-specific regions: Sequence locations=1-4,37-93,116-125,173 -583,606-1085,1108-1143,1167-1321,1359-1394,1416-1447,1481-1570,1609 -1950,1987-2140
  Gene Ontology: Cellular component=extracellular space
atggaaatttttaatttctttttattatttttttttgttggtcaaaatttgatcatagctgaagaagaagtgaagccgtgcaagaaaaagaggtaaaccaatttagttaattgactgtgtggcttttaattagtcaattcattaatgattaattgattaatttaactaattagctttggccatgactcatttgtgtgcgtttgttcgtccgattattgcgactcgcccgaaccattgggcgatgtcagtgggaacaaaatggtgtattatgtgagcgacaaattggcccatcgattggccaaatttaaaaatgccgaaaataaaaatggtaaaataatttaaaaatgccaacaaaaattataaataaattttggagaaggtgcaagtgatgacactgaattcgaagtgcgcgtggacgcgtcaaagaaacggcagcgcattttgggctttggcggagcgttcaccgacgcggcaggcgtaaatttaaacgcattgagcgaacggagccgcgaggcactgctgaagacgtattttgacaaggaaattggtacaaatggaatattgacagaatcacagtcctgacaatttaaaaaaattaaattatactcttctaacattgccaaattcaaaaatggcactaatgaccctgtttgggttacggtacctctcttaccatatgccaaatcacttcaattttccgtttttcctgttttaggcatcggttactcagttggccgtgttccaattgccagctctgacttttccacccgtgaatattcgtatttggacacgccggacgatttcaatctgaccacatttgcattggccagggaggactttgaagagaaagtaaggcattggcattggcacaaatagtcggagagtcaattcccaagaaattcttgagaatttcgggcaaatggtctcgagtcttgaagaattcctaattttggatttaaaatttacaaaaaggagaaatttctgaattaactgccaacattttcagatcccacacattttgaaggccattcagctgaccggaggggacctccgtttgtatgcgtcgccatggtaaaaaattttcataaaaagtacaaataatatttttatttgatgtttatttaaatctttcccttggcatggcatttttaatttcaattttatgcttttcaaaggtctccgcccggttggatgaaaacgagcggacgaatgcgagggtccgccaaaatgaagggcactttggatgggccctacttccatacctacgcacagtatttcaagaggtcggctaaaattgagaaaattcatttatttatgttcgaattataaaaaaatcgaataattattttattattttaggttttttgaagaatatgccaaacaaaatgtgactttttggggcctaactctccaaaatgagccatgtcagtgaattaattaattgtcgtttttaaattttaataaatatatatattttttagttattgtttataacggtaatctcagctggcaagcgcattggtttgacagcaaatcgcaatggtaaaattgaaaaaattaggcaaaattgaaattttattttaaatttttaataattttaaatttttagcgattttgcttctcaattgcttctgccagcccttaaaagctcggaagcatcaaaaaatttggtaattatggcccatgatgaccaacggcataccatcgaagcggagtctaaagatgtaaccaaaaaactgaattttttttttgaaatttttcgattttttagcttttttacgacccgcaaaaaactgcaattgatgggctggctgtccattggtaaacaaaaaaattttaaatgattttgttcgaatttgtttttcaaaggtatgcccattcgacgtacgatccgttgagcctcatgcacaaattataccccgacaaatttttgttggccagcgaagtgccaaaaattgaaaattttaaaaaattcaaaaaatttttctaggcttgtgcaggctttttcgattgggagcacacgccgttgttgggcgattggattcgcggttggtcctatgggcatgacattctgaaccaattgcgcaattgggtggtcggatggacggattggaatttatgtgagggaaaacattcgtaa

SEQ ID NO: 61340 - DNA, 615 bp, Heterodera glycines
  Genomic contig location: Contig_ID=SeqID_30982; Location=45..659; Strand=-
  SCN-specific regions: Sequence locations=1-501,524-615
tttggaaattttcccacatccggattgggcgatgaccaacagaaccaattgtcattcgtggagttgggcacttagccatggggaaagagttaatttaagacaattaggattaatagcacttgttttttttcgaaggtttggccttaactcgcatttttcaacggaatttcctagcgctctgacaggaaaattggcaccggaagagtttgacgacacattgcgacgtgtgaattacgttcttcagaggaatgtgagcagaaacttgcgctggttgatctgcggattgcttttttgctgctgcagcttcggtatttcgttatggccggtggtctgtctgaacagaagggtaagcggagaaaagtttcatttcaattttttgtaaaaaccaaaattcaagactatttccgctctcgagaaaactctggaccatgaaaatcaacaattgtacgacaagctcggcttgcattggtagcgcacctttaacttttcaatttgtttgctacaaatggcgatttcaggaagttggccaggctgcccgttgagccgtccaatcgcctgacagaatatgtccttctgcttgaaacgctgccacgaattcccctttccatgccggat

SEQ ID NO: 61341 - DNA, 175 bp, Heterodera glycines
  Genomic contig location: Contig_ID=SeqID_30983; Location=254..428; Strand=+
  SCN-specific regions: Sequence locations=1-26,49-175
  Gene Ontology: Mol. function=sodium:chloride/potassium:chloride symporter activity; Cellular component=mitochondrion; Biological process=transport
cacacacagtgccgagccgaacaatgacagccatttgttgtagaaacgaaagccgggccggaagccgggcgatttggcggccgacgcatcgaaacaggcaaaattggtgatggcaaaagcggccaaaaagaagttggaaatcaaatcagcgatcgagttcagctccccaatcatg

SEQ ID NO: 61342 - DNA, 1442 bp, Heterodera glycines
  misc_feature (364)..(364): n is a, c, g, or t
  Genomic contig location: Contig_ID=SeqID_30983; Location=251..1692; Strand=-
  SCN-specific regions: Sequence locations=1-146,168-1391,1414-1442
  Gene Ontology: Mol. function=sodium:chloride/potassium:chloride symporter activity; Cellular component=integral to plasma membrane; Biological process=transport
tgcagacccgaatactgtagtaacgttaattacagtaacacaaatactgtgaaatgtttaaattgccttacattaatttcttttcttgaatttttttccaggtgatctcaaagacccgtctaaatccagtaaatttttacacgaatttaaaatttaattgaaaaaatgcaccatttagtccctcgcggcactttttgggctatcgctatcacaacactcacttatctatggtatgtttgggcatttttcttcgacaataattcagcacttttaccataaaaggtgtatggtgatcacggcattgactactgtacgcgatgcaaccggcttttccgagcctgaacttcatcccacccacccaccngctacaccgtcccgtcgtgccgtgccaatgacacgtgccggtttgggttggcaaatgattatgatgtacggccaatttaactgcttgcgctctatatataattgaatccatggttactatgatcagattctgatttagctagagctcgacattttgaaaaaaccatggacctgggttttctggacaaaaacccaggaaaatgtagtctttttcatgtttgactaaaactggatttctggaaaaaaatccagggaaatccatgtccgggaaaaatccaggttgccgaagaatgcctggactttgacccggatccttcgagaaacccaggcttggatccagatccaggtcgagctctagatttaacccttgttttctgagtatattatcccgaccacatttctcgtctaggttatgaccctgcagggtgcttgggcaccactgatcactgtcggcattttttccaccacgctaagctcggccagcggctgtctgatcggtgcgccacgaattttgcaagtatttataaaagaagcattttaccagtcggatttgtctgacaaaaatttttcaggcattatgtgccgacaaaatgttcccctatatgcacccatttgcgaaaggctatcggaaaaccaacgacccgttcagagcctattttctcactcttctgatcgcaatttcggtgttgtttttgttagcattatttccattagggcatgcttacattaatgaaaaaataagttgaaacctggcttgtcgagaattttggtttttcaagtttttcgaacctttatcttcaattacagttaatgcaagattttcaattttcaataatgccatatccaagacctaatcacaaggaaatatgagaatggctaagcccgctcatttttaggcgatcatgattggggagctgaactcgatcgctgatttgatttccaacttctttttggccgcttttgccatcaccaattttgcctgtttcgatgcgtcggccgccaaatcgcccggcttccggcccggctttcgtttctacaacaaatggctgtcattgttcggctcggcactgtgtgtgctt

SEQ ID NO: 61343 - DNA, 388 bp, Heterodera glycines; identical to SEQ ID NO: 51536
  Genomic contig location: Contig_ID=SeqID_30984; Location=199..586; Strand=-
  SCN-specific regions: Sequence locations=1-20,42-275,297-388

SEQ ID NO: 61344 - DNA, 729 bp, Heterodera glycines
  Genomic contig location: Contig_ID=SeqID_30987; Location=200..928; Strand=+
  SCN-specific regions: Sequence locations=1-167,189-215,271-328,351 -446,469-544,566-729
atgttggaacaacaaatggaagaggcgaagaaagtgaagactttggtgaacatgcttaatgtgagaagaaagccgataaaaacggtgaaaaaattggagggaattcccaacgaaatgaaggcgaaatcgaccaatttggaagtgataatgaagacaaatgaacagcagaaaatgaggggacaaggacaatccaaggacgaaaaaaaggaaaagccgaaaaagaacaaggaaaagaaggaaaagggcaaggagaagaagaagaagaagaagtcggacaaaaaggagcaaggagaagcggaagtgcgaagagcaaaaaggaaaagcgacgacccctggggggaagaagggggcaactcggtgctggaggagccactgacactgccggacaacgaaagagacggcacaacgacgggccgatgcaacagcgaacggattagaaagtgacatttggggaggcacttataagcaagattactaatttttaattcaggatcattacgagggtgagtgacggatcgtgcccaattaattaactaacgaactctaaataattaattatatttaaccaaatgatttgctcaaaggcaaaaggaagagacgcatccgcgatcaaacggaacattcaaacggtggcggaacgccaatttgaagccaaattcaacgtgatttgtgccaacgctgacttttcatacatttcgaacaccgacgtacccagaaaaaagcattgaa

SEQ ID NO: 61345 - DNA, 732 bp, Heterodera glycines
  Genomic contig location: Contig_ID=SeqID_30989; Location=369..1100; Strand=-
  SCN-specific regions: Sequence locations=1-270,292-470,502-551,599 -681,706-707,729-732
atggtagaggaagcggtccaagagcaggaacgccggcggagtatcgtcgtcatgggattggccgagtcggccgagccaaagccgtcggatcgcgttgctcccgacagcaccgctgtctcaagtatactcgatgagcttggcatcgagtgctccatttcaaactatcgaatggccccccccccaccaagcggggtcaggtcatggacggccgcgttccatttttaaatacctacaaaaatactatgttaatccctttgaaataccgaatttagtctttgaaaacaaatgctatcatgatggtgatgaaaaatgtgaattatttgccagcttatttgcaaattcatttaacatttctgatgttgacccaggctattatagcttgggaaacaattatgcaatcaatgctttatatagaggaattagattaaaaaaactaaaaaaatcaatggtatagatttttagttagtaaggccctatccaaatttaaaaaattttgagttattattgcgcgtttgtgcaaaaactaaatatctttaagtgttgtctaccagaataataatgttaatttattacaaaagtataaaaaaaattataaaatcaatgtcagaggaatttcattaaaactaattaacatagtacaaatatttatgtcaaaatttgaaattcttcgaagtttttgatttaaaaggaaatttgactaaattacgattcaaaaaatattttcaaaataaa

SEQ ID NO: 61346 - DNA, 1563 bp, Heterodera glycines
  Genomic contig location: Contig_ID=SeqID_6388; Location=342..1904; Strand=-
  SCN-specific regions: Sequence locations=1-273,295-332,354-433,455 -1144,1166-1563
  Gene Ontology: Mol. function=ATP binding; Cellular component =extracellular space; Biological process=cell surface receptor linked signal transduction
cctcggcgacacgagctcgggaaattgccgtgtcaaaggacacacaagatgaacgagcgctggaggtggagcagtgcgagtgtccccccggctacgtcggcacttcctgcgaagagtgtgccgagggctacgaacggtcgggccaagggccctacctgggccattgcgtggcggcacggcagccaccggaacggccattgtgtgactcggccggcgcattgtccgcccatccccaacacgacagacgatgcgattgcaagccgaatgtagtcggtgagaaggacaaaaagtcaaattctaggaaatgaaagtgtaattggagcggaagaacggaaaaaatatgacaggaaaagtgccggggggacaaaagtctaatggaggaaaagcggatttaggagaaagagcggattttgtgattatgatgcacatattagaaaaatggagagggaaagagtctggacagagaacttcacttagctttatgcaaagcttagacaaaatgccttttgattgtccttggaaaacgctgcagggattatttatgcgccacaaatgctaaagcgctaaatgcgtttatttggccttgggattaagccaactcggccaaatccctttttgctgatttatccaagtgttgtgtcgcaaatttgttgctaaattttatgtttcggcgttttgcttttcaattttgctttttgctttgtccccaacaatatctttgaaggcgtcacttgcgaccgatgtgcgcccgaggcgttcaatttgtcgccccaaaacccccaggggtgcttgcgctgcttctgctcaggcgtcacgcgcgtgtgcgaaagttcgcattggcgccgcaaccgagtcgagctcgattatgcgcgcgtagaccgcgaccaattggaggcgaccacgtcggacgcgcacagtccgtacaaccgccgacgcaaccgcaggttcgccgagcaaagcgaaagcaaatcgcaaaacgaacgcattgtgcatacggtaccatcccctcaggtgtacgatggatccatcagtttccacgggttttatgaggcacgcggtcaaacactatactggagcttaccgcaaaagtttctgggcgacaaagtgaccgcctacggtggcaaactccgctacactttccgcttctccggcgccgggccgctcaacccggacgcggacgcgatcatccgcggcaacaacattcagctggaatatgtgagcaggcagcaagtgcacgcggaccggcccaatttggtggaggtaaagtcggcacaaagagaaggggcggcaaacattggaaaatgccctcctccgcctcaggttccgatcactgagctcggctggcgccactccaacggcgtctccgcctcgcgcgagcagctcatgatggtgctggccgacctggacgcgcttctgatcaaaatgagttacatgcgcgagtgctcgcaagcgtcgcttgtctccgcctctttggacacggcggacgcttacggcacgggcgaaggtgcgttggacgtggaacagtgccaatgcccagctggatacattggcagttcatgcgag

SEQ ID NO: 61347 - DNA, 573 bp, Heterodera glycines
  Genomic contig location: Contig_ID=SeqID_6389; Location=253..825; Strand=+
  SCN-specific regions: Sequence locations=1-240,274-296,318-573
atgtgcggttcgatgtgtcccccggcgctggccaaacttttgggatggcatcgtgccaaagggggccaacgcggccaacggcccgagtcgtttttgacagcctacgaaatggagcaactgccggtgatgctgaacgaattggaaaaggccaaccgacacttttggcaaatggtctgctggcgatggagtcaaaatgagcagaaagcagcggccgaacgaagtgcgaaaaaggcgagacatcagcagcaaatgcaacagcagcagcagcagcaggagacgacgagcggagaaccgagtccaaaggacaaaagaaaaggtttggcattgtgtcttttccgccaaattaagttttaatccaactgttttaggctgtcccgacgattcgtacgtgaacggatgcgctctgcgcgagttggtccgtttgatggcgaagacaatgtgcgagaagggcacttttgacgcgcggacagaaacgatgctgacggagttccgcgcgcgcattttgggccaacggaacgcgtcgatgagagaaacgatgggcaaagagagcaaagcggagaggcggcggaaaga

SEQ ID NO: 61348 - DNA, 1345 bp, Heterodera glycines
  Genomic contig location: Contig_ID=SeqID_30993; Location=594..1938; Strand=-
  SCN-specific regions: Sequence locations=1-467,489-678,700-765,788 -796,818-1001,1025-1199,1224-1253,1282-1345
  Gene Ontology: Mol. function=pre-mRNA splicing factor activity; Cellular component=small nuclear ribonucleoprotein complex; Biological process=cell cycle
tttatgaatataattaattttaagtttgccaaaagcccaatcattacgggtgctttttcactttgtaaactcaatctttaggggtgtatttttcccgaatcttcggggaaaataccgatagctgaagcaggaagttcgaagctcaaaaaacccgaagttttcgaagccgaagtttcgcctagccctgcctataatgttcaatttgcccatatactctcttagaaaatgcatgcacctgtcaattcgataatgcattcgtccgaatttctcaataataattcataaaattgtttgccgaagaattttctattgaagagtagcaaaattcatgataaccttttcatgacaaagaccgtcataaattaggtatataatattaaacccctcgattacggctagaacatacctatggttaattttccataataatataatcccgaagcaaaaattaattggtaccgcacccgtttcttttcaatctttttcttgtctttcttgctcattcataagcgcatctcgtatacaatgctattttgaaagttacatgcgcgcgccacattttcaagtttctcctagcgaggttcccttgtaaggttgtgggatttttttgaaattgactgtttttaagagacggataatttttaccgaaattttgtcagtgtatttgaccaaccagtcaagaaatgtttggttatttccgcgttttcaataaaatccaaattttgctcctttttaccccgtcttgttaagattggtttattcttcgaaaattttttggggggtttgattcgctaagttcaaaagggcaccaatttatgtcacttcccattatcggacctaaattcgaacagacaaccgaatttttttatattttgaaaactatactggtcccattaaaaaagagaaaaatgtttttttttcaattttgctattgattgtgagcaaaaaaatgacgacaccaaataaatctatatttttgtcattttgccttccatttgcaggtgcctgacttcaacaaaatgtacgagttgtacgacccggtcaccgcgatgttcttcttcaggtttttctcagaatttagggaaaaaaaacattttctgcatttcctatgactgttttttgaattcgaaataaatttcccaattgtttgttccttaaattgtcctccatttttaggaacaagcatatcatgatcgacttgggcaccggcaacaacaacaaaatcaattggccaatgcacgacggccaagaactgatcgacatcatcgagacggtgtaccgaggcgcacgcaaaggccgggggtaagcggtggggcaacttaaggaccgatagaaaaacccccgg

SEQ ID NO: 61349 - DNA, 293 bp, Heterodera glycines
  Genomic contig location: Contig_ID=SeqID_30994; Location=180..472; Strand=-
  SCN-specific regions: Sequence locations=1-293
atgactgtcatcggcgatctgagcacccagaaacaactgaaaaatgccgtgggcaatggcgccgccgaattcacccaacggcggaagaaaggcaaatacagccccaactcgacggagtgcgaaggtgcggcacggcagccgcagaaagaggagggcattttgcagagtctccgctcgtacccaacgggcgtctttttcatgttgggcaacgaattttgcgagcgcttctccttctacggcatgcgtgccattctgatcatttatttggtggtggaccacaaactgtcggacaa

SEQ ID NO: 61350 - DNA, 417 bp, Heterodera glycines
  Genomic contig location: Contig_ID=SeqID_30996; Location=495..911; Strand=+
  SCN-specific regions: Sequence locations=1-417
atggttcacatgcatcgtttggtgggcaatcagccacacagcggagggtcggcattcttcacttccgaaaatgtggaattggtgagtgcgcgggcatattgaattttgccattttcttcataatgttaggtaaatcaatcgatgggtaccaacggccattgctccgtgggagtggcgccgcataattttggctcctttggacaaccaaccaatgtgatggcattctcttctggccaggccatggcttccggcatggacaatcccattgtcctaatgggacagaatttctcagctgaccaaatggaagttgggccgggtcggacggcggaaaccaacgaggaaacgaccggtgcatttcggatgctgttcaaatgcccggagtgtggcctcgtgaaaaactccaacggagagttggaa

SEQ ID NO: 61351 - DNA, 192 bp, Heterodera glycines
  Genomic contig location: Contig_ID=SeqID_30998; Location=577..768; Strand=+
  SCN-specific regions: Sequence locations=1-192
atggccaacttcacaattcgatcatcaattgaaatcgaacgaacgcgaaagtcaactccgatggtggctgccatgtccgggtcaaatttatcatctacaaatcgcgcgattaggctggatttcccgaccccactttcgcctaaagaaaaatataagaaaacatggacaatggaattgttccacgaaccgatg

SEQ ID NO: 61352 - DNA, 478 bp, Heterodera glycines
  Genomic contig location: Contig_ID=SeqID_30998; Location=173..650; Strand=-
  SCN-specific regions: Sequence locations=1-478
  Gene Ontology: Mol. function=RAB small monomeric GTPase activity; Biological process=negative regulation of FGF receptor signaling pathway
atggcagccaccatcggagttgactttcgcgttcgttcgatttcaattgatgatcgaattgtgaagttggccatttgggacacggcgggccaagaacgctttcggacgcttacaccgagttattaccgcggaggtgcagcgattttgagaatttaagagcgtctctctgttcaggccaaggagtgattttggtgtacgatgtgtccaatcggccgtctttcgagaatctcgaccattggctgttggaggtggacacttactgcaccaaaagtgacaccgtcaaaatgttggtcggcaacaaaatcgacgcggtgagagcaaacttcgcaacgaaacaattgaccaacttaaggagcgaagaatggtctcgcgggaggagggccttcaatttgcgaagaaacaccgaatgctttttatcgaggcgagcgcaaagacgcgcgaaggagttcaatgcgcatttgaggaactcgtggaaaag

SEQ ID NO: 61353 - DNA, 1062 bp, Heterodera glycines
  misc_feature (17)..(17): n is a, c, g, or t
  Genomic contig location: Contig_ID=SeqID_30999; Location=219..1280; Strand=-
  SCN-specific regions: Sequence locations=1-389,411-838,860-1062
atgcagtacaatgcttntaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatggaaatatcagatggg

SEQ ID NO: 61354 - DNA, 442 bp, Heterodera glycines
  Genomic contig location: Contig_ID=SeqID_30999; Location=594..1035; Strand=+
  SCN-specific regions: Sequence locations=1-277,299-442
aattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaa

SEQ ID NO: 61355 - DNA, 1339 bp, Heterodera glycines
  Genomic contig location: Contig_ID=SeqID_31000; Location=385..1723; Strand=+
  SCN-specific regions: Sequence locations=1-64,102-675,697-1211,1250 -1339
atggaagattattcaccagggtctatgaataaagagaaatttataaaattcgaaaaatggtaggaaaataatttaaaaaaaaacaataaaatcttatttttcaggtataacgaaaacaaggagacacccttttatttggatgaagaattgaaaaattattgccgaaacgacacggagattttattgctgtcaattattgagtttaggagaattttgatcaacgacattacgaagggatttgacccgttgccgaggagttgtacgaatgcgggggtcgcgatgaatatttttaaggcactgtttttgttgacggagcagttatcgattgtgccggagaagggatatgagcggtgtgatagagcgagtgtgatggccattaaatatttggagtggcggagcaaacgggatggaattgagatacggcacgcggggaatggacgagaggtcaaagttggaaattacaaattggatggatttattgcgaatgaaggaggtagggacaaatgcattgaggtgatgggatgttacatacacggatgtttgaattgttatgacccggcggcggaactgattggtggaaggacggcccaggaattgaacgatgagacgcaggagagattgatggagctgcgtaagactttggacgtcgaagaagtttgggtaagtttatctgacatttacatttttattgtgagtttttaggggtgccaaattgaaaaggaactgaaaaaggatgaggagatgcgggacttcttcgacgacagagggaatgagaaggggccgattgatccgcggatggcttatgcaggagggaggacgggaccgatgaaattgtttgcaaaatcggacgagaagaaaaaaattagcgtttacgatattgtgagtctgtatccgtctgtgaattacggtacagcttacccgattggattgccagagattattataccgaagagcgatgagattgatgttaattggacgagaccggaggatttgaagtataagggattgtataaagtgagggtcaacccgccgcgggggttacgggttccggttctgcagttgaagtgcgatgataggttattgttcccgttgtgttggagatgtgcgtcaaaatttaagaaggagactacgagatgtaattacaattgcccccatgatgagacacagcggagatacgtggcgacatataccagcgttgaattggtaagaaatttaaaatttgaaatttagataattttgacattttcaggcaaaggcgttggagtgcggatattctgtggacagattttatagagcgtggcattacgaagaagaggcggatgacttatttaaaggatat

SEQ ID NO: 61356 - DNA, 1099 bp, Heterodera glycines
  Genomic contig location: Contig_ID=SeqID_6390; Location=1867..2965; Strand=+
  SCN-specific regions: Sequence locations=1-312,334-558,602-1099
atggattatgaaacggtgccaaaatggggcgacggcgacgacggatcaatgggaaggcgaaaatttggacgatttgaacactgtcgcctttatgtttttccctgccaaggaatgcgttgggtgagcaacaaaaaaaagcattttattttgtttaaaaattgtgccgaatttttaggcgtttgtctccacgtcgaaaatggtgtcaaattatgtgaaagtgatttatgcatttgagaaaaggtcgatcattttggattataatgatgaataggagtgatttgatcatttttaatgttcgtttttatatcttcgtttaaatatattttattttatctcgtctcgacgcatccctttgatatgtgtactaggttgcgtccccgaccgtcggggttggaaaagtcggggttggaagcgtcggggtcgaccacatcgttcggggtcgtggtttttcaatttttgccttatgccatatagtcaaaaaacttacattatttttgcttaaaatttttttattattcattaatacttttatgtacttttttatttggtaaaaatcagttaaaaaattgcattttaattctttaattttcaaaaatttttcgagccggcgcttactgacaccgccggacccttgttcccgaaaagttttttgtttttcaaattggcgatcactcttgaaatgacacgcagacccggagcgacgtttgatgaattcattgcacaagcagtacgagcggaagcaacgcaatcggttgccagaaactcgtttaggtcaaaccaaacttttcaacggaaaatgcagaatttttcatattcatccaataatgtgctatcaaaaatccataccagtaattggtcccgaccagaaatgaacacgaacaggccaactgtgttgggacgacccacaattcaaataattgtttatcattgggtccgttctttgaccgaccaatattgatttgttcccctctcccatccaattccttccactcatttccccaattcattccttcccaatttgccttcgcattgttttccctcctatttttactccattcctccgaccaaatatttgtattttatttttccattttcttca

SEQ ID NO: 61357 - DNA, 322 bp, Heterodera glycines
  Genomic contig location: Contig_ID=SeqID_6390; Location=1..322; Strand=+
  SCN-specific regions: Sequence locations=1-185,207-322
tttggtagtgaagtgtacattttctctgggaattagttgtcccagtgcttagatggcattggttcgagtttataccttgttttttagacttagctcatcaagagctttcgaatgataccaaatttgtccgaatttgagcgttttaaaaggtcaggagccctctttttcattcaaattttcgagttttaaaccggttcaaaaaccggtttaaatgcttttccgagcccaattttaagcttttctatcgttctcagcacctaagaaaacctataaaagtgtttttgtgcgattttgagccgataccgtattcggcaattttacc

SEQ ID NO: 61358 - DNA, 1980 bp, Heterodera glycines
  Genomic contig location: Contig_ID=SeqID_6391; Location=1171..3150; Strand=+
  SCN-specific regions: Sequence locations=1-1105,1127-1154,1176 -1296,1322-1329,1351-1421,1444-1980
atgaacccgtaaggaataatttaacccatttaccctcagttatttttccctaatttagctggatatgcaacgacgttttgatggatattctcccattctttgaacgtgttgaactcggcctcaaaatggcacttctttcgccacgttttgatgggctggtggacaaacatttcgatggcaaatcagaattgacaatttggagaccaatcttaattcacaagtataatgtagcggtattatctgtgtctatcgacaataccaattctatgccatttccgttgcccaaccattcgctacacaacaaaatccgctttaacaaccttctgattaagtaaatgcgtaattatctgtgcgtaatatgttgttcccttttaaggtacattgaccattccgtcattgcatttctccgtgccaacaagcaaatttggaacaaaggcaccaatttgtggttgagtgttccttttgcacgagatgatcagccaatttggggtgtttttgtccgtgaaatttggccaatttttgcgccttatattcgccacttgaacatttacaatgatggcctccttttggacaatttgcgtcgtttcatttcgccgacaattctcactgatctcaacattaattcaatcagttccgcttttttgcccgatgcgactgatgattttgacgagccaaatgcaattccaactgctggccaaatgttgtcaaaatggttgcacattccgcgaaaagatggacaaccgaagcgattgtgttgcatgcttgcttctgctggtgatgtcaacaatttcaaagaggtatggcaatgtttttgttaatcaactgattttattgcatttacactccattttttaattgtttaggaatttctcaatgccaccacttccgttagctacaaaattaaatttattgttaatccaccgtcaccgcaaattgtgccatttgaattagctaacgaacggaccatggaaaagctgacactgatcaaaaaaagcggacatcctcaggaggaccgatggattatgaaacggtgccaaaatggggcgacggcgacgacggatcaatgggaagacggagatttggacgatttgaacactgtctcctttgtgtttttccctgtcaagggatgcattgggtgagcaacaaaaaaaaaatcattttattttgtttaaaaattgtgccgaatttttaggcctttgtctccacgtcgaaaatggtgtcaaattatgtgaaagtgatttatgcatttgagaaaaggtcgatcattttggattataatgataaataggagtgatttgatcattttaatgttcatttttattatcttcgtttaaatatattttattttatctcgtctcgacgcatcacttggaacacggacaactgagtaccaaggtcccggttttgaccgggacctggatattcccggcttttttcccggttttcccagccaaaaattcccggtttttcaacccaaaaagtcccggtcgtgcccaaatttcccggccccgctgcactctagtttttataaaatcatatatgtaggtggttttcgaggtcgctgcagattattcttaggggtgtatttttcgtttttattgcatttttcataacaaatttttattcacaagcaaaaatggttgaagtttttttcaattatataaaagactagaaaatagttgctaataactcgataagtagcttaacgaaaaataatatgttcttagtacgttttaagccatagaagagagctcaggaaaaaatagtgaaaaaaaaattggagccctaatgacaattgaaaatcaaaaaaactttaaatattttagtcggaaagaattacatatcaacaataatgagcaaagaacagcaacaaaattatgtatcagaccaatttgtccattcaataatatccaaatccgccgatcatttctcaattatttttcacttccgaacatttcgacggttgagagaatggcctaa

SEQ ID NO: 61359 - DNA, 1037 bp, Heterodera glycines
  Genomic contig location: Contig_ID=SeqID_31002; Location=124..1160; Strand=+
  SCN-specific regions: Sequence locations=1-123,330-360,451-535,588 -628,650-658,755-894,932-955,979-1037
ggttccacagggccaccaaaagcggtggggttgacgcattatcagctgatcaatgggtgccgaattgcggcacaagccattgacatcaagcgggaggtgaacgcgtttttcgaacaaattggcaaatatttaaataaatatttgaaaaaaaaattaattttttaaaataaattttttttttaataaattatttaaaaaagaataaaaagtgtaaaaatttattaaagaaatgttcaaatataatatagtttaaagttgtgaaatttatttcggtaaattttacattttaaaagataaaaatatttgtaaaaataattttttatttttatcgactcaatttgttcaataaattttaaaggctaattatttttttaaataccaaaatgattaattaattttcattaattatccattcatttattaacctaattttatttatataaattaatagactgttctttgctgtgcccttccactttttcggataccggtttttgcattggccattttcacgccatttttaattgaatcgcggtaataatttaaatttaaaaaaatttaatccatttatttttaaataattttaagttcaatttttcctgagccttctccattgcctcgtttactatttcaatccatcaacaaaaatcagttaaactattttaattaaattttatcatttattaatttattatttataaaaaaaataattaaaattacctaattatttttcaataatttaaatgttttaaatgcaacagatgctcaactttgttgacaaatgccacggcacttcgccttctgctcaaaacttcgccgcttacacaaggccaaaagttttctttgccaagcattgacaccgtcattttgttgggcgatagggtaaaattttgcatttttttattttaaaatttaaatataaaatattattgaggtatccaccgatttgttgacagccattgagtcggtgatgccaaatgcaaaaggaatagcggtaattttaattgaaattacttaaatttttaggtcaaaaaata

SEQ ID NO: 61360 - DNA, 193 bp, Heterodera glycines
  Genomic contig location: Contig_ID=SeqID_31004; Location=1015..1207; Strand=-
  SCN-specific regions: Sequence locations=1-193
tttataattaagtgagtttataaactaaattaaggttctttcaattatataatatggaccagcagcaaaaaattaaaacaaaaagaaacaaagttaagttagaacatgacggcgcactctatgttttcgaccaattgagcgcagattgacttaagaaattttggcgatgtgagtttcatggcccgtcagacaa

SEQ ID NO: 61361 - DNA, 235 bp, Heterodera glycines
  Genomic contig location: Contig_ID=SeqID_31004; Location=1249..1483; Strand=+
  SCN-specific regions: Sequence locations=1-235
aaataaatgtgagttatgaattctcttttatatgcaaccacgcgaaaacagccacgcgaaaacggccacgcgaaaacggccacgcgaaaacggccacgcgaaaacggccacgcgaaaatggccacgcgaaaacggccacgcgaaaacggccacgcgaaaacggccacgcgaaaacggccacgcgaaaatggccacgcgaaaacggccacgcgaaaacgtcctggcccgaaataaa

SEQ ID NO: 61362 - DNA, 361 bp, Heterodera glycines
  Genomic contig location: Contig_ID=SeqID_31005; Location=629..989; Strand=+
  SCN-specific regions: Sequence locations=1-61,83-147,169-361
atgcgcaaatatcaaattctgtgcaaatttactgatgtcatttggccccagggaatgtctgacgaggccaaaaagcaaatggccaaagattacggcgagaaaaactccgaaactgccaaaaatccttgttcaaaaccacggaggtgaacaaaaattacaccaaaattgatatgaaaaaatattaaattgaattaaattagtcagaatgggccgaatgtttgagatgcgcgtctatggccgagtgggaaaccctcacaccgcaaagccgcgcagggaacacacgtggagatacagcccctataaagcgcactacgattacgcggattactattccgatggatccgttgatttctattattaa

SEQ ID NO: 61363 - DNA, 185 bp, Heterodera glycines
  Genomic contig location: Contig_ID=SeqID_31005; Location=180..364; Strand=+
  SCN-specific regions: Sequence locations=1-185
cgcttttcgcttgaggcgcgtgcccaccaattgttggccattgctcggcttcactgttacgaattctcaaatttttatgccaattgcgtccccaatttgctcagcgaattcggacgagagaacggtttgggcgagcagagccgcacaaaacttgagaaagcattggcccattcgctgttcaaagt

SEQ ID NO: 61364 - DNA, 834 bp, Heterodera glycines
  Genomic contig location: Contig_ID=SeqID_31008; Location=264..1097; Strand=+
  SCN-specific regions: Sequence locations=1-149,205-370,395-478,500-834
atgtctgagaatgatttggcccgagacggagatgatggagttggcctggtgggtcgcgtacagcggctagtacaacacggtgtagggaaagtggggcaaattgtccgtcatgaacacccgctcctcacggtggaccttatgaaattttaaattgtagacattttaaaggatgctttttacaaaataaaaaatacaaatatattagaaaagtggtactttgaagtagattggtcccgtgtgatattttcagaatcatatcatcattcctgtacggtgtcgccaaagaaaatcgatatagagaaaaacataaaaatttttgaaaatctgcccacagataacacacaagtacccaaaattgttacaccgccagatttttattttattttttatttttcagtttcgtcatttgagtcctaatgactatgaaatttcagttccgtctcgaagattggcttatttttcggaattttcatcacaaaaagtcaaattttgccttaaaaagtgtaaataagttcctgtttgattacgcgtatttagccggtttcaaactaaaaatgcaaagttcgaaaaatttgaattttcgaacttttgttcgaattcatgtccggggttcgaaattggtcaaaatagatgccggatcgtgatcagcggccccaaaccctaggaaacatgctttcatgttttttgaaaacaaaaaaaacctttatttgatttgagtcatttatgcattattcgaattgcctttgattgttcagggcaaaacggtgacccaaaaagacaggcacaaactgctgcaggcgaaagagttgggaaaacggcaaaaatgagataaaa

SEQ ID NO: 61365 - DNA, 697 bp, Heterodera glycines
  Genomic contig location: Contig_ID=SeqID_31010; Location=281..977; Strand=+
  SCN-specific regions: Sequence locations=1-77,99-370,392-697
atgggttgtaaaatgtgtgttttgaccttatttctcgggaaccgtaagagctacgcttttgcggtaagcgaacaatttgtagagctcgtcgagaggaagggtgagaaaaaaatttcgtagctctacgacaaattcgaacaaagttataccccggcaaaggtcgaaaaaagccgattttttttgtgttttcgccttccggtttacaatccgtttacaattgcaaattcatccggaatgtccggaatttcacggattttgatgtttttcacgtgttttcttcacgtttacgtgtgtttttgacgtgcgttctttaaaccggttccggtttttcacgtgttttcttaacatttacgtgtattttcgacacgtttgcatgcgttttcaacatttcacgtgtgttttcgttacattaacgtgtgtttcaatatgttagcatgtgttttcgagtattttcacattttttgctttgtgttttactttgtgtttttgcatgcaatttttacagtttaaacaccagaacaattctgattgttccggaatgcttcaaaatagttctgataattctgttacagaccagaacagttctgaaaattctggtaagcgtccgaatagttctgataattctgaaacacaccagaacagttctgaaaattctggaaaacgtcagaattgttctgaaaatataaaattaaattaa

SEQ ID NO: 61366 - DNA, 4104 bp, Heterodera glycines
  Genomic contig location: Contig_ID=SeqID_6392; Location=751..4854; Strand=-
  SCN-specific regions: Sequence locations=1-447,470-1918,1940 -2262,2284-3126,3148-3320,3347-3453,3475-3708,3730-3741,3763 -3768,3792-3800,3840-3881,3927-3942,3982-4104
atggcaatgcgtgatgaacggactaaaaattttcgaatttgcgtccaatatagccgaaagcattcaatgctcatatggcgtgactcctgtctgattatgccgatagcgctcgccgaattaaaaaaaacttttaatcttgactgcgaggacaaaccgttcttcccttatgcatttaacagaagggagaacgacgccataagactggaaaatcttccggacgaaagcgagtatgagcccggcacgatgaaggctgacaagtacgaaaagtttaaaaaatggtacaacgacaacaaagagacgccattcttcttgcccgatgagctaagggcatactgtctgaatgacaccgaaattctgctcaaagctttggttaaattccgccagattttgatggatgaaattacggacggatttgacgtgctgccaattagctgtaccatagcgaggtttaaaacataaattgctcttttatcattttcattttacagcgcttgcatgaacatcttcaaggttcaatttatgcaagaagatcagattgcaatggtctccgagctgggctatgaacgaaacgacagagccagcgtcatcgcaatcaaatatttggactggcgggcaaaaagtgaaggcattgaaatccagcatgcgggcaatggacgcgaaaaacgatggaaacaattcaaacttgatggatggattgagagacaacaacggtgcatcgaagtgttaggatgttattggcatggatgtgagaaatgtttcaaacctaatgaggagctcgtcgatggaaagacgtgtcgtgagctgaatgaaacaacacatgaccgtcttcgccaacttcgcgagcctgacgataatgggatctgtttacaagttgaagaagtctgggagtgtgaaataaatgaccagctaaagaaaaacgacgagatgaaagagttttttgatgacttggggaatgaacgtggacctctggaccctagacttgcatattgcggcagacgaactggcccattgcgactttttgctgaaacagcagaggacgagaagatctccgtcttcgacattgtctcactatatccatgggtcaactatgacaccgattatcccgttggcgttcctaccgttgttcatcctagcgcggaggagatgattgtcaattggacaaaacctgagcatttaagctaccgaggtctttaccgtgttcgcgtcatccctcctcgtggactacaaataccagtacttccgatgaagattgacgaaagattactattcagctgctgccatcgatgtgcagctttgttccgtaaaagtgtgacacggtgttcgcacaagtgcaaccacacagatcagcagagggccttcactggcaacttcactcacattgaactcgaaaaagcgttagagatgggttatattgtcgaccgattttggagggcctggcattacgcagaatggagtgatcagattttcaaaggatatgtgcggcaatttatcaggctcaaggtagtataattaaaaaaaagtttttatccaactttttttcataggtggaatcaagcggctttccggaggggatcgaaacattggaacaaaaacaggagtacatcgatgaatatcgacgaatttatggagttgacttggattttgggcatatcaaaaaaaatccaggactccgattcatcgcggagtgcaacgagagctgtaagccatgcgactaccatttcgtcgaaagtatggacggagagcacacgggatcaacggattgggcaggcggaacatggatatccaaaagcaaggaacaggcgctaacgtttagcaaagaggcgaaaatggaaacagcatgcaacggaaaaccaattcgcttgtcggaccaatcgtttggaatcctggaggatgagtacctgaagatcgtcaacgatcgtggattgggaaaaagagccatccaggaggagcaactcgcagtacaattaactgcaggacaactcgccacaagccgatcaatcgcgcagcttttttccaaggaatgccgcagaagttccagaggaggaaatccgaccattcaggccagacgacttttacgacgcaaggatgttatggccaggtggctaaacgaagacacgatgcaaatcttctcgtgcgctgagttttcaatgcaaaatgtggactatcaggcagtcaacaactgttaccgctacattccggtccaaatccgcattgacaagaagacgctcaacgcattcctggatccggagcttcacatcctcacagcgtcatcaccattcgcagattgtggaaatttccgctaccattatctgcaactgagccagagcaattggatcaaaatcgacacacgcaccgctacgatccagaaaatcgactccagcagcatctctgagatccacgaagcctctggagacaaatcgttgttggaaatcacgccgctagtttttcatcgatggacgatcgacaacgaaacaggcgaagggctatttgcgcacttggatgaatggctgcgtttggatcaatggaagtcgaaggagaaggagcacaaaacggcgcgtgcgctcacactgggagctctcccgaacggagtgattggcctcaccgaagaatggtttatggaaaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagctactcgaggcacacggcgagcaccggcaatttcaaggattgaagcaattgagctggtaccgcctccaatgccccaggaaatgagagcgaatgaaacggcaagttcgcaacaagaggaccccgagccgtccccgctggtgatggatctgaaacgacaaatggtcgcgttccgctcaaaacgacgttttcaaagtcgtgggaatgtcgcgactgaacgtcagccgcgaatgtccgtcgagcggacaaatggggaggacggggaggaatgaacgaagtagcgaacgaggagtgattgatggatgaaatgatgagaaaattagggcaaacgggaaacgatgaaggaaagaaaggggtgaagggaggggtcggctgacggcgggcacgtgaattaggggaaagaaagcgataaaaagcggatgtggcgccttacccgcgtgaaggtcgcccgaggcagcgcaaaaacgccgatcggaccatcggcggagcgacggcctcctctttatatttctcgcacatttattgtaagtgtagggtttaattacccaagtttgagtttgagataaatttgcggagtatttttggtgcgaatttttgggcggcaaattgggcaattggcgacggctaaatcggaacaaacggcgcagaccctcccccaactgcgtcaattaattaatttaaattgaaggctttccggcaacattatgcgccacatttttattgtaaagcatagatggaaaatgggcagaagtcgacccccctcaccttcgcccgcaaaatgccccaaaataggtggggggggggggggtcggaagcggggaaagaggaaaattgaacaaacttttttagcttaattcattaatagcaaaagttttttaattgtcgccaaattgtaaaaaaaattaatatttttgggctagcttttttgaaaatttaaaatatcaatccttagggaataatttctgttttattttaattatttcataattggccaaatatgcatttaaatgcactaaaaattttaatcaaaaagaaaattaaaaaaaaaattactgtttataagcccctttcttcaaggaacatgcccataaaacatatatattttaattatttttgattgttttttaaattaatattttctatccagtatatttaatctaatatgaaaattttcatattaaaatacttacataaaattattacaaaaatgtatagcatgaagttcattagcatttttagcagaaaaaaataataatctaaaaattgggttttttttataatcaacaagtggacaattttggttgaagttccaataaa

SEQ ID NO: 61367 - DNA, 167 bp, Heterodera glycines
  Genomic contig location: Contig_ID=SeqID_6392; Location=1696..1862; Strand=+
  SCN-specific regions: Sequence locations=1-12,34-167
ccgacccctcccttcacccctttctttccttcatcgtttcccgtttgccctaattttctcatcatttcatccatcaatcactcctcgttcgctacttcgttcattcctccccgtcctccccatttgtccgctcgacggacattcgcggctgacgttcagtcgcgaca

SEQ ID NO: 61368 - DNA, 56 bp, Heterodera glycines; identical to SEQ ID NO: 57643
  Genomic contig location: Contig_ID=SeqID_31012; Location=227..282; Strand=+
  SCN-specific regions: Sequence locations=1-56

SEQ ID NO: 61369 - DNA, 933 bp, Heterodera glycines
  Genomic contig location: Contig_ID=SeqID_31013; Location=1..933; Strand=-
  SCN-specific regions: Sequence locations=1-331,354-394,417-711,769-933
ctggttcgctgcgccaatgtgggatgcacgctcgtggggcgacctaacggctgtgctggcgtctgtgcgtcgttgagcggttgttgtgccaggcacataacacactgactggggatggtggttccgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttaacggggctccagagaaggtgcaagacctgtccaactggcggtgccta

SEQ ID NO: 61370 - DNA, 951 bp, Heterodera glycines
  Genomic contig location: Contig_ID=SeqID_31015; Location=484..1434; Strand=+
  SCN-specific regions: Sequence locations=1-19,41-147,176-325,354 -397,437-951
  Gene Ontology: Mol. function=serine esterase activity; Cellular component=synaptic junction
ccccattttcttcacccaggaaaacattgccttcttcggcggtgaccccgaaaatgtgacactttttggccaaagtgcgggcgccgcgtgcattgacttgctgagcctgtcgcctctggccaagggtgtgtatgtacaatatttgtcataaaatttttaaaaataaaaattttttgagttttccttttcaggccttttcaaacgtatcattctgatgggcggaaacgcgtgcaccgattggtcaatgacgacgccggaacgcactcaacaggcggcgatcagaatggcacggaaagggggatggaagggtcggattttaaaggccaataaaattttaaatttattaaaaatttgtttttccattttcccggctttacagttaaattttattttttttaaaaaaaaaaacttaaaaaaaaaagaaaaagtaaaaaaacaccctctaaattcttagttttccagtgaaaaattgtaaaaaaaaaaattagaaaaaacttactttttgaagaaattttaattttttacaatagaaaaacattcattactaaaagatttcgacatttttttaaaatttctaccaataattatcgatttaaacaaaaatacacaccaaaaatgaatgccattttataccccacactctgattgattgaacactcaggtgccgacactgatctggactcattgctcacatttatgcgctcagttcccgcctacaaaatttcggcaccgctcatcggcaaatcggcgttcaaccggcacaaaaaagtgtgcaatttacgggaaaaattaaaaaaagatttttccattgattggatttatagggactcgacttttgcccagtgatcgacggggagctgatcaccaaatcgcctgagcaaatgcggcgtgagcttgactggcccttggaagtgattgttggcggcacagagtccgaggcattgcttttcg

SEQ ID NO: 61371 - DNA, 478 bp, Heterodera glycines
  misc_feature (97)..(97): n is a, c, g, or t
  Genomic contig location: Contig_ID=SeqID_31016; Location=60..537; Strand=+
  SCN-specific regions: Sequence locations=1-3,28-161,195-335,362-478
atgaaaaaaataattaaaaaaaataatgctggtgtggtaagtgtgaagaactgtgttcctccaggcaaaaaattctaagaaaatttataagcattgnaagagttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatga

SEQ ID NO: 61372 - DNA, 629 bp, Heterodera glycines
  Genomic contig location: Contig_ID=SeqID_31016; Location=431..1059; Strand=-
  SCN-specific regions: Sequence locations=1-334,371-498,524-629
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaat

SEQ ID NO: 61373 - DNA, 206 bp, Heterodera glycines
  Genomic contig location: Contig_ID=SeqID_31016; Location=1215..1420; Strand=+
  SCN-specific regions: Sequence locations=1-129,163-206
tgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaa

SEQ ID NO: 61374 - DNA, 741 bp, Heterodera glycines
  Genomic contig location: Contig_ID=SeqID_31018; Location=527..1267; Strand=+
  SCN-specific regions: Sequence locations=1-165,187-214,271-332,428 -506,548-741
atgatcgcttataatttaagttcgaagacaaaacgccaatcaggtttacaccattttgattttttcttagatcacggtcaatatggacgatcaaaaaatggagcagcagcattgcgcgtcacatgattaatgaggctaaatgaagggattcattaacataattaaatttgaaaaataaatgaattattcccaaaaatgtagagaaattatactgaaatataataaaacaaataaaaaatcactttaaaatataataaaacaaataaaattcacttttgaacggggataataattaataataacttttccattctttaaatttagaatttgtcaaaatttattatttactattatttttctaaagaattttacaaatataaataatgaaatgatttctttgaatttacaataaaaaatattttaaattgttttgtaatctattttcgtcataatttgctcaaatatgattaaatattcatttcattgaatatatcttaatttaatgcaaaatttcaattaaaaaaaatagttaaaatttttttaaaaagtaatttccagacaaaaatagtagagaagttttaggtttcggaaaattacaaatttttctgaactgtttcgagtatggaaaaagttagcaattatatcatctttgcagaagaacaagattgcgtgaatatcaggcacatccaactacgtcggtcaatctcttgcatctttagaattattcctcaagagttttga

SEQ ID NO: 61375 - DNA, 593 bp, Heterodera glycines
  Genomic contig location: Contig_ID=SeqID_31019; Location=116..708; Strand=-
  SCN-specific regions: Sequence locations=1-4,26-246,278-593
atgcttttgttcgaattcgggttcgttgagttcgaaacttgtcgaaattgtgtgagattcatgatccaagtgtaagcattttaaggatttttccatcaaatgtttgcgttacatttgtcaaaatgcggctgacttgttcggatcagatgaatttttgcaaattgatcagaaaatattgtgcaatcttctcgagagtgatcgtttgttactcagcgatgaatttgaaatttggaaatctgtaatttcaatttaattttttattttcattttttaatttcgatatttttttctatttaggcactccgttgggccgatgaaaaatgtcgtcagaatggcattgaatgctcctcgggaaatcgtcgttcagtacttggaccggcactgttcaaaattcgttttccaaatatccatgaggaggattttgcaaaatgcgtcggtaaaaattttgaaatcggaaattaaatagaaattgttttggtcgataaggtattttacctttaatgcttgaatttcatacatggacaaggagggtcagaaatttttcaaatttatgtgaaattggccgaaaaaaactgatgcctaagaataataaa

SEQ ID NO: 61376 - DNA, 478 bp, Heterodera glycines
  Genomic contig location: Contig_ID=SeqID_31020; Location=563..1040; Strand=+
  SCN-specific regions: Sequence locations=1-135,180-204,238-241,263-478
atgttaaaacaggaatttttgtccgtggccttgtcaggatccacatcagaatcaggatatgatccgatccaggtaaatttgatcaggataaccctgaccctgattattatttttcacaattttttttggcattacttaaaataaattatgttaaaaaacaataattcaaattattaatagcacatgagcagaaacaaagcaaattcattcaaaattaaacaaaatatttcaccctttgaacatttaaacgaacattttaatttagggtttcgacaaaatatgcataattttgcttaaaaataacaaaatttcatattcttcggaagatagcccaggtttttctctattagactgcaaaaaaatgccagtgattagagctcggaggcatcgggatcaagtagggattttcctgagatctggtcccaatcacgtcttttttaaacggatcaggatgccgaccaaataatatatttaaaca

SEQ ID NO: 61377 - DNA, 902 bp, Heterodera glycines
  Genomic contig location: Contig_ID=SeqID_31021; Location=10..911; Strand=-
  SCN-specific regions: Sequence locations=1-14,36-902
  Gene Ontology: Mol. function=pre-mRNA splicing factor activity; Cellular component=nucleus; Biological process=RNA processing
atggaggggcttgagaagattgaaaagtcagaagacctttggctggaagcgattcgtcttcatcctcccaacgtgggaaaaaacattggtactataaattacggtaaacaatttaaaaatattctttttgaattcagttgcgaatgctgtacgggctttgccccattctgttaaaatttggttaaaagctgctgatttggaggccgatcttaaagggcggaagattgtgttgctcaaagcactagaaaacaacccaagttcggttcgattatggaaggccgccgttgacctacaagggccggaagatgcccgatcactgctcacgcgggcggtcgaatgctgcccattgagcacggaactttggctggcattggcaaaacttgaaacctacgaaaatgctcaaaaagtttctttattgtaatgatcaaacataaagtaagctttaggttttgaacaaagcacgtgaaaatattcctaccgaacgaatgatttggatcgcagctgccaggttggaagagactcgaggtcaagcaaagcgtgtgccacttttgattgatcgtgcgcttatttcactgcgctcggcgcaagtcgaaatcaacaaaaaacaatggcttgaagacgccgtcgaatgtgaacgggcggattgtcctctgaccagcaaagcaatcatgtaattaacgaaatccaattgtcttcagaagcattagctttttattctcttaagccaaaatgtgcttgcggttggtgtggaggacgaagacagaaagcacacgtggatggaagacggagaatggtttatcacccagggggcactgcaatgtgcacgtgccgtattctcattttacgctgaacacatttcccgaaaaagaaaggaatctggacgaaagcagcgttctttgaac

SEQ ID NO: 61378 - DNA, 1300 bp, Heterodera glycines
  Genomic contig location: Contig_ID=SeqID_791; Location=210..1509; Strand=+
  SCN-specific regions: Sequence locations=1-141,163-452,483-634,666 -777,799-1013,1035-1300
atggacgaggacaaattggcactgaaaaatggacaaaaggacgacacggggggaagggaaagcgaaaacagtgacaaacagggggagcaatttgcagaagacaatttcgacacgaatccgttgggtggggctttttatttattttcatttgcactttaaatcattcaaaaatttaaaaagcaaaaagcgaccccctaattaaaatagttcaaatgaaaagaaattaaagtcatttgaaatcaaaatataaaaaatgcccaaatacatctaattttgcaatttcattgttttttagttgagaaaggcgttatgcaaaagtcgctcattgacaatgccttcgatgtgttcgaatgcgcctcccaaaatttgaattgtcttttggccaatgccgagatgagtgccatcaaattcgaccagttcatcaaagttgttgagttggcggaaaggtcccatattttatcatttttattttgaatttgtaaatttactatcaataattattcaattaattcctcctcatttccatttgctcagattccggaccttcggtcgccaatattttggcaatccgtgccaactcatccgacacactttgatggaccaatcgcgcaaatatattgagcgataccatgccgagaaaatggaggaggttaaaatgtttttggagagcgaaacgttcactctttgcccggtgcccgtccaattcacactgtttgaccttccggtgagaaagaattggtcgtttttaagtcaatgattgacacttttgacggggttttccctaggttttcccaatggattgcattttaaaaaatgcttttcaaatttaggaatttttcttcctcaaagagttgcaacagaaacagcaaaatgatgaacaaacggaggaagagactgaacagaactcagtggagacatttgtccacggcaaatccatccgtttttcggtgtttcgacattcttcggaaatggacacggaaatattcccttattcacctgaacaattcgacgaaagtgtgaggagaaaggcacaaaaaatggacatgaaaaacttttttgcgaagagaaagcattaaaaaattattttgaaataaacaaaaaatatggaaaaacaaattcagccccgacgaattggtgacagacgacggatgatctgcaaaaatggcgaagtctctcagtgttcgtcgtccgatgacggcactcgaaattccattgaagacgaatcactggcgccgtcgccgcacaacgcaatgccaaatttatgcaattccgcgctgaatcttttacgtgtgattggcaa

SEQ ID NO: 61379 - DNA, 393 bp, Heterodera glycines
  Genomic contig location: Contig_ID=SeqID_792; Location=151..543; Strand=+
  SCN-specific regions: Sequence locations=1-393
tcccttgcggcggtgttcgatttgggcgacgcttcgtttggctgtgtggcggccaaaattatactctttcagtcaattctgaagcaaatttcggcgaccgattggacaaccggggaaatccattcgcaacattcgccttatgtggacacaattgtccaagtgaatggagaaaaagaggggggggggggggtgaatattggccaaaagcaaaggaaaaaatggccaaaataacaattatcagccttttccataaggttttactggtgttcctttttaggaatgttcgcaattcaaacaaaagttcgtccgccttttcccctacgttcacatttccgacgaattgtacgccgccatttggtccatgcttttgctgtgcattttccgtattttggt

SEQ ID NO: 61380 - DNA, 608 bp, Heterodera glycines
  Genomic contig location: Contig_ID=SeqID_792; Location=624..1231; Strand=+
  SCN-specific regions: Sequence locations=1-244,267-307,329-447,469 -469,491-608
agtgcagcattgagggaagagcactgcaactgttggatgtcgagcaattatgtggggaattggaggagatcaccggactgaggcaatttcacaatcatccctttattttattgtaaattcccgaaattaggcctcttccccaccgaccgttcgtcgaaaatttcgtcaaagcattttatttgccgtttggagagcttcaaaattggatggtgaatcatacagtgagtggagaaaaaatagggattttaattgggattcttaacaaattcaaggagtacagcctaagccaaacgagcgcaattttaaatgcagcggctggggcggcggcgatcagctcgtcctccgtcgctacgaactccagaaaagcgaccatgtcgcgcatcatggccaatctgttggacgcgggcggaattggggaaggcggcaactctcttttccaatgaataattccaattttttgtttaattttacgttatttccatccgttcatcttttgaatttataattacgcaaaagaacactcacattttgtaattctaacaatcccagttttgtttgtatatattgaatgttgttaattgtgataaaaaaaaaggcttggatttaaa

SEQ ID NO: 61381 - DNA, 675 bp, Heterodera glycines
  Genomic contig location: Contig_ID=SeqID_793; Location=6212..6886; Strand=+
  SCN-specific regions: Sequence locations=1-64,92-119,141-259,281 -340,362-518,543-675
aataagctgttcgtcaacggacacttcaccaaggacctgagcgaggatgagcaggaggaattgaagcagtaccaggagcagctggatcagttcaaggcatgaacaactgggagggagtggaaattttcataagaaaaatactgaaatttccaaaaaaaaattcagtccgaagtcaagacctacttggaggagcgccagaaacagttccgcaaccaggtggcgcgccagggcggcgccgaggccaaggagggcggaactcagctgaagaagccggagccgccaaagaaggtgggcctcgttgcctagcgatggtgttcgagaatgccgagaatctcgacttatgaaaattttactctgttttttggacctgatcccggggcttggccgatttttttgaaattttggtccacattttcagcccagcttctgctcggacaaagccaccacacagtacgtgttcgacggctgcagcgttcaaggcgacaacgtgtacattggggatacttttgtacggaattttcaaaattttttaaaatttttcacccccccccctcataggtgcgcaagctgagcccggacgagcagaaggaattggcccagtttgaccagaaattcaccgcctaccagaaggcagtgacggccggcttccgcaaggtggaaaattgttttggcaaa

SEQ ID NO: 61382 - DNA, 2101 bp, Heterodera glycines
  Genomic contig location: Contig_ID=SeqID_793; Location=2805..4905; Strand=-
  SCN-specific regions: Sequence locations=1-600,623-990,1013-1388,1411- 1821,1844-1994,2016-2101
atgcccccaaaacgtaaaaatatctatttggagagctacgaaaaggaattccggcacataaagaaaagccgaaaaggcgaagaatttgccctctgtgtcgtctgcaacgatgatatcaatctgctgtccatcgggaaaagtgcaatttcgttgcaccaaaaaactggaaaacatcagaaagcggcaaaagcagcaaacagatcaattccattgcaggaatttatgccaaacacttccgccccatcaactgaagaccgtaaagttctggcggccgaaggttaacaggcttttttctgatcaaaattttataattaataggcactatcgcttatcacactgcacaacattgccaatcttttcgctcggtggattgtttgtcctcggacggcttgttgcgcacaatttttcccgattcaaatattgcgaaaaaaataagttgcggacaaacaaaaacggcaaaaattctaactggtatcgcataaatacaaaaacttttttcaattattgttaaggcgtgttggctccttattccgtgaaaaaaatcgttgaacgactggctgacaaaccattctctttatcgatcgatgcgtcaaactttgggaatcaaaaactttttcctcttgttgttcggttttttacaaaagacaatggtattgaaacccgtttgattgacttggagtcacttccgggcgaaacatcatttgaagtgagatcaattttttgcatttttaattgcaataaaaggtgcaccaatggatcaacaaaataatggaaaaatacgatttgaatgtatcaaatttaacggcactttcggcggacaacacaaaagccaatttcggtggagaagagcgcgcaggagaaaacaatttatttttccgtctaagacaacaaaatgaacgattgattggtgtggggtgtgtgtgccatgttttgcacaatgcggcgaaaaaggcaacggacaatttgagaattgaaggaagagcaatggacattgaggcagtgatttttaaaatggcagggcattttaaaaattcaaccaaacgaattgaggagctaaaaggattttgtgaggaattggaggtgcggaataaggaatgataaattctaagctataaatttaggttgagtttgaacgcttgaatcgtcatgggccaacaagatggacatcgatgcataatgtgttgggcaaaatgattcggctggaatctgtgttaatcgcctacttttcaaaaccagaaaagtgtccggcacttctttatgacttttttttcgttttttctgaacaatcgtttgcgatcattcattttttacaccacattcttggcttatttaataagacaattgacttttttcaggttgttttacaaatcttaaatgaaaaaattttataaatttagaaagaaaaagtcattttgcccgaacttttgctggaaatggacaaatttagagggaaaattgaacaacgaaaaagtgaaaggttttatggtgcagatttggcaatgggaaaagtcgatgagagcacacgcgaagcgttggaggaacaatttcaagtaaaaattgtcggttgcatattttcaaaaattttcagtcgttttacacttcggttctggcgtatttggacaaatggcatcgcattgaccgatttcctgaaaagttgcaatgggttgcgctggcataccgcaaaattccccacgacgatgcattggctctggctcgacaaattgcgcccgagttaacaaatgatttgtttgacgatgttagcgaagcaaaccaaatattgaattctttcccaaatgatgaatttcaaaaattaacccccgaacagaagtggaagaagctgtttgaagcagatttgcctaatctgctcaagctggtcagcgtcgtactttccgtgcctgtctcgaatgcatttgtggagagggtattctctttgtgcggatcgcaatggactgataaacgaaatcttttgcaagtcgaaacagtcaaggcgttggtccaaaccaaagtcaattatgatctttcttgcccacaaatgtaccaaatgctcatttccaatcacaaattgtcagagaaaataggcggatgggaaaaatacttttga

SEQ ID NO: 61383 - DNA, 3172 bp, Heterodera glycines
  Genomic contig location: Contig_ID=SeqID_794; Location=278..3449; Strand=+
  SCN-specific regions: Sequence locations=1-48,70-227,250-466,494 -578,783-789,814-963,1018-1104,1225-1281,1304-1802,1835-2135,2234 -2287,2332-3097,3119-3172
atgactatatcagcttggaaattttcaaatatttcgatcactagaaaatttcaaaaaatcctcctttgtataattttatttgtaaatgtttcacgtttaggcactgatcgtgaggtgcgcagcagttcgtccggacgcattttccaggtgcgtggaagcggtgccacgtcgctggtgcagtcgcctaccgcgcgggtaggcggtggcgcatgcaccatgctgacgcgccttcaacaacaacagcagcaaatgcgtcgttgcgtcggaggcgcgaccagtgcagcatcacctacgacagttgcaactgctgcagtgcgacaggattccgcggacgaggcaagcatgggcagtgtcagtacggtggcgagtggcggcgcggtggtgggtggtgtcgcaacgcaacacacaccgcaaatgcagcgtcgcgctgcgaccattgcgtcacagcagcaccaggtgggtgttgaaatttaaaaaattaaatttaaatttagagtttcatcaataaattccattaggtatatttggacactaattgatttttttaaatggattaattagttaaaagtgtttcgaagtaatttttttaataatttttagtaaaaaatcaaaatttcgttcatttttaattttttttttatattttaattaatgaaaaattaaaaagtgctgcaacaaaaaagatttcatttaaataaataaatattatttttaaatattttctaaaaatttaaaaaaaaaaatttaactattttttcaattttatttgaaatttaatttttctccttttatttctgcagcagcagcaacgcttcaaaatgcgtaggcccaaatccactggtcaaatcatcatccaacagcagcaacaaatggtggaggcacagaatcatcatcagaggaaaaaaatgtccgaaaatcatcagcaacacgctgttgtgatgcaggtgggaaaattgaattttcaaatatttatttatttttttaatttaaaatttatttttattaaattttttatttccggtttttggatacaaatgattgttccaaaaattcttcttttttttgtcaacaaagagggtaatatttttgattgaaaaattctcgaaaaaattttaaaattaaaaattgatttttcggtcttttttttttgttaattaaatctgttaattttttacttaattaatatttaaattttctttttctttttttgcttttttaaatattgcggttttgtaaaatgaaaaatttttactctgatgaaataaaacggagctcccgcggattttcgggctcgtggattacgaatttgacatacaaatctaccaattttgaattcctttacgaaatttgaatcaaaagtctaaaattccaaatatttatttttgaccatttgttcgaattcgggttcaaattgggatttttcaacacccttattcaattaacgatccctgaaaacccctttttcatgatataatatcactaccagggatggggaattccgaggcaccaaaaattttcggaagtcggaattccgaggcccaaaaatttttcttaagtctgaagcggaattccgaccccaaaaaatcggaacttggaagtcgaaattccgtaccatccctgatctctactatacatatggcaaataattaatttaatcaattaattatctttcaggatcgcggttcggttggcacggcaggcaccggacaatccggcggttccggctcgctatcgttggcaccggtcattgctggcgccggtgccgtacgtggcggcgcacacgcgcagcacaaccaccaatgcaacagcaacaacaataacaataatagcaacagcgtgtccgcgtacaacacggtgaacaccgcgtacgacccgtcgtacaccagcgcaaccgtttactcggactcaatcacgtgcctgcacgcgcctggcgtcctgcagtcgggtggcggcgtcattggggctggcggtggggcgagcagttgcgcggacggcatcacggaccagcggcgcgggtgagtggtgacggatgagtggattaagcaatcaattagattgataggcttaatggctttattggtttaattagatgcttgtgcgtttcttgaaatttgccattccccctcacttccgacatttttttaaaatcaattttataaaaagaattaaccaaaaattttatttttttttgaattttttaaaaaataagtttttttttttaaatttttaaaatcttttcttgaaattcttgttctcgaacaacatttaaacattcttgaaatttctgttaaaattatataaaaactttgaaaaatatagaaattaattaaagaaaagtttttgtttattcaaaaccctacaggcgaatttctttaaattttcaatatgaagtcaatgtttttttttcaaagttatttcattaaaaaaacagatgttaattaaaacaaagaaaaaaaattaaatttagaaaagcacaaaaaatttatcaaagcgaaatgaataaaaagaatcccaaaaaattagggtagagtcaactccgtctggccaactccgtctcagcaatgttcaaaaagctataacttttttctttgttggccaaacttcacaatcatggtatcattcgaaagccctagatgtttagaagatatttataagctatttctcagtgattaatcggctctcaaaaaaacttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccgtagagcggccatcggtaattgtaaaaaaaatcggtaccggtaatttttgcagttgataaaccggtactttttggctgggaaaaccgggataaaaccgggacttttccctggtcaaaaccaggatttaggtactcagttgtacgcttttttcaacaccagatgccggtcccgtacaactctaattttgaccaattccaaaatactaaaaacaaattataaattaaatatgggattatagttacttttacatattggtggatcaatcattatttttta

SEQ ID NO: 61384 - DNA, 727 bp, Heterodera glycines
  misc_feature (666)..(666): n is a, c, g, or t
  Genomic contig location: Contig_ID=SeqID_794; Location=3534..4260; Strand=-
  SCN-specific regions: Sequence locations=1-500,522-583,711-727
atgattgatgatgatatcagtgagatggagttagtaaatgaggaggaattgaattacgaattaaaagaggagaaaagtgaagaaaatggagaaaaattaatgataaaaacgaaaaaacaaaaaataaaacatttcaatgatccgttggaaattaccaaattacgtatagaatttgaagaaaaaatggaaaaattgtgccaaaaaataaaagaaaatgccaaaaaagaaaaggcaaaattggaaaaagcattgaaaaatgcagcaaacaatgaagatgaaaaacgccatttgaacaacgaatatgatgacaaatttggcactttcaattcatcgccattttctcaaaaaatttctggcactttttaaaaagttaccgagaggtttttagggtcgttgaccacgaatctggcatctattttgaccatctcagacttcctaactgatttttgttcgagttaggcttagattaaaaatcgctaactttttaaatagcgccaaatttccctttttgtgtcaaaaatttcttattttttccttgttcggttttctttcttcacctatatatcacacaatgcttctgtcttttttctttccattttcatttttttttaatttttgctttgataaatttttgagaaagtttatgctttttgtaaatataaattntcttttcatttttatgttttaatttaaaatcttttttttttattcaaataagttaaataaa

SEQ ID NO: 61385 - DNA, 1502 bp, Heterodera glycines
  Genomic contig location: Contig_ID=SeqID_6393; Location=718..2219; Strand=-
  SCN-specific regions: Sequence locations=1-689,764-887,933-1059,1116 -1398,1452-1465,1490-1502
atgttcatggctttgccggacgatttgctctcgcggtttcccgtccccgccgcatttcgcaaattgtcgccggcacagcaaagacgcgtccaccaaatttattacagtaagcgcattggttttgacgagaaaatgcgcgaattggggcgactgatcaatcagttgtcaactgatcagcagcggcgactgatgccaatccgtcccgtggaagaagaacaaaaaccgaagaaggtgagaaacgaaaaaggcactgattagagaaaaaaaacaaagaccaatgctaattaatgcctgtttttctaattagcatatgccaactttggtcgaatttgaagtgcctgttctgttacaattcagcggacatttggtacactcggtggtctaagagacaaaatgcttaccaatataaattcataccaggaaacgcatctgctcaaagcttatttggactctaagaattttgagtttttggaatggcttattggcacgaaaggcatcgatgaaacggtcggaccattgaataatttaaatttaacacttacaggaattttctttatttgcaaaaaatataaacgcttttttaaaattttacatgtctattttcgcctttttttctccttttttgtcagtttttcctcactgttctcgtccatttttgccattttcctcccttttttcattttggcaagaatttttgaaaaattattttttttaaatttctctaaaataatttttagttttaacatttacttttttataatttcagagtcgcgcccgattggtcggtgttttcttgaaacagtcttatcagttggacccggacaattttccattgccactcaatggggacagtcacgaaattgaggatgacataagaaatttaggggtaataataaaaaatgaatttagaaaatttattttaaaaatatttacaggttcgacttatgtttggacaaagtccctttgatcggacggacatttttaaagtgaaattggacaaattaaagcacgcattttcaaaaagaacacaaaaagaagacaaacagacgaaaggtgaagaaaatatacaattttaaatttattttaatatttattttatttttttaatatttattggattaagccaccaatgaagcggcattagactgcgtcgaagaagcagaaaatgcatggattgaccggctggaaatgttccctgaggcaaaactgttcgaattccggcacaatgataacagtgctttgacggcacaaaagtcaggctcattgtttggcaatttggagaaattgtttgctgctatcaatggcactgttcacatggattggaattccaacgatttttcatcatgaaaactttttaaaaattcttaaaaaaacaacacatgctgttgtattctccacattaaaaattaaattttattttttttataaattatttttttaaatatttttatcgattccaattgacaaaaaaaaataataatttaaattagacaattaataaa

SEQ ID NO: 61386 - DNA, 1337 bp, Heterodera glycines
  Genomic contig location: Contig_ID=SeqID_6393; Location=2395..3731; Strand=+
  SCN-specific regions: Sequence locations=1-116,148-190,213-771,794 -1113,1145-1179,1201-1337
atgttttgtccatgtaaattgctttgaatcggttgaatatttctggtggcatcgcttttcgatattcactgagtgtcgtgtgaagtgaacgtttacttgtgacaacaataatttgcaaaaataataatagtaatattttaaataattgcatttttatgaatgggtgggaaattgacactaattggcccattttctttataaatggtcaaaaatcggaataaatattcattgacaaaattcaatgtttgcacaaatgaccacaaaaatggttaatggtcgaaatacagccaaccaagctgcataaaattgctgctatataaaaaaaagtggacaaaaatgcgaaagtaaaaacattttatgataaaatgtttttaattcatataacaaattttgttatcactttaggggacgtactaacaatgtaaaaatgaagtgcagtgaacagaaaatcccgtctttttaagtattcggcaaatttggccaaatggacaatattttatcggctttcgctgatcagcaccgaaacggaaggtggccgagcacaatgggtggggaaaggttgtggagaagcggcaattattggaccaaaggcagataattcataccatttataccatatgggaaggaagcagacactgctacggtattccccttacagtaacgctgtcaacgcaaagagaacccagcgattgttggcaacaaaggttggttggcactttgcaatccattttccatcaactgagtttgtgccatttccagtttaaagcctttcaccgccaaggagctcctgaagatgaacggaggtcagttttccgagctgttgagcgagtctcggcacatgggctgggctcagctgcacaacaccgacttggccgcattttcggcactcacttttctcatcgttctccgatattttgccaaatttacattggctttaatattttgtccaaaaaaggcttttgaaaaattacaaaagtaaaaaggaaaagccgtgttgcgacttttgcgccgcggacatttgcgcctcaacacttgcgccgaccaacaaaaatggacatttgcgcctcaacacttgcgccgaccaacaaaaatggacatttgcgccgctcagtcaaatatatatttaaatatttttactaattttcaacgaattttattccaattaccatgccaacaacaagaagcatttaaaagaaatacaaaaaaataatcacaacgatagacacccaatttttgttttgttttttgtacatcagcagcaaaggcaaatttgttgccaaggaaacaaaaaatgaagatttaataagtcaaattaatgtatgtaggttttagtttaa

SEQ ID NO: 61387 - DNA, 1213 bp, Heterodera glycines
  Genomic contig location: Contig_ID=SeqID_6395; Location=845..2057; Strand=+
  SCN-specific regions: Sequence locations=1-118,142-156,184-360,383 -578,639-755,777-902,943-1213
atgtcccaattaaacatttggtgctcaatggctgctgttttttatcgacagataaattggattacttcttttcttcttacggatcgatcagtgaaaggaaaaagtgcgtataaatacgaattaaaaataaatttaaaaaatggagggttaggaacagaaaaagtttttaaaataaatataaaacataattctcattttatgttcgaacattaaaaggtatgggctcgaatgccttgccagtttcggagtgatcgtgtcacatttaaagccgctaaatttgtccgaacttgagctgagcgcattgaatggaattcagctatggaattgcagtaagtccgcaaaaattggcattttgccaactttaatttaatattgttttttactttgtatttttgcgacaatattatccttcttctattagttgagcgttttgtgccattgtctgatcagcaaaaagcgcatcggaatgcattttttgttgaattaaacgcaatggccgcacaaaacaacggcaaaatagccgagattggcatcagattcggcttattgatgaaccttttgttcgacactttggtgacaaattaattagtttaatttaaacataattaaataataatgaaaatcaaatttaatttattccaatctgcgttttcgcattcagaatgctgcttctcaactgcttgaagcattcgcaatggctgatatttttttcccagctcaccattctttttgcttccccgatgctattgtcggcgctttgttggtacaataaccaaaattagggaaacaattattgtttaataaacaattaaaatttaggatcaacagtgaaattataaatggccgaaaaagagagtgatcaaaagagagagacagacgcaaaaagacagcagagagtgtgtgagaaggagagagagagaaagaggagagagagagagagagttcaatcggattttaatgtcatctaacaattttttttctcattttttaattttttttctgccgtccccaaatgccatcatctgacaacaaattatacaattttatgacaatatctgttaaaattgattcaaaagtttaaaattccagctgcgtttgacggcaccgccgagcttatgtcgtcccatgaagttttttggccaaaatagttaataatcagaagatttcaaaatgaaattccgatattcctttgtcgcaaaattacaaaaaaaaa

SEQ ID NO: 61388 - DNA, 1244 bp, Heterodera glycines
  Genomic contig location: Contig_ID=SeqID_6395; Location=3696..4939; Strand=-
  SCN-specific regions: Sequence locations=1-240,262-436,458-585,607 -616,638-685,734-765,812-950,972-995,1029-1082,1135-1244
atgacaataatgattagcatcgggcaatggatgatgcacattatttggcatcaaattgatcggcttcgccacattgccaattttttgattaattattggattgagttccgtttgactgattatccattggcactatcacattatcagtgctgtgtacatgattatgttccactgggtgatagcttgaaaaattcgggtaactatggtgataaagaccatgcccaaatgaatgaaccgaagaatcatttatattattaacattatttgagctaatcagtggcatcgaatttgaatacaatgccatgccattgtgatcatattcattagccaaatggtaattagttggcacatcataaacagtatgataattagatggaacattaatctgatcagtttgagacaaaaatgaccatcttggccattattaaatgtttgaatgtgattattatccattgcagtgagaatatgccaaagtgagcaaaaaaattgcaacaaaaataatgaaaacattttttgtatatatctaaaagtggtttttgttattaattctgcctgcaccaatgccctggctttcataaatccgccaaaagaaacaccagaaactttttataacttagaaattaaatttaatatagaatacctcaaattttgcgagatttcttcgtctctattttttgcttatacgaatatttttatttttaaattttaaattttataaacaatttattaaaaagtaatcagttctgagtaaagttagtgacctagaatattattatttaatataaaatatacaattatagaaatatttatacgaataaagtttctttattaatagagctcgcaaaaaaaggcaccaaaaatcgcgaaaaaggcactataataggcaccaaaaaaattgaaaaaaaggcatgaaaaggcacgaaaatcccgaaaaaggcatgaaaaaaggcatttaaaatttttttaattaactgctttttagggagaaaaacacgtaaaaattaaccaaaaaacttaatttttgtcttttaaatgattattaaatattttgtaatgtttttcgaataaggaaattttaagcctaaaatttctttaaaaaaaaattaaattattttttgagaaaatttttaaattcttaggggtgtatttttccaattttattgcattttaatgggatttttcggtaaaaaacgctgccaaaaaaggcatttaagacacaaaaatcccgaaaaaggcataataaa

SEQ ID NO: 61389 - DNA, 648 bp, Heterodera glycines
  Genomic contig location: Contig_ID=SeqID_31022; Location=90..737; Strand=-
  SCN-specific regions: Sequence locations=1-561,584-648
  Gene Ontology: Mol. function=succinate-semialdehyde dehydrogenase activity; Cellular component=mitochondrion; Biological process =succinyl-CoA metabolism
catatgctgaatacgtcgttaaagctcaaattttggccggaggaaggggaaaagggcattttatcggctgtccaaagaacggagggggaattcgaatcaccaaatcgtgagtttgcatgtcaatttttgttgatttaaaaagccaaatttcagcgtggaaaaagcgaaaagttatactgaaggaatgctcgggaaaagactcgtcacaaaacagacgggagacgagggagtggtcgtaaaaaaggcattcattcgttttcctcgatttgtctttgtttcgttactgattttctttgctcaggttatggttgcagaatcaattacgatcagacgagagacttacctttctgttctgatggaccccacttcggccggacctgtcattcgtttttgaatttattcaaattctctctctctcttttcaggtggtcgttgcgtgtcctttgggtggcgtggacattgaagaagttgctgctacacagcccgtcttaatactcaaagtgggctaataataacagaaacaatcctttcctcttcgaatttgatttttaatttcaggaaagaatttcagtctttgacggaataaccgagggacaatgccaaaaaattgcacaatttttgggcttttctggcaagacagctgctaaa

SEQ ID NO: 61390 - DNA, 73 bp, Heterodera glycines
  Genomic contig location: Contig_ID=SeqID_31022; Location=1415..1487; Strand=+
  SCN-specific regions: Sequence locations=1-73
cgctttcttctgttgtattcatttattttgccgctcttttgaccatttacctgcgttttcccgaattgaggcc

SEQ ID NO: 61391 - DNA, 915 bp, Heterodera glycines
  Genomic contig location: Contig_ID=SeqID_31023; Location=179..1093; Strand=-
  SCN-specific regions: Sequence locations=1-108,130-130,152-222,281 -322,345-515,560-894
atgccaaaaacagaaacaataacaaaaccatgtgcaacagcaaagatgaacaaatcagcagtaaatactcgcttccagatttttgccgattttaatggaaataaaacggaaaaattcccaatttttccaatattggcaatttttatttttcgttggaaaaatttatttgcatattcttacttttacgcggattttttttaataaattaagaaccgcattgactttttaaatttttaaaaattcgagatattttttataattgttatttcaatttttatatgataattctgtttaatgaattaaaagttttaccactttcttcatgtctgctttaaattattttctcgcgcttcattcacttttttttgccattaaaatttgtgtccttttaattgggtatgtaacacgcgtttttgtcacgatatttgctgttgtgtaacaactgttactccaaaatatgatatttctttttcttaaacaaaaaaattattatgattcataatttttatgttccctaaaaaaataataattttttattttttaataaataaaaaaaattcatcccgatggaattgttgctgtttcgtcatgacgaatttgacaaattgtacggctgtgagggatttaatgcggacaaaatcccacttgaagaaagaacaaacattgtgaacggatgcattttgatcacactttttttcgtttttgaggtctttttcagggggtgattgaattagggctgctctagtataaatattcagatttttatccaagtgattatcataagtttgttcaattcaattgcctgcgtaatttatgtctcaatgcaatttgtcagaatcagcaaaatttacatcatcgttggcacttacgcatgggtttttacgagtggttagcatatttattttaaaaaataaa

SEQ ID NO: 61392 - DNA, 662 bp, Heterodera glycines
  misc_feature (627)..(627): n is a, c, g, or t
  Genomic contig location: Contig_ID=SeqID_31024; Location=136..797; Strand=-
  SCN-specific regions: Sequence locations=1-101,124-166,200-308,353 -479,531-563,608-662
atgtgccaacagaaacagaagcactgccgcttaatgggccttttagcaatggtaattaattcggcaaacattgcaatgggacaatttatgccaaattatcaacaacagcaacaaatacaacaatcacctctatttcctcagcgatcccattgggtataaaaagtgatcaaaattttgtaaaataaaaataactcttttcgattgagaaaaatcgaatttgaaattttaaaaccaaaaaaatttaacattcgtacagacagtatccagttttgttctgtatattgtaattaaaatatggcttgaaagacaaaatttatataaaaataaaatggaatttcatttaaaaaaaattgaaattgctaataaagcaattaaaaatcgatttttgattagataaaataattttattttagaattatgatgatggacaacaacagcaacaacttttagagcaaaagtcagaaaacaattttgatcttcatcggcaatggcatcaacagcagcagcaacaatatcaacaacaacagcaggtggttaattaaacgattaagcaagcttatccgaattattattttttatttcttaattattgataatttatataattgtttcgtagtttctatttanatatgtgttatgtattttttttttttttgaataaa

SEQ ID NO: 61393 - DNA, 402 bp, Heterodera glycines
  Genomic contig location: Contig_ID=SeqID_31027; Location=57..458; Strand=-
  SCN-specific regions: Sequence locations=1-168,190-218,241-368,390-402
atgtccttcgattcaaaatttgagtcatgcgcaatcgcctgttcagcttttgatccccatctcgcctggactaagacttgtcacccagccccagtgggacagccagcatgtctgattgagtttcgcaatggcaaattaattgttgatggtgcttgcccctcactatatgcgggattgcagacttccctaaatacgccgaatgatgttagctcgttgaatggatccgtgagttgtcttttgtgccatggaattatgagtgtcgttgagctgttgcggaatgaaagtgttgcgataatcaaggaagaaattggtcattattgcgattatcttcttgcattacgctccgtgtgcaaaggaataatcagcgacttcattttagacaatttggttcaatcacattga

SEQ ID NO: 61394 - DNA, 597 bp, Heterodera glycines
  Genomic contig location: Contig_ID=SeqID_31030; Location=376..972; Strand=-
  SCN-specific regions: Sequence locations=1-51,75-597
  Gene Ontology: Mol. function=leucine-tRNA ligase activity; Cellular component=cytoplasm; Biological process=tRNA modification
atggtcagtggaaatggcaaacttagtcttgattcatttttaactaagaattgtactggttgttgtaggtaccttaactacggggacccggcatggaaagaagcgactcgcaaatgtttggcttcgcttaacactttttcggatgaagtgcggcgcaactttgagcacaccatcgaatggctgcatgaatacgcttgttctcgctcgtttggacttggtaaaacaattaacgccaattattcacaatttctattatattttttcggtttcttaggcactaaacttccatgggacccacaatatttgatcgagtcgctttccgacagtaccatttacaacgcttattacactgtttcgcatttgctgcaaaatgatatttacggtgctgaaacgggtgaactcggcattttaccacctcaactgactgacgctgtttgggattacatattcatgggtaatttgtttgttttttattatttaattcgatttaatgtatttttgaaggtattccatatgattcgactaaaatgccaattgaagaagcaaaactgaagagaatgaggcacgagtttgagtattggtaccccgtcgatatga

SEQ ID NO: 61395 - DNA, 804 bp, Heterodera glycines
  Genomic contig location: Contig_ID=SeqID_31031; Location=471..1274; Strand=-
  SCN-specific regions: Sequence locations=1-261,393-804
  Gene Ontology: Mol. function=transcriptional activator activity; Cellular component=cytoplasm; Biological process=regulation of cholesterol biosynthesis
ttggggcggtcggatgatggaccctaacggacttcctagtgagtgggcgaccaatccgaggctaatccgtcgccctaaaggtgcccctccaaaatccgctacggcctcggccccgtccccgactcgtttttcgtcgacccttcccaagcaatgcccgactatgaccagttgaccaccgtctacgcgggcgacaaacacctgattgagctgaaagtgaaggcgaacacgcgcattgggtgagaacgcgggggggaagtgccggaaagagagagtgaaagggaaggagaatagagagagggagagaaagacgaagagagaaaagggagagagtgaggagagaaacagagagagcccagagaaagagagagacgagaggtttagagagagagagaaacatgactgattcagttggcaatacctcaccgaggaggaggacatcggttttgcggtgtacttcgacccctcgggcaatgccaacaatctgacggagatggactgcgtttttccgtaagattccccctcctttttttccgtttttccacgggattgccccccttttttttctttccctccgatgcgcttttcccacgcctccccaattttcttcagttacattcgattggaatgttcccaagtgcccatttcgggttccctcctttgtgagcagtcgggccgatgtaagcgatgagaaatcggaagaattggctttttgtgtctgtcccttcagacataatcgaattcgacaactattactcgtggttctctgctaaacaattgcggtataacatcgaaatcgatgacagg

SEQ ID NO: 61396 - DNA, 488 bp, Heterodera glycines
  Genomic contig location: Contig_ID=SeqID_6396; Location=261..748; Strand=-
  SCN-specific regions: Sequence locations=1-98,127-199,221-453,478-488
atgatttcggtgagtgaaaaaattatagaaaaaaacaatgattggatcggaaatgccaattagagaggacattcatgtttagatcttgattctttcacaataaatgaaaaaaatttaaatttttaaggttgacgaaaagggttgtgaggctggtgccgcaacaatcgtatcgatgccaaccggcttcgcttataatccgccccctccgcccgttttccgtgccgaccatccgttcgcctttttccttatcagaagcaaaaaggaagtgctattcaacggagcatttgttgggggaaaatgaaaatgcaaagaaaaaggaagaaggaattgaattgctgaaaaatatgatggaacacatttaattgataaaaatgtccactcctccaaaaatctaattatattagggctggtcgggaccgggaatttttggctccagccctaaattatatgcataaaaatatcaaaatacaaatattacaagtaataaa

SEQ ID NO: 61397 - DNA, 602 bp, Heterodera glycines
  Genomic contig location: Contig_ID=SeqID_6397; Location=101..702; Strand=-
  SCN-specific regions: Sequence locations=1-196,219-236,258-394,416 -500,522-532,556-602
atggaattggagaaaacgttcaatttgagcattgccaacaaaatatttctaaacgaaagttttaccattttggaagagtttaatcagacattgagcaaatattaccagggaaattttgaacagattgattttggcaaaagggaagaagcagcaaacgtataaacaaaaacaaaaaacgaattcgaaattaatgctttttataggaaattaatgcatttgttgagaatgcgacgaatggaaaaattccaaaaatgattaatcccgaatttcttgatggtcgaccagtgtaatacacataaaatttaattttttacattatcaattcattagacttcttctgatcaatgcgatttatttcaatggaaattggtcatatcctttcaatgaacgcgacacacaaaaagaaatattttttctcgcaaatggcaaagaaatcaaagtatgtcttcgcaaggcatgtaattaggaagtccaattttcgatagcaaattattgtcaaaatagatatttaaaattgttaatttgaaatattctttttagttggatatgatgcaacaaacaaattttttcgtttaccaggaagagaataacgtataaataaa

SEQ ID NO: 61398 - DNA, 2410 bp, Heterodera glycines
  Genomic contig location: Contig_ID=SeqID_6397; Location=809..3218; Strand=-
  SCN-specific regions: Sequence locations=1-102,140-653,677-775,797 -977,1058-1294,1318-1373,1395-1558,1592-1769,1793-1827,1849-1924,1968- 2060,2082-2410
atgattataaaccagcagcttaaacatctgttggttttgactgtttttaaaacgattattcttctgttaagtatcaaattcatcgatgcaagtccaggtcccaaatatttttaaaaataaattttaattaatattttttcagaatttaatgccgcggatgtgtgccgtgccattgatcgctccgcccaatttcactcgctttgccttcgctcgtcggtggtccaacagaaaggcttcatccccaagcatttgcggcccccgtggttggactcatctctttttgaggacaacaaattaaaagcggaggagaaaatgtcggccaatggatgttacgcgtgttacagtgggacaaaggcgagcaatgggaccaatcaggacgaggattactgtgcttgtgtggtacggtattcgaagaggaacgaatagggtactgctgtgtgtcatttaagtacaaaaagcaaatgccgaatgaaggattttcgaaaatcattggaacattcgtcggactcaattgtttgcaggatttatacaaaatggcattggtaaaggaataaatattcttattttatacggtactttttcagatgccaaagtgtggtaatccctattatgaccaaatcaaacactgtgtcatggtcaggttaaaaaaagtgaagaatttatttcttaaaatttaaggtccatttttacgaaaatgaacccgaaaaggagccaaatggaaacgaatataaacgtaaaaacaattttaaacattaccgtgccaaaaattaatcattttaaatttgactttttctttaggcactctcgcatttttggacggatgcgtcgcgggaggaacagcccaaaattgcacggcaaaagtgaaaattgaatttgaggagccgaaaagttcgtttttctacggaaattgtgacgcacaaatgaaaacaatgtttgagaacaggtggaagaaagggacaaattatcagaaatggggcaattaattaataactaattaccattaattataaaattaaataaatttaattatattattattttattaatttatttaattgttttcagttttgaaattacggattcttccttttctccttttacctttcccgtggtattccaacaccgaatttgcagcagtttatttggcagtgcgcaaatggaaaatgcgttcaatggcattacagtaaccataagcggagagtgcgtaaagagaaaaaaatgcaaataataatattttatttcgtaggagaatttgcgcgggtttgcgagtgtttggagacaaatttaattggacaaaaaaaaaataataataaaattcgcaataaatacactttaaaataaacggaatcagtaacaacaatgaaagatttaaatgggaaaataatttgggtaaacaaccggcacaaaagaattaatgaggacaaatgatgccaatttattgtaaacttaagaaataaataatttaaatcacatggatttcattttgacaatttatttcgttatttaatcagttgtggcacaaacatcttcaaactgccagccattgaatttgaaaaagtattttaattttttatttcaatttttaaaaattcacttttctgagaaattcacacatcaataaatcactatttttggtaaatgttgatcatatacggtttaaagctttagctaatttttttaaaatttttctaacgtttttaacacctaagaaaattaaaatttttgtgttttaagctctttaaataagatgttgaccataactcatcatattttttccaaaaatttcattctgatttcgtcatttaaaacccgagaggaatcggttgatcaacatatatttgttgaatatttgaacgttttcattcgctgagagttcgattaatacataaatatttcgtcttattttgctatgatgttcataaacaatattttacttattttacaaaaattataattaattttaaaatgcatttccagggccgtgtgcatgagatgcgcggcctgcagttgaacatggctggccaagcagtgcaatggcgtgacccgaggggcgcccatttgtacacagagcagcaccaactgacgtggcaaccgaccgaattgaagtccatcagtgccaatgggaaggtgaacatcgcatttcaatatccacaaacaacgggaccacgtgagtaaaattaattgggtaattagctaatttataagtatattactcataattaatgaagttagtttttttcagaattttccatgaatttgctaaacgcaatctaccgtaactgctgtgctgatgcatcgtctacacagaatacggtactttcgcccatttcggcggccattgcgttggccatggcttatgcgggcgcgcggggacaaacggcggccgaatttgtcaatttgttggccgatg

SEQ ID NO: 61399 - DNA, 930 bp, Heterodera glycines
  Genomic contig location: Contig_ID=SeqID_6397; Location=5481..6410; Strand=-
  SCN-specific regions: Sequence locations=1-311,333-562,584-689,713 -831,863-930
atggatgccaatgccattcattcgttaacccttccaagggatgcaacggcccgaaagccgtttgaagacgggcacccaaaacagcatgttgtgcacgtcgcgtacttcgatcacttcacggccaatctccgcggccaccacgcgacaagcgcgacttggcacagtttggaaacgcagcaaaacttaaatcaaatataatcacaggcatcgatggtaagatactcattatgaccaaattcagatcagaaattttaacttgttaatggcgcttttcaatgctttacttttcgtcacttttcctaccgtaacttttcttttccatactgtaactcgttgctaccgtatcattcttcacattttcctttagtttaattacgtttttctacacgagggatatgctcgcagcgcattacagtcaacagaaaaagcatttttgaatcagagaaattcgtttttcagttgcgcttgtcgccgcacgcggcgcggacagcaaacgacgcgattggttttggccggcacagaaaaatggacatcttttgggttggtgagcaattaaaaatatttccatttccaaatataggtaattaatggttccagggatacaattttagttttaagatttatatacaaagtccattaaatgttgcttattttcaccttttgtgaaagtgtttttgactttttggttcctttatgagcctttatttcttaattccttggccattaaaatgaattttgcattttttgtccaatatttacgattaaataaccatttttaatgcttttccattttctttttaagatgcttctcaaatgttcgttcctcttccatctgaattggttccattcgtttctttgttcagctttgatgaccaaatcgaagcgaactttgggctcaatttcgaattcgatttatccaatctctgctga

SEQ ID NO: 61400 - DNA, 785 bp, Heterodera glycines
  Genomic contig location: Contig_ID=SeqID_6397; Location=3408..4192; Strand=-
  SCN-specific regions: Sequence locations=1-292,314-330,358-537,568 -678,700-753,775-785
atgagaaaaactgagaaatgttagtctatttataaagctttctaaactaaacaaattctaattaactttcagtcatctcaagaataaaaaagtcattattttgtcaaaaatggtgagaaatggcattgaatgaatgtattaaagtgtctgtttattttgggctgtttttgatattcccaaatggtcgttctctccggcagttgagcaatttgtccgtgtgaagtctctaagaaattatgcacaactgcaaaaatgtacgaatgtcaagcgatctcaccagcagttttggtgctaattttggtgaaaaaattaagtggtgccgaactaaaacctttttatttattaaaactagagtagagcggcaccggtagtggtactgaaataaacgtacaaatgagtgcttagtactggttttaaccggaacaggtaagtaccgttttttaccggtttttccagccaaatagtaccgtttcaatcctaaaaataccggtaccggttttttacaactacccattaccgctctactctattaaaacctaaattaaaaatttaatttgaaaaataaaagtgcgggaaaggtcacaaaaataaaatcagaatattcattttcacttaactcttaaaattttcagcattacttcatcactttacactttttaccagaatacacaacgagcgaataatatattacaaaataaaccaaactgactgggatgactcatctccgtttttcatttctaatataccgttatgataatcatttattttttgtttactaaaataaa

SEQ ID NO: 61401 - DNA, 752 bp, Heterodera glycines
  Genomic contig location: Contig_ID=SeqID_6397; Location=4205..4956; Strand=+
  SCN-specific regions: Sequence locations=1-44,66-72,110-185,208 -479,501-519,541-752
atgacaaataaaattattttgtgcacaatcattgcattggcattcttaaccaaaattgatcaggttcatcgctttatttatttatctaaatttaaaaatgtttttaaaacagatttcatcatgcttttctgtcacatacggaaatagatgttgcaaaaccattccgaattttcccgttattccaagtattttaaattttgaatttaacatatgcgattttatgatttgcttgtttctaaaaaaccagtgcttaattatgtatcaaatcctaggtattgtcactttgtgtagtgtcggcagtccgtggtgcaacgcttttggagggaattgcgtcgtttgcgaatttgttttcattccgactgcacgttgtgagctgatcaccaagtgcagttgctactattgttgtgaggagcagtacaaagactattgccctcaggggtgcgaaaattgcgtgacggacggcgagggcggctgtgaggagaacgcaaaaagcagagaaaaattcgaaggctgcgcgtaattaattaatctattaattatgaaaaggaatgcccatcacaaacccaaaacccttagaaaaaatataaaattagcaaaatatcatttaaattaaaaatgctcatacaatatcacacttatcataaccataatcattgccaaaatggaatttttgctgatttttttaatattctttttcgattttcacattataacgtaggtgggtaattctgcacccatgttatgataacata

SEQ ID NO: 61402 - DNA, 627 bp, Heterodera glycines
  Genomic contig location: Contig_ID=SeqID_31032; Location=459..1085; Strand=+
  SCN-specific regions: Sequence locations=1-365,387-627
ctggatttgtagcgatgtttggatggacattctcccatcttttgaccatgctcaactcggcctcaaattggcattgctttcttatcgtttcgatgctttggtggacacgcatttcgatggaaaaagcgaattgacaatttggcgactaatcagaattcgcaaggacacatcaggaccaaaaccgaaaatttgtgtaacgctggatgaaaataacaatgatatcgatgacgatgacaattttgtggattttccgttttcggaccgtcagctgcccaacaaaaattgctttaaaagcctttggattgagtaatttgaacttttcatgtgtatattaaggcattttaatttttcttcaggtacattgaccattccatcatcacttttctccattccaagaagcgaatcttcgacagaagtggcaccaatttgtatttgagtgtggctacggatttccagccgatttggaatgcttttgtccgtcaaatttggccaatttttgcgggaagtattcgccatttgagttttgacgctggcgatcctttggacaatttgcgtcgccgcatttcaccaacatttctcaccgatctcaatcgattctggtgctctgttacccgacggtattgctga

SEQ ID NO: 61403 - DNA, 99 bp, Heterodera glycines
  Genomic contig location: Contig_ID=SeqID_31037; Location=976..1074; Strand=-
  SCN-specific regions: Sequence locations=1-99
aatcaattaaaaatgaaatacgaaccgaagccatgcttcaaaatgtgcaaatgaattggtggtagacgagatgagaaaactttggaagttcttaatttg

SEQ ID NO: 61404 - DNA, 871 bp, Heterodera glycines
  Genomic contig location: Contig_ID=SeqID_31038; Location=197..1067; Strand=+
  SCN-specific regions: Sequence locations=1-53,83-219,249-384,409 -545,575-711,741-871
atagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaatttggggcgatttgaatgagaatagaaagagccaggttcgatgaagttttggtaagccaaaaaaaaatcc

SEQ ID NO: 61405 - DNA, 327 bp, Heterodera glycines
  Genomic contig location: Contig_ID=SeqID_31039; Location=12..338; Strand=-
  SCN-specific regions: Sequence locations=1-164,186-327
atgaactgcaccgggacagcaaaaactatcgggatgagagctggagttgaagttcaactaggaaagccgcacaatcatgccccttctccaacacgatgtgaagccgctaagatcaacagaagcgtccgcaacacagcattgtcatcccgtggaaatatgccacgcacagttgtgaatgaatgcctcgctggtgcgtcaaatgaagttattgcaagccttcccctaattccgtcaatggagaaagctgtcagtagagtccgtcatgcagccgggggtcaattccaaataccaaaaacactcgcagatatcgagataccagcggtataa

SEQ ID NO: 61406 - DNA, 556 bp, Heterodera glycines
  Genomic contig location: Contig_ID=SeqID_31039; Location=1334..1889; Strand=+
  SCN-specific regions: Sequence locations=1-139,161-287,324-556
atgggaaggaaactcccagccgaacttttgttcgaaatggttctctgtgttcgaagagaacatgcccacgcgagcatttgcctctcgtcccttgtttatgcaaataatgctacctcgtgcttcattatggcggaaaatttgggtttcagtatgattttggatgtttccgctttttttttaaattttcgttgttgctgtttggacttgtctttttatttttgcactaacaattctgttattttatttttggtatttatttaaacgtttttgtctgaatgtggtgattaactcttcttccttccttttctcatttccattggtttttattggttttttttgtgcgtttccttttgtgttcggtgttcgctgtttgagcctttttgagacggtttatttgaaattcaatttaatttaggcatttttcaagctcaaagagaactatcaagacgcgatagcagctggacaagattggaactttgtgagacagacggcgcgtgatgatatcgcatgcaacaacgttatggtggctctggacagactgatggatgtgccgcaa

SEQ ID NO: 61407 - DNA, 498 bp, Heterodera glycines
  Genomic contig location: Contig_ID=SeqID_31041; Location=580..1077; Strand=+
  SCN-specific regions: Sequence locations=1-107,134-217,239-263,292-498
atggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaa

SEQ ID NO: 61408 - DNA, 512 bp, Heterodera glycines
  Genomic contig location: Contig_ID=SeqID_31041; Location=1..512; Strand=+
  SCN-specific regions: Sequence locations=1-198,234-512
gcgcatcggctcggggggactgccccgaaaacaaaaaaatcgattttttcaagtgtccgtttggggtactcaagcaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 61409 - DNA, 558 bp, Heterodera glycines
  Genomic contig location: Contig_ID=SeqID_6398; Location=217..774; Strand=-
  SCN-specific regions: Sequence locations=1-136,159-397,430-448,486-558
atggcatcgatgtctgattgtttggtgagtgcgcccaattggtaggaacccatgacaataattttcgctttgcgattctaaatttcgaaaaaaataacgaatttgggcaatagtcctaaagaatggggatccctccctaatttaaattcttttattttaggctcaaaatcagtttccggggatttttaagggtgctgattgcaaatttgaactcggatttgcccaattccggaccccggagccgaattcgaacaaaagttgtgaaattttttccaaaagatacgttgaaaccggtcaaattttggcgcaaattgcgcattttgtccaattaataatttaagtatgttttacaccaaattgaaaatgacaaattcgggtattttattttttcattggcattatttaatttttatttattttattaaatttgtttttctatggaattcttaaggaaggacttacccatttctttacaatttgttctatttcttgaattgcctgatcaatttttgttctccgttcgtcgtttatgagaccaaagccatttttagaaataaa

SEQ ID NO: 61410 - DNA, 94 bp, Heterodera glycines
  Genomic contig location: Contig_ID=SeqID_6398; Location=768..861; Strand=+
  SCN-specific regions: Sequence locations=1-43,65-94
atgccatttgtgttgtgcccgaattacgcacttggagagcggcaaaattttttgggaaggcaaagtgccaaattcaatggaacgggttcagaag

SEQ ID NO: 61411 - DNA, 2405 bp, Heterodera glycines
  Genomic contig location: Contig_ID=SeqID_6399; Location=173..2577; Strand=+
  SCN-specific regions: Sequence locations=1-314,336-436,458-593,620 -679,722-899,967-1390,1412-1439,1486-1543,1566-1636,1669-1669,1691 -1696,1718-1966,1989-2119,2142-2254,2276-2405
  Gene Ontology: Mol. function=polynucleotide adenylyltransferase activity; Cellular component=cytoplasm; Biological process=mRNA polyadenylation
atggccaacgaaattggacaattagcgaatcggaggagggcatttattacgaggggtggagactatgaggaactgatggaaatgaacagcgagcgggagaagctgagaaggaagctcagatcattggcaggtgattggcccggcgggggagggcttaaatttgacaatccatcggaggacggaagatgccgttgattactgtgtaatgtcacttctaaagttcggcccaaatttccccgtacaataatagtagacatggaataatgtcctttattccgaaggcggatatccacgaaatacagtatgctaatataatgaggaaaaggggaaagggaccccgacccgtgcaggacggaaggggaggggatctggagtaaatgtgatcccggttataagaatgaatagaggtgatcgctaaggaatgggccacattacgagaaagggcggagctaaagttgatcagagtgatcagaggcactaacaaaatcagacagtcaaaaaataagaaataatgtacaattagtttctcgcccaaaaaccatacaattttaggcttcgaagtgggcgtaattattttgaagaaactttttgcgacagaaaagagagaaaaagaagacaaccaaatcattttaagaaattatcgcactttattattggctgtaaaaatgtgggccaaaggtattttaaaatgaaaaaataaaataaattattattttaaattggtatttattctctaattttctctcatcagagcatcacatttatgacaacaaattgggcttcttcaatggcattagcctttcccttttggtggccaaagtgatgcttctttacccaatggcatcacttccttttctcattgaaaagttcttcttcaccttctccacatggtcattttgttttaatattttcttttaaaaaaagttttaataaaattaattgtcaattattttttgaattttaaatgtcctaattattctatgcaagttttaggccttggccaaccccggtaaagctgtccaatttgccggatgggtcggcactccgctggaaccccagcgaagaaaaacaaaaacggagcgaaattggctatggaattgcggccgaattggcaatgccaattgtcacgccgggacacattgaacaaaatgccactttcaatgtgaaccgatccaccgcaacaatcattcggcgggaaatgcaaaacggtgtcaattaaaggaaaataaaataattagggaattaaaaagggatgtcatcattaatttgaatgtttagcaattaaaattgtacgaaattggccaaatctgagcatttcattgaatggaaaatggaaaagcttaataaaggctacaaaattcaaggaaaaggtgacccaataatattatttaaattgaaacgcgtcaggaccagtcagctggggacagctcagctttaagataatttacaaaatttataaaattgaaaaatattaaaagttttaaacaatgacttaggttagggctaggctttaggctaggcctaggcttgcttgtgcctaggcttaattttataaaaatttaattgtatggctgaatcgtccatcagtcgaattgtcccatcagctgattgtcctcagctgactagttcagaagccaaattaaaaattaaaaaatttcaaatatttttcgcagttttcccatttcattcgcattaattgcaaagccttcgctttggccgacttttacgacttttgtggctacgtggagacgcgaattcgtctccaattgctgatcgatgtcgaacgatttgatcgcattcgattggcccatgcgaagcaaattgttgaaaaggaacaaattttgggagagaatttggatggaagcaccgctaataaaaagaatcacaaaaagtgaaacggagggtctcttctatttttaggattttatcaattttttcctgggctacctttggtcagaaacgtactaaaaactatatttttggatgctattgttaaactacttttcgaatttttagatcctaaaatccttaaaaagagataatttgtcctgttttggcattttgcctaaaattgcctaacaacaacaaaaaaaacgaagataaactccctaagaatcgacttaaaatttgaaaaacaaagccctaatattgtcttttcaatacatacaaaattaagaaatgttttcttcaaaatttggttggttggcctcgaattggacgagcaaatcgcttcagaaaatgagtcggaaagtacgaacaattggaataattggaaagaagcactgaattcgatgctttccgaacaatttaacgccgtcattttgaaggcgtatcggacaaagaatggttttagtggcccattggttcacattcaattgacggcacaatatgagcaaaagcattaa

SEQ ID NO: 61412 - DNA, 709 bp, Heterodera glycines
  Genomic contig location: Contig_ID=SeqID_6400; Location=212..920; Strand=-
  SCN-specific regions: Sequence locations=1-71,93-222,244-331,357 -507,529-709
atggcctcccaaatttccaaaattctgcccactcttctcttcatcgccgccgcatttctgctcaactttggctgctgtcagcaaaatgagaggtgtgtgaataactctttctgctgctgctgtacacgttcaacatttaattgtgttctttttcgctttcagccaaacgacggaaactcttcgcgccagaaatgcgtcgtcatcaccgcaatttcctttgaacaccacaacattcacaaccaccaaaaaagaaacgacggttgccactccttcgactacagaagctggcactgaggcggcgacaactgatgatactaatgacgaacaatcattgctgttttggattttgattgggtccgtatcattttgttcaacgcttttcacagccattcatttttctcctaccatttttagcgtcattgtagcaattgtgctcttcttggtcctgctggtgtgcattgtgtgctgcatgcgaggaggaagccaaaaagatgcgcgcgaaaccgtcaatggcgagagcggaggggctgtgaccaaattaacgatgaatggggacaacgccgacagttccagtgcttcacaatcagcatctgagcccgacgaaggatggttcgtgccggactcattgcccaacaacacaatgacggacctagcgaaagtaaacgctcgactggcccaaggaaagaagcagcaggcgccgaagcagtag

SEQ ID NO: 61413 - DNA, 634 bp, Heterodera glycines
  Genomic contig location: Contig_ID=SeqID_6400; Location=1252..1885; Strand=-
  SCN-specific regions: Sequence locations=1-109,132-163,186-496,518 -538,560-634
  Gene Ontology: Mol. function=peptidyl-prolyl cis-trans isomerase activity; Cellular component=extracellular space; Biological process= protein folding
taggcgagaaattccccgacgagaatttcaaagagaagcataccgtcccgggactattggtaacgtttaaggaatggaacactcgtagcccatgggccagaaaaagcgtcatttttcaacttatttttaaattcagtcgatggccaatgccggccccaacactaacggctcgcagtttttcatcaacacagtgaaaacggaggttggacgaaaggcgtatttagccattttcgagattcatttttaacacaaattaatctagcgaattcaagaaatactgggaaaatgcctatacttggaaaattcttacaaattgcaatttatgtgcgcagtagcgcaagtgttttaacaataggaaaaggtgccgtggtcaagaaattcggtacttgcggtttttgaataacacacaattaagcactgcaaattttccgctctcctattcccggaaattgcttttgttattttcggtttagggtttttgatgatgttttcattgcagtggcttgacggcaaacacgtggtgtttgggcgagtcgttgagggcatggacgtggtgaagcaagtcgaagcccagggcaatcagagcggaaagacagcgaacgaagtttgcccatcctttcgctgttcatttcgc

SEQ ID NO: 61414 - DNA, 881 bp, Heterodera glycines
  Genomic contig location: Contig_ID=SeqID_6400; Location=3350..4230; Strand=-
  SCN-specific regions: Sequence locations=1-134,156-567,589-700,722 -856,878-881
  Gene Ontology: Mol. function=5'-methylthioadenosine phosphorylase activity; Biological process=phosphorylation
atgactcattttccccctttggcaccgcacaggacgacgaaacgcgagcagaccttttacgatggactgccgggtcatccgccgggcatttgccatatgccaatgcatcccgcgctcaacgaacgcctgcgacgggcgctgctcgccacggcgacgcgtttgggcgctgcacacagcgaccgcggcgtgttggtgtgcgtggagggaccacgcttctccacgcgggcggagagcgagctgttccgcgtttggggcgccgatttggttggcatgacactgtgcccggaagtgatttataaattgaaaagcattactaaatgctaaatttaaggctgtccttgccaaagaattgggcattccgtacgcttcggttgccgttgtgactgactacgattgttggcgcgataccgctgaaggggtacgttaggagacaaccgtccgaccaattcaaaactgttcatggcctttttgtcacggcatctcaaaattcccgttcccgtgccactatattcctatatataatttgtttcctattgtttcatttgtcaggtgagcattgctttagtgggcgaaacaatgcgaaaaaatgcgcaactgatgcagaaattctttgtggaagcgatcagtgaaattgccggacacaaagagcaattcgttgcagaggcacagaaggccaaggtgaattggaagtggacaaacacaaaatgcaaatcaaattattaatactttgccattttagcaattggccgctgcctcagtgatggaaggagaacacaaactgaactttgatcacttgtgctgaagcttgcttgtttctctgtgatatgatgtagcatgactcttttttattaaatacatatttcgtaaaattaattaataaa

SEQ ID NO: 61415 - DNA, 1050 bp, Heterodera glycines
  Genomic contig location: Contig_ID=SeqID_31044; Location=11..1060; Strand=-
  SCN-specific regions: Sequence locations=1-93,115-430,453-462,486-1050
atgaaagccattctgattttccaaagcctcaccattcttacggtaaaatttgttgtataccatagggttcgcaagtggttttcaaaataggcaaaaaattaatatcaaaattttttggtatcgattttaatttcttaaatttggtaccaaaatcagtgaattgcacagatgtaaaattcatgaatatttttgtacctcatcaaatcctacaaatgatttatctttagattcctctcgttctttaatgaacgaatccgaaagaatttttttgcggaaagcactttggaatttacttataattttgtccgatatttagtttttggggtcactgatcaccaatctgacatctattttaacaaaatcccgagttcctaagctaaatttaaaagaaataaatcgaaaagtttgaattttcgacttttgttcgagtcaggttaggaattagaattttttgttctttaacaaatttcaaaatcaccactttgaccatagagccaaaaattctatttacagcggggaatttgtcgcttcataatttgtctgttcaaattcatcctttgggacccaattggtgccgagaagatgcacttttttccggcaattgccaatttgtatttcgtcggcgtttacagtcgcaatgttgtgccacacattttgattgttgaacgcattttggcaactgtgtttgtccgctcatatgagcattggcggggctacctgttcacaatcatttgggctccgatcgcagtaagaaatttttgtattttcaaatattaacggagttaaaatttaccaaatttttacccccccccccccatttttatgtaggaatgaaagaaactaatcctttattggaaaaatatttttctgtcatcaaattatattataaaatatgtaaacttcttaaatggcaaaattttctcgcattttttttttataaatttgagttgggaatccattagtctgaaacccaaatatttttttagtggattttttttgtaaattttattatttcttttacaattccttttacacataaattttaataaa

SEQ ID NO: 61416 - DNA, 50 bp, Heterodera glycines
  Genomic contig location: Contig_ID=SeqID_31046; Location=141..190; Strand=-
  SCN-specific regions: Sequence locations=1-50
atgatcacctttttctgcagcgcttcatccaacgacagcattcgcccgct

SEQ ID NO: 61417 - DNA, 230 bp, Heterodera glycines
  Genomic contig location: Contig_ID=SeqID_31047; Location=125..354; Strand=-
  SCN-specific regions: Sequence locations=1-88,120-130,171-230
atggaagagttgcaactgaacatgccctaccgtgttcagcctcactttggcgacacacaagaattgttgggacgaggtaggcaggcacttttaaaaattgaattataatttaaatttatggaattggcacttttaaaaaatcaattaaaaattttgtaaaataaatttaaggcatgcatcccgtgccaaagagtgtggacacggcggaaccgttgcgtgccgaaaatgat

SEQ ID NO: 61418 - DNA, 425 bp, Heterodera glycines
  Genomic contig location: Contig_ID=SeqID_31047; Location=716..1140; Strand=-
  SCN-specific regions: Sequence locations=1-137,176-209,240-362
atgacggagtacgacttgccgacgccgcggccaatccgcgcggttgagcgcgagttgcccggctcgcgtcaatccaccgcaacggttggcatccgcgcggaaagccctcagcgggcccaacacgcattctacaggtgtttataaatattaattaaattttttttgattttaattaccccaaaaatttaaaagcaaaaattgaactttccaaaaatttaattgaaatattttattttttactttttcagtactcatactgatcaagtggcttcatacaatccaattgaatgaagaaaattttaacgaattggattatgattcaaatttattttttttagcccgtaaattgtagaaatgtttagaaaaattgaatttttagaattaaaattgtcatttttatttgttaaaaatattgaaaaaataaa

SEQ ID NO: 61419 - DNA, 252 bp, Heterodera glycines
  Genomic contig location: Contig_ID=SeqID_31048; Location=611..862; Strand=+
  SCN-specific regions: Sequence locations=1-84,108-252
atggatcaatcagaatctgctcattatacggattttagtgaaagtgatgagagcgctttaaaatgtaaacaatgaatgaaaaactttaatttttatttaaaattttagtggacatttggaacagtaacccaaaatatccttgctgttcatcaattataccatcggccctttctggagaacctgccccgccgttggcaccaaaattgaagctcaattagcgctttacaaaacataattcttttaaaaaatgca

SEQ ID NO: 61420 - DNA, 683 bp, Heterodera glycines
  Genomic contig location: Contig_ID=SeqID_31049; Location=67..749; Strand=-
  SCN-specific regions: Sequence locations=1-53,75-512,534-601,624-629
atgtccttggatgcaaggacttccttgaaaatgagcatttggaaaagtggaaaaaataatcaaaggaaatttggtaaatttttgaatttataacatatttggatattaaattatggcattatgtcaattttttgctcatagttgagaattattattttttattatagcggggtcagcgccttcggcgcatcccccgctaggcagtacgattgtgttatagaattaagaatgataaaatagactgggctttttctccaatctctgggactcaaatctccggcattccaaacaatggactcaaatctccggcattctaaacattgggactcaattcgactttttgttcgaattcgagtccgggattcggaattcgtcgcaatggatgtcagattcgtgatcagcgaccccgaaaaccccctagaaatgtgttaaaaaaaattttttttatggtctgtaaaccacataagtaccaaatttaaaattattaaagcacaaaagcttcttcattctcgtcaaataaaaattttcagaaattttgcccttttttgcttgaaaaatttacagaatcaactgcacgtgccatcattgataacaagcacagtttcaatttttatcattaaattttgaggaatttaattataaatcaaaaataatgtaaaatttagaaaaaaaagtaaaataaa

SEQ ID NO: 61421 - DNA, 423 bp, Heterodera glycines
  Genomic contig location: Contig_ID=SeqID_31049; Location=752..1174; Strand=-
  SCN-specific regions: Sequence locations=37-167,189-255,280-423
atggccaaaaaagaatcaaagaatggtggcacaaacgagcaacagcagaagaagcacggtatgcaaactgaaaaatgaattgcgaaaatgtatgaattaatggaagggaaaagcatcaaagcgagggaatccaaatgcgaactttgagcttcaaaaaagattaatctttcaaaattaattttgaaattttaatctcacaattctgcctaaaatttgagcaaaaaacaaaaaaaaatgcgaaatgtcagaaaaaagaaatatgtatagaatgaatgaatggaatgagtaagaaaaaaagaaaaatacattttttacgaaaatataaagcagaattttttccctttttcagctacatcagggatgggatccgtccttgaatggcaaggacgtccttgaaattgggccctctttcttgaaaataaa

SEQ ID NO: 61422 - DNA, 648 bp, Heterodera glycines
  Genomic contig location: Contig_ID=SeqID_31050; Location=850..1497; Strand=+
  SCN-specific regions: Sequence locations=1-276,298-441,463-563,588 -608,630-648
atggccaaggcgacacacgcccgatgggccaagaaaggtgagtttttccattggtttttcgtaaaatctctaattttccaatttttagccgctccccagcccgacaccgatgccgaaaagccacaaccatctgaagaagggccgtcgacatcagaagcaacggcgcaggacaacgacggacaaccatcatcaactccaacaccggtgacaccgctggaaatggacgtgccatcggtggagatgatggtggtgtgtcattcccttcaacgcctgccgacgaagaccaacaaattcaaccaatgccgtcaacatcgacggcacgctgtgacgtggtggcgacaccatcgacttcaaagggcgccggtggctttggtctcgacgatcgtgagtgagaaatttcaccaaaaatttagttttttaactcgtttcattttcattacattgaaattttaattttaggttggccgctactctcatctcggcacacaagagaagatcgttgagaaactggtgaagcacacgacgatgttgaatgcactgcacgaccgtggcgttgagaacaacaaagaaaatgacaaatacccagattttgaccaaattttcacctcacttttatttattttcacattaatatttcgaaaaatttga

SEQ ID NO: 61423 - DNA, 53 bp, Heterodera glycines
  Genomic contig location: Contig_ID=SeqID_31050; Location=1596..1648; Strand=+
  SCN-specific regions: Sequence locations=1-17,41-53
atgaagaaagttatggcttatcaaaataaacaatcaaaaatgcacggatcagt

SEQ ID NO: 61424 - DNA, 1866 bp, Heterodera glycines
  Genomic contig location: Contig_ID=SeqID_6401; Location=1997..3862; Strand=-
  SCN-specific regions: Sequence locations=1-557,579-605,631-922,973 -1098,1121-1191,1370-1374,1397-1841,1863-1866
atggagcagtacaatgccagagaaaattcagagatcaaatctgaggccagatttggattctccggacttgatttggccacaaaaactgcttttaataaatttccaactgatcaaagcaaagttttgacccgtacaataaaagtgatcgaatttgtaatttggggacatccattggaaaatttttttaaaaatcaatttgaatggggaagaacgaaaaatggcttttaaccgaagcaaaaatgtctgctctttcctataggacagaaattgatcggctgtcacttgtggttaacggtgcaaaaaattccgattagcatagcataagaagggtgacagaacttatacaacaccccaataatattgttggaaattgtcatttaaaatttgagacgtgaaaattttaaatttgagaagtgaaatttttaatttaatttatgcctttaaagctttccttactgttgtttctacggcctactagttgtaagtttgtttgtctttactaagttacaaaatttattaacaaaaaagtctttattaaaagattttccataaaattgatcaaagttttttaaataaaacttagtcaatttacaataaattagggtggaccgggaccggggcgggaattcccggtcctccgaggtcccggtcccggattttgaaaaaaaatcccggtcccggtttgccagtcccggtcccggcgggactaataagcactggtaagaagaataggggtctgggtgaaaaattagtgatgaaaattggagaagggaaatttttaactaccaattgtgctgatgtcctagtggctaatcctcttggttttctacttctttcccatggttcaatccctctacagaaattaaaagattttgaatttttttttgtatactcatgggtttcctatcgacaaaaaaatattcctcatatatatattttttaattgacacatattttatcattttttaaagtaagtccatacaaactaataatcccaaaaactacccttttttgttgaaaatctgttaactaactacactcaaattttcaaaatctcccacggcggcgcctatcggcaccgccgaaccccctttctttccccaaaagtttttggaaaaagctcgccgaaaaaaagtgatgtgaaaagcaaatatgaatttctaataatattcgatcattagtccaaaaatgatttaataatttaaataaattttgtttgaaacattgattaaatatattataatttaattttgcgttaacttttgggttttataaataaaaaaccaaacaaaaaattaattatttaattttttcatttgaaataaactaaaaatttgaattttttaatttttttgaatttttaaaatttcccggttggtcccggtccccggtcccggacaaaaaccgaggtcccggtcccggttttggccaaaattcctggtcccgtaccactctacaataaatgtatgaaaagtcctcgaaaatatccatttgatggcataatctgttagcagatatcaagcaaaatgtaaaaaaagcttcaaatatttttgatatttttaggccaaatcggaaaataaaatgcgaaagcgaaagcccatccctgctgctcaccccaaaatgcttgactcatgcttatgcgaattcctttggcgcgaagactgcaaacggcgcggtgctgatacattcgatgacatttagttcaaattgcggcttttatgcctcattctaaataatcgttgcgcgccaaaactggcgcattttttccctttttttacattttggtgtgcggcagcataatggaaaagtgcccatagaaccaatgtataaatattatttgctatattgtttaaaagaaaaaataaa

SEQ ID NO: 61425 - DNA, 492 bp, Heterodera glycines
  Genomic contig location: Contig_ID=SeqID_6401; Location=4211..4702; Strand=+
  SCN-specific regions: Sequence locations=1-372,395-492
atgagttccattcccgcagcggtatccgcaaatttgattgttcgttctcccatttgcgcagatatgtcaatcatgcaattttctttttccaaggatgactcatcgtcgaccatcggcggtcgcgaaacgcccgccgcctccaaaagcatttctggcaccgcatctgcctctgccccatcaaagaaagcgccgtcctctttgagtgtttcgaatggcggtggtgccaaagcggcgtccgtcgtcgcctccggcactgtgccaaagagcaaaagtgtcgttgggaaaaacgcgaagagttcccccgctgcggaccctttggatttggtgcgcgcgagtggacaacggacgaacacgcgactgctcgaacgcgacgcattggaagcatttgtgaaaacggtggacccaaacgaattgttggaggacgaagtggcggacgcgattggcctggtggtggaggaatttgtggacgaactgatccgacactccgtcgat

SEQ ID NO: 61426 - DNA, 1122 bp, Heterodera glycines
  Genomic contig location: Contig_ID=SeqID_6402; Location=140..1261; Strand=-
  SCN-specific regions: Sequence locations=1-32,54-165,187-352,374 -535,557-780,807-1061,1104-1122
atgaaaaggatccaacaaaatttctctgatcagattggagtgtcaagcatttcaacgctcaaaaaggataatcgttttgcaagtaagtggtggacaataaaacaaaaaaagacaagttatgtacgtagtagaacaacataaaagataactcgctggtgggactcgaacccacggccttcccatgtcgaggaatgttctaaccgactgagctacgggcgttccttaaggggttctcccatgtccttttatcatactttctcccacactttatttccttatgccatcacaaagcagataaccgaccaaaggcccgatagttaaggtcacgctttttaaaggcctcccgagaacgggctttggaaattttcttagacctggattatctgattttttttacaagaaatccagcccagtcccatggttttttcaaatgtccaaatgtactaattaccatatccatcttaatatacagtactgtacacgcgagtatcgcgttactgtgattggattgagaagaacactgacggtgaggtgaaatgtttgtgaattggagaacacgaagactttgcaaaatgtgataaaaaaagacgaacatttcaagatttttgcaattattatccagattaattagttttatgcttaagtaaatatgctaatggataattgatccactttcggccccggtaccgcctgttgtcctggggaaagccactgcttttccggtcgcaaattgtcgagggggatccatttttcatctgaagtcaggaccctcccgagaaatgggatgttgctgttgttgttggagcagttgagtagcgatgtccacccgccgttgtcgctgagggggggtcaaatcgtgaggcaaccacttactgcagcgccatttttttcccaattcgtgcaaaattctgtcgatttgggagtgatcactagggatgcgatttttaggtaaataagattcacggaatttaaaaatgctgattttcctgttcgtttcgtacttttcagaaaaatatgaatttttgcagagaaataccttagtataaatactttctgcctgcaaaatttaaaaagattttatatattcaaaatttttttataaacattcccgtgtttaataaa

SEQ ID NO: 61427 - DNA, 1529 bp, Heterodera glycines
  Genomic contig location: Contig_ID=SeqID_6402; Location=2430..3958; Strand=-
  SCN-specific regions: Sequence locations=1-308,345-774,796-801,831 -841,868-1529
atgggcacgaaaggatgccgaaacagagagacatctttgttggccattttgcatctcacgatcagcaacactatgcatggacggtaaaaaaagaaaaaagttggaaaaaacgttggcgaaaaaacaaaatgccaattcaaatataaaataaaatatgtaaccataaccaaacgtgttaaagtcgggaccagagcgtttgggcccccgtttttgggcccccgcgtttgggcccccgtttttgggccccggggtcgtttgggcccccgtttttgggccccggggtcgtttgggccccaacccaaaaatcgaaaaatgtgcttttttaaaaattaagattctaaaaactaagcctgagggatccctcgccacttggcataagttaggtttaattaacattcgaatggctaacccaattgcaaccaaaaaacaaaaagtaaaattgtcttacgaaggccacctttacaccttcgctggaagcttgcttcggtgacgggactttttcattggcgccgccactttttttatcaaatttatacaattttggctaggttagttagtttttagaaatttttttattttgcaatgtttagacgaggcaaatggatcataccagtgtgccattttctgctcacatcgaagtcgcaggcgtcatacattcgtatgtttgagctcctacatcaggcatggccaacatttgcacctacatcattcacaattgatttcgaattggccgtgagcaatgcggtcacaactgtatttggagggtgtcaaatcaatttttgtttcttccattttgtgcgaaatttgcaaaagaaattgaaggaacaaaatttgtggcaggttttaataatttttttaaaaattattgcggcgccgaagtgaccccgacccgtttcagcgctactgcaccgattctgtgtttgccgagaacgctcgaatgatcacgtctgttgcgttcgtgcccttgtgtgacattagaatggcggtagcggcacttgatacggagttcggaaatttggcggttttccaaccgctgattgactggtgtgtgaactttttttaaatttaaaccccactgaaattacaggctattaatcaattacgttggacagcccaggcccaatggcacatggtctcaaccaacttttcgccctgaacaatggaacgtctacacacgcacgcttaatgccgattcacggaccaacaaccactccgaggcggagcatcatcgtctacagggcgccttcaattgccgacacccgtcgatttttcacttcattgacgtgctaagtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtga

SEQ ID NO: 61428 - DNA, 86 bp, Heterodera glycines; identical to SEQ ID NO: 57243
  Genomic contig location: Contig_ID=SeqID_6402; Location=2410..2495; Strand=+
  SCN-specific regions: Sequence locations=1-86

SEQ ID NO: 61429 - DNA, 954 bp, Heterodera glycines
  Genomic contig location: Contig_ID=SeqID_31052; Location=1..954; Strand=-
  SCN-specific regions: Sequence locations=1-11,33-59,116-178,236 -236,258-303,325-362,404-595,617-670,695-745,784-863,886-954
ataaaattgacaaatatgatcaattaatattaataaaatccgaaaaattgaaatttacgatttttttacaaaaaatttttttttttacatttttattttaaaaatcaaattaaatgctcaaaaaggcaatggtaattccacaaaatttttcctttattattaatgaaatcgaaaattcataaattaaatttaaacagtttttaaaattaaaaaaaaaattccaaaaaaaattaaagaattttcttggtccttttttattttaaaagacacagaaaaatttatttaatatgtccccaacaactaatttttattaaacattttagtccatcttgacgaggagacattgctttccattaattcggtaattttttaaattattaaaaaattcatttcaaattttaatgtcccccacccccctcttaaagttgaatggcattttgaacttttgcgaggacggcaggcatcagtttggccaaggcgtaatcacttatgcacaaggcgaaattgtcaattggtaggcccactattttaagtattatttgcccaactttctaaattgtgggactaaaatattttaattaactaaaaaaactgatttttggggggtttttccgttccaaaaaaatgaaattgtaccccaaaatttattgttttgcattcacctttctccaaataaaattaaaaaattttttttgacggtggaaaatcggttggaaactgaaaaatgagctcgtcaatttgttacataaattttctttaaaaaaatataaaatttcaatttttctgtaggataacgacactttccgattcatttcggtcagtctttttttatttatttgattttggcatattttaacataatgccaaccccctttttctccctttaaaaaacagagttgccgacgacatgggcaaattgcgctttcagttcaaagtgtccataagccgctgttc

SEQ ID NO: 61430 - DNA, 837 bp, Heterodera glycines
  Genomic contig location: Contig_ID=SeqID_31053; Location=176..1012; Strand=+
  SCN-specific regions: Sequence locations=1-143,165-258,280-837
  Gene Ontology: Mol. function=RNA helicase activity; Cellular component=polysome; Biological process=regulation of translational termination
atgcaggcccctccggggacgggaaaaactgacgtggcaacgagaattatgctgtcaattctcaaagaaaatgacgaggcccgggtcctattcattgccccaatgaatgttgcagtggtgcgagcagttcagcagatggccgagaacatggaggaggtcagatggagagagcggatgctggcgctgtttgctgggacgggaaaggctaaataccgggacgaaattgcgcacatcggttcacatcttttggcttctgccgtcagtgctcctcaacttttggacactttggatgaggagaagaaaaaggtagtggcacggtatgtaaaggcgtgccaagacacaccgaaaatggctaatgagggaaaagttacggaaatattaatgggaaaggaaaagcggcgcctcgtcttctgcacattaagcttggcggaacaactgggggggctattttcagatttcgattatgtcttcctggacgaagccggacaagcaagcacagtgcaggtgctttccatgctgtcaaaattcccgggattgaagaaattgctgatcactggagatgaacatcagctcggggtcaatctgcaagaagtgccggaggcagttcgcgacaaatgcggtttggacaccgttttggagaatttaagggtcgcggaatcagtcgacaaaacggttctgtccgtcaacttccgtagtcacccagtgattacgaaatgtgtcgaagcagccgcgtacgcaccgcacggaatacagctgatctccggacgatcagcagaccaaatgaacatgctgagcggattgacaggatcaggctcccatccccagggattcccttaa

SEQ ID NO: 61431 - DNA, 1458 bp, Heterodera glycines
  Genomic contig location: Contig_ID=SeqID_31054; Location=142..1599; Strand=-
  SCN-specific regions: Sequence locations=1-42,75-105,128-212,234 -299,321-997,1019-1320,1342-1458
atgccttgggtctggcatagcgctgggcaaggtcgccgtcgccaacaacaacaacaacaacaacaacaacagcattatggatcggtgaaaattcttttttttgcatttaaaaattttctgtttaaatttaaataacaccaaaaatattgtcacgcttttctgttttttttcaatcttaagaatttaatcaatccttctctttttttagcctgtaaaatttctaagtaagatttgaattactacggtcttcaaaaaaggctcaaaatgccatttttgtgtttattttttcagtaactttctaaaattattttttaaattaacctacaaaaattggaacaaatttgagactgtttgctaaatgttttttaaatagtgttaaatttttcagatacaaccgaattttaaaaagtgaattgggcttaaaaagaatagtaaactgtttgcctccgcttgcgtagagatgaaatgcctccgcttgcgtagagatgaaatgcctccgcttgcgtagagatgaaatgcctccgcttgcgtagagatgaaatgcctccgcttgcgtagagatgaaatgcctccgcttgcgtagagatgaaatgcctccgcttgcgtagagatgaaagctctcacgcttccaaattcctgcaaaacgccccagcgctgatgaggaagaattggagaacccgaaaagtttgaaagatgttctccgttatgcaggagctgggacattttacattactgcaaccattgcggacttgcactatcaagtttatgatgttcgaatatttttttgtgttttctagtaaatttctcattttcctttagtcgtgcccgctccgagtgcgtggtatcccctgtcgtcgcaaactaccaacaaatctcacgtgcgattcgtgcgggcaaacagtggagaagccagtcaaaaacatttatctgaaaattgttttacaagacctagacgacagcacctgcactcaacgtgcaacaattttttcggcggttattcaatttttctttaattttcgtaatatttgcacattcaggtcgcggaagcgtttctcggacttaaggcaattgatgtccatgaaatggaagaacagaaactgtatgagcattttgaagccaaattgggaacaacaattaatgcaaaagtgaccattaaggtaaatgtttttttgttggacattgttacttgtagaacaaaattataggaggacagtcaaaactttttcggcctcgactgggtggtcacacgaatttataagtcaagcgaaaagaaaattggcgatactgaaaagaaagcggttgaaaatgaggggacttcttcaaaaattgctagattggattagacattttccatacatttgggcctgttaaaaaatagaaatttatcacattttgcgttgaataatgcacaattatgaacatgaaacttttttattggaatgtaatttcgaaattaaa

SEQ ID NO: 61432 - DNA, 464 bp, Heterodera glycines
  Genomic contig location: Contig_ID=SeqID_31056; Location=523..986; Strand=-
  SCN-specific regions: Sequence locations=1-293,315-433,461-464
atggaagaagcacctgacaaggccggtgaacgtaatttccatcggatttgccgacgcagtcaaaggcgagggaggaaggcgacagcggaacattgggagccgtgggctgaggaaggaatgccatgggatgtgccgtgggttggggttggaatgccatgggatgtgccgtgggttggggttggaatgccatgggatgcgctgaaggatacgataccccggcttgggtttgtgcgtggtgatacggtgccattggattttgaacattttgttgtgcctttcctgtccaattagtgcttaatatgtgcacaattattttctcctttcttttccacaatgaataatgcctgttttgccaacaattttgctgtgtcgtgcattgcttccatttcgcatcataaaccaaattgtccgagcatctcgtttcatttgcaacgccttaattattaattaattaacgcaataaa

SEQ ID NO: 61433 - DNA, 151 bp, Heterodera glycines
  Genomic contig location: Contig_ID=SeqID_31058; Location=605..755; Strand=+
  SCN-specific regions: Sequence locations=1-62,84-151
gggctcctgtatggtcgatcacgagaaaagaacggaaggaaatgacaccaccgacaagagggagcagagaaagcagcgaggaaaagtcatcggcaacggattcaccgtaccaatcgagaacagtgacaagcacagaacgggtcagtgttag

SEQ ID NO: 61434 - DNA, 1270 bp, Heterodera glycines
  Genomic contig location: Contig_ID=SeqID_31061; Location=75..1344; Strand=+
  SCN-specific regions: Sequence locations=1-87,144-211,234-551,580 -751,844-857,879-1011,1033-1172,1207-1270
atgaaagccatcaatttggaaaggtgggacatttgaatggaaagtcaacttttattaggacgcattattattcatcatttaagggactaattttacaaaaaataatttttgcatttttataattttgaatttttattaattttggttagattaaattatgaattttcaaatgaaaccaaagtataaaaaaagaaatgttaaggctgtgttctattatattatttttattttaacagttttgccacgattggattcgccacgaaggaagtgccattggacgggtcaattggccaaattttgaacagttacggataccgaaacgatggctcatttggctgtaatggcatcaaccggccgtgcaaaatgccatttggccaaatgccaatgtcattatttggtattccatcgtcattttcccccgtggcaatgccatcggcggacgtgacaatggcatataaatcatcggaattttccactggcgacgtggtcggatgtggccttttcttggacactcagctgatctttttgacaaagaatggacgacgaatgggtgggccaattaaatttaaaaaacattttaagatgactcatcgtttttcatttcttctcccgccaattctcttttccgtgagtttctttgtgggcgggcgacaaaatcgaagcgaactttgggccaaatttcaaattcaatttggccactctttgaagaaagcagaaacaacggaagaaggcgataatcatttaaaattcattaatttttttgtgttttcattcttttttcaatttttgattttgtttttaatgctaattgtattattttatttgttttaatttattttattaaaaaatgttctggcgatttttggtgaaatttttaatagattctaaatgattgctgctcggcgcctggaaatttataagagttgggtattttgccagaattcggtttctaataatttttttgaattgataaatagacatctgcaatgtataaaaaaaattatgaaattactttcccccaacgcccacccccttcgcaatatacaaaaacgaaaaaaaaatacaataatccatgttcagttttgtaaaaagatgtctcaattatggacaactgggaatggcatttgtgtaatgattatgaattctaaaatgctaatgaccgaagtatttcttttttaaatgctaaaaacaaaatatttccacagcctttaacaaagatttattctattctctgaaactattaaatccaattttccaaatgaatttttaa

SEQ ID NO: 61435 - DNA, 663 bp, Heterodera glycines
  Genomic contig location: Contig_ID=SeqID_6403; Location=458..1120; Strand=-
  SCN-specific regions: Sequence locations=1-640,662-663
atggcaagaaaaaaacgaaaaccaagattcgctaaatatggaaaagttgacgggcgttggagatttggactgtacaagcgcaaatacaatatattgctcgggccggcattggaaggagtacagaatttgttggtcacagcgtaccacgaagcggcacacgcgataaaatatgggcaaaacaacatcgacattttagacaaagtaagtagttttcagcaatctggtacaaaaaatgaatgcttactttcctattaattttcatcaattatttaataggtcacgattcaagcccaaggaggcaatttgggcgaaacttcttggcacgatgttgaaggactctacacagatgaagaacgctttgcgcaaattgtgcaatttatgggtggacgcgcggtggaactgttgatgtttcacaacgcgcaaggagacgaacaggatgtggaagatgcacgagctgtggcaattcaagtaacgtacatattgaaattgttcatttacattagacatttaaatcttttgttttaggttttggaattacgtgaaatggaaccaacagacgagctgatcgcaaatttaatccaacaagcaacaaacacggcgacccaagttttgacgaacaatgagaggaggttgaaacgagtaagaactacatttaaaaattaa

SEQ ID NO: 61436 - DNA, 683 bp, Heterodera glycines
  Genomic contig location: Contig_ID=SeqID_6404; Location=170..852; Strand=-
  SCN-specific regions: Sequence locations=1-231,253-531,630-683
atgacacaaatgatataccaatcgattcgtcttgacgagctatgcacgaagaagtaggtctccagttgcggaagtgccaaaaaacggtttttgaaccggtttaaaactcgaaaaattgagtgaaaaagggggcccctgaccctttaaaacggtcaaattttctcgccaatggcctggttgcagtcacgatgcctttgttcttcttcgacagtcaagcgtatgggaagcatttgaagggggccaaatccaaggaattattctggtagatagtgcttacccaacacgtcgctggctaatgacaccttttgcaaaccctacaactgcagctcagcaacaatataattatgcacatgcaaaaacgcgtgttattgtcgagaatgcatttgccagatggaagaggcgattccatattttacattccgaagtacgaattaagttgcagaatgtgccaacattgatcacggcagcagctgtattattgcacaacattgcaatcgatcgcaaattgccagattttttggtggctcttcgtaatttattttatttttcttttttattcatgtcaaaaattgataaatctttttgatttgttaatttttcttttttaaataatttattttttaatatttcctctcatgatccgtgcacacaccgtccgaaaaaacgagatgtgtaccaataaa

SEQ ID NO: 61437 - DNA, 443 bp, Heterodera glycines
  Genomic contig location: Contig_ID=SeqID_6405; Location=447..889; Strand=-
  SCN-specific regions: Sequence locations=1-176,198-337,361-443
atggaagacctttacgaaaaatgtctaaagaattcgcgtccgatccatcggaaaatggaggagaatttgtacgacatccgagttttggacgtgaaggcgaaactggcagaaaatgagctcagacaaaaaatgactcaaatggcaaacacatggaaaaagacgggcaaagacgaacgaaagcggaaatatgaggaaatcgaagaacaattcgctaagtgcggattttgtgggggaaactggcaaaatgataaaatgtgcaaaaaacaatttaagggccaatgatttgtgcaatgaaaagattcaactcgccgagagcacttatgaaatggtggactcattcatccaaaagttggacaaagagacgagcagtttcaacgcttttgtaaagcgctctaaaaggacggctcaatcaacgcccggaacatcgaaggaaaacattgccg

SEQ ID NO: 61438 - DNA, 674 bp, Heterodera glycines
  Genomic contig location: Contig_ID=SeqID_6407; Location=60..733; Strand=+
  SCN-specific regions: Sequence locations=1-238,260-533,633-674
  Gene Ontology: Biological process=reproduction
gcacttcttccgcatggcgccatgacattgacacggccggtgacggagacagccaatcggcagcactgaagcgttcaaaattgcatttgttgtgcggcggcggtgacggactgacaaccgagcgtgaaagcgggggcaactctgagtttgacgaggaggagggggagggcagcgacgactacgactcgtacgggttggccagtgacgatgacatgtcgccttcatccaacaatttgtccgacgatgatgaggacgacgagctgagtgcggagtcggacgatggcggtgacaacagtgacgaggaggagttggaacgtctgttgggcggaggcgcggcggcgattgacggcgacgctgtaccgctcgccaacgacggcgacaacgcatcctttgaacagccggaagaggaggtggaggtgaaccctttctgcatggacttggccgtcgaggacccgtgggcgagcgtacagaagaagcaaagcgttgaaagcggcggtggcaaatcgcagcaacagtcgctggacaaacagcgagcggcgactgtggcggcggaggcggaaaagcagcggcgactgcagcgacgcaagcgcaaaagggaggcggcagccaagcggaagcgacaacagcggcagatgcaggaggcactgatcaaagccaccgtgtccaacattacg

SEQ ID NO: 61439 - DNA, 457 bp, Heterodera glycines
  Genomic contig location: Contig_ID=SeqID_31063; Location=403..859; Strand=+
  SCN-specific regions: Sequence locations=1-457
atgaaaatatgtaagaaaaagtacaaaatatgtaccaaatatgtataaaatcctgaaatatgtaaaaaatatgtaaataaaagtcccgatttttgttcgcaaacacaaaaaagaaagtgtttccctactttttagagcatggagaagccaggaaaaaaatgtatttacataaaattgacatctctaataatataatattgttcgtgcaatatttcaggtaaactgtgtcacccaatttttgccatttgcattgtatccgtccccatttccccgtactttgttccaacaagctgtgggcgtacaccaggtaaaatactactgctaacaatattcggtatcagtgatgcgatttgagccctatttgttgatattttcccatgttttcagagtattcttacacaattttacagggatgactgtaatttctctctgtttttggtaacatatgtttacagga

SEQ ID NO: 61440 - DNA, 1050 bp, Heterodera glycines
  Genomic contig location: Contig_ID=SeqID_31066; Location=194..1243; Strand=+
  SCN-specific regions: Sequence locations=1-22,56-752,774-981,1013-1050
atgcagttgtgctgggacctggtcatctttctccactttcttctggcagcaaatcgtctgctgatctttatgaaggcctcttttaagccctccattttgaacaaagagccaaagtcggagcaaattcttttcaatgtaagccgaaaatgattagctaatttaagcaattaactaatgagttcttccaccatttcagtctcttctcgtgctgatttggctccttttgatcgctttgatcattgcgtttcaaacgccgttccttggcgttttgtttcagcgcgattatgtttattttttggccgatcagtctctcccggcgatgcccatttttcggctctgtgaattttattggacctgctttctgttgccaactacaacaactttctatatatccattgttgttttgttgaaaaaggttgagtactacataatgctaaaattttggtgtaatcaaaaataattttagccccattatcaaaaattgttaatccgtcccctaattcccgatctttttgtccttatataaaaccaactcccaacaataatttaacgattcaattttaaatttccactttatttcagtatagaaaaaagtcatccgatggcaaaacggccaaaaagttcgtgctgaataagcaggaatggcgcattttgggccaatcggtggcaatgttcgttctgatggcatttattgtggccatttgggatttggtcgatttgctctcgtgggttctgcccgacgggctcattctgctcagtgatttcttctttttgctgttctgtggcatcagcccaattttgtatctgtgcactcttccgtatgttttaggggcaacttttaattgagtcccattccaattcacccctctgacttcctagtgaatgggtctcgcggtgttaggtcaaacctaaaaaaagaatcaatggggtgaagctaaaaagtatcaatgtgggcaaaccaaaaaatcaatgataataacctttaaatttaattattatttaaatattttttgccgaataagatcacaatttagctcaaacttagtcaaa

SEQ ID NO: 61441 - DNA, 538 bp, Heterodera glycines
  Genomic contig location: Contig_ID=SeqID_31067; Location=296..833; Strand=-
  SCN-specific regions: Sequence locations=1-21,43-538
atgattggatgcaacaatttcttggcagcatcattcagagtgaaaatggttaatttataaatcgaacaacgaatttttataatctaattatttgaagaagtgccttccacttcaacgtgattgtacgcatgttgaaggacagttctttggcaatgaagatcaatgatgaacggattatgtgttgtgtgatgaaagggtgacgcatttcggctcgtatctcccccgggttagttttagtgttttttattttatgtgtgactttataaaagggtggcgcgttccggctcgtatctcctccgggagaacgatgcctggacgcgctgtccttcatttttttgttcggaaggcagtgaggggacgaaaatgtgtgaggaagggggtggcgcgttccggctcgtatctcctccgggagaacgatgcctggacgcgctgtccctcatttttttgttcgggaggcagtgaggggccgagaatgtgtgatgaaagggtggcgcgttccggctcgtatctcctccgggagaacaagacaaaaaataaa

SEQ ID NO: 61442 - DNA, 466 bp, Heterodera glycines
  Genomic contig location: Contig_ID=SeqID_31068; Location=307..772; Strand=+
  SCN-specific regions: Sequence locations=1-466
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 61443 - DNA, 423 bp, Heterodera glycines
  Genomic contig location: Contig_ID=SeqID_31069; Location=37..459; Strand=+
  SCN-specific regions: Sequence locations=1-401
atgaggacaactgtgattaaaagaggtacaacagtgatcagaagaggtacaactgtgatcaaaagaggtacaactgtgatcagaagaggtacaactgtgattaaaagaggtacaacagtgatcagaagaggtgcaacaatgattagaagaagtgcaacagtgattaaaagaggtactacagtgatcagaagaggtacaactgtgattaaaagaggtacaactgtgattgaagaggtacaactgtgattaaaagaggtacaacagtgatcagaagaggtacaactgtgatcaaaagaggtacaactgtgatcagaagaggtacaaaattgttagaagaggtacaaaagtgtttagaagaggtacaactgtgattgattagaagaggtacaaaaattgaatgcaatttattataaattttaaaaa

SEQ ID NO: 61444 - DNA, 306 bp, Heterodera glycines
  Genomic contig location: Contig_ID=SeqID_6410; Location=3874..4179; Strand=-
  SCN-specific regions: Sequence locations=1-113,138-306
atggcatttccccaaaggtcgtctctgactgaggtgaattggtaatagcgccatttcagcgctgctttttgcattttcatcgccaattgcgcagtccacgggtcttcgttcacttaattaaaaattattttaaaaatgccgtcagaaaacggcaccttcggccagcagacttttgctgagaatgaactcgccgttgttccaacttgaacaacccgaggaggagatcaactgactgtgcgcgaggtccacttgccgttgcagactttgaatgcgactttcgtactcctggccaattaattaaataaa

SEQ ID NO: 61445 - DNA, 2188 bp, Heterodera glycines
  Genomic contig location: Contig_ID=SeqID_6410; Location=1626..3813; Strand=+
  SCN-specific regions: Sequence locations=1-101,138-154,245-281,309 -494,530-936,958-1474,1496-1526,1560-1830,1853-2027,2049-2188
  Gene Ontology: Mol. function=microtubule motor activity; Cellular component=spindle microtubule; Biological process=anterograde axon cargo transport
atgaactcgacctcgtcacgttcacatgcaattttcacaattattctcacacaaagagagcacgacacaatcacggatttggacactgaaaaagtgagggaaaataaataaataattataatttaataaataaataattttttgattccataggaattattttaatttaaaaattattattttctgtctaaaatattttcattaaattaaaataattattttcttttgaacaatttaaattaaaggttagcaaaattttcgctggttgacctgctggtaagaaagacaaattatttaaaaaattaactaaactcagcaaaaccattgtttaggaagtgaaagagccgattcgacaggggcggaaggccaaagactaaaagtcgaaaaataaacaatttaatttaattttggcatttaaaaagttttaggagggcgcaaatatcaacaaaagtctgacaacacttggaatggtcattaaaaaggtaaaatttgtgaaataatatttaaaacaaaatatttaattttaattgtttagctcgcggaacaatcgaccaaaaagggacggcactcgcgcaccgcagtgattccttaccgggtcagaaacgggcaaaagcatcgttggcattccgcttgttcaggactccgtgctgacttggctcctccgcgagaatttgggcggcaattcgaagacggcaatgatcgccgctttgagtccggtaaattttggaagaaaattagcagaaaaacttccaaaaatacaggccgacgttaatttcgacgaaacattgagcaccctaaggcaagaaactcattcatatggaaattatgtgatggttaattgctccgtcaaagatatgcggacagtgccaaacaaattgtgtgccgtgccaaagtcaacgaggacccaaacgcgaagctgatccgggaactgaaaggtggggccagcggcagaagggcatcggtaaaagcaagcagtacatccggatttgatttaagaggaagtgtacaaactgcggaacatgttgcaaaactatggagtggaggttggcaaaataaggacgaaaatggcacagtgccaagccattcccctgaaatttgccaggttgacgaaaacggggacatttcgtcgagcacgcgagtcttttcggggagagaagaggagacgctggaacagatcaaaacatcggagaaactgatcgcggaactgaacgaaagttgggaggacaaactgaaaaagacggaagccatgaagtaaacgaaagagaaatacggggggggggagcaattaagtggtaattaatgggccaaacggacgacaaacccggcacagaaaggtgcgtgaagaagaactgcgcgaactcggcttggccacctccgcggacggatcggcactgggcgtgttccagcccaagaagctgcctcaccttgtgaatctgaacgaagacccgctgatgagtgaatgtttgctgtactatctgaaggagggggtcaccaggtcggtaatttgtgcagttaaaccatttgtctaattaattaatttaatttaaaattaattttttgctttagggtcggaaggtccgaggcggatcaacggccggacattttgctgagcggagaacatattcgaaacgcgcactgtcagtttatcaacgcggacgccgtggtgaacattgtgccaattgagggcgaatgttttttgaacggacagccaatcgaaggtgttttttggagggcacaagataaaaccaaacccacaaaaaacagctggaaactccaccaaactgagctcgggaagtcgcataattctcggccgaaaccacgtatttcgcttcaatggtaatttgtgaggaaataattggccagaaaactgacaatttgcagaccctcaagaagttcggacgagtcggcacaatttggcggcaattgcaagtgagggagggaggaactgatcattgcatagattaatttcttcaacgaatgatactgttttttttgaataggagaaccaatcgattggcgttttgcccaacatgaactgtttgagaagcagggcatcgacctgaagcaggagatgcacaaaaaagtgttggagatggagcaacagtttcgcaaggaaatggaacagatggaaagggaacaccgaagacggaacaatgtaaaagcaagggaatcactcggaatgattgtt

SEQ ID NO: 61446 - DNA, 1210 bp, Heterodera glycines
  misc_feature (697)..(697): n is a, c, g, or t
  Genomic contig location: Contig_ID=SeqID_31073; Location=747..1956; Strand=+
  SCN-specific regions: Sequence locations=1-90,115-129,151-596,618 -773,803-1009,1033-1140,1164-1210
  Gene Ontology: Mol. function=ATP binding; Cellular component=integral to plasma membrane; Biological process=glial cell fate determination
atggacaaggaaaactgcaagaaagcgggatgcgaggccaaatacggaaaccatcggtgtgattcggaggtgatttgttgaaaaatctggaaattaaaaaaattattattaaaacaataaccattgtgcttaattctaaaaaacaaatttggaaatttatttatttaatttagtgcaatttatttgcgtgccaattcgacggcggcgattgttccacaaaacaggcacaaccctttggcaaatgcccacaggcaagctattgttcacatgtgtttgcggatggcaaatgtgatgaagtgagtcggttttatgtcaccacaactcagcttatttttaatttgttttatttttcctatacctatttagcaaattaagttttaaatccgtctattttctgaattaagatttgcaacaacgaacgctgcttgttcgacggctttgactgtttggagcgacaccaggcgacgtgtccgtggatggtcgactgtgccaaagtgtacgcggacggtcattgtgacgagcagtgcaatcaggcgaactgcggatgggacgtgggtggacatttcgcgcgggttcactgggcgccattgtgaagtgattttctgggcaaaatatttatgaaataaaaaaaattcgaatttctttagacctcagtgcccgttgacaaattcaatcggaccgattctgatcactttgncccggttgtgtggcttctctttggagcatttacttcttcaaggaaatcgaaatggtcagtcagtcaaattctgatcaatttttaattaataataattttttttttcgtttttcacagaatctcgcaactctctgaccattttctgctctttcctttccgttttttgtggtgcttcgatgattttcgtctccaaatcgaaagttccgctcgacagactccaaattttctgactctacttaatttattagtgttaatatcaacaattaatttccccatgttttttgccgttttttaatcgttcggtagtggcggataaaatttctcaaaagaagagatagtcatttttcttggatataagataaatttaaaaattctctgagaaattaaatggcgatgcgattgcgcaccgccctccctctcacgctcgagcgcttttgtaacgtataaaatttctcaaaagaagagatagtcatttttcttggatataagataaatttaaaaattctctaagaa

SEQ ID NO: 61447 - DNA, 348 bp, Heterodera glycines
  Genomic contig location: Contig_ID=SeqID_31075; Location=626..973; Strand=-
  SCN-specific regions: Sequence locations=1-348
gacgggttgggcttggtcagccttgatcaatcaaggacaggtttggccttgaccagtcttgatcaaaaactgttaaggacgggttgggcttggtcagccttgatcaatcaaggacaggtttggcttgaccaatcttgtcaaaaactgtcaaggacggggtttggccttgaccagtcttgatcaaaaattgtcaagacggggttggtcttgatcaagaattatcctttacaggccggatgggacgcgaagaagaaccgccgtatggttggactgatcatgcgcaaagcgatcgaaaaattggaggacaaaaacaatgatgggctgatggcgtccataagcgaggatgaa

SEQ ID NO: 61448 - DNA, 49 bp, Heterodera glycines; identical to SEQ ID NO: 51181
  Genomic contig location: Contig_ID=SeqID_31076; Location=850..898; Strand=-
  SCN-specific regions: Sequence locations=1-49

SEQ ID NO: 61449 - DNA, 1193 bp, Heterodera glycines
  Genomic contig location: Contig_ID=SeqID_31077; Location=311..1503; Strand=+
  SCN-specific regions: Sequence locations=1-69,97-104,141-158,181 -542,565-874,906-1193
atgtctgttgatgaaacaattcgcgagttgagcgggacactcactcaactcaaaatattagtggttagtcaaaaagtgtttttaaattaaattgtgacgccgacataaaaaaaatgaatttttaattatttcaataattagaatttccaaaaactggcataaaaccaataaaattgtgttgaattttttgaacaaaacatttattaatgataaattctttaacagggtaaaatcaatgagcaaattagcggtgtcagtgcccgaattaacataacactgcaaaactttgatgactcagtggctggcattgctactgatgccaaccaaatgacaaaacaggtggacaccaccattgaccaggtgaaaattggtaaaaaaccaatttaaatcacataatataaaaatgggacaaaaatatttgaatttaaattgattactttttcaatatcgcacgcataaacaacattaaagttaagaaaaagcagctcttgaaatattagggttcattattcataatttgaaatgtaataattggtttttcgaatttaaaaacgaaagaaaaaatgagacaggactattgaaatataatcacatcattaacacacttatagagttttgttaatattattgtgatagaaaacatagaatttaatttaacgaattcaaataaaaaaattttacactaaattattgacaaaatagaaaatctgagtttaattaagatccctggttcctgggccttttacacgctgttttttgcgctaattgccgtgctcatccttctctcagtgctcatcataatcaatttaatcataaaaattcaatcattttacggcacaatgcgcgggggctcgtcaagtaaaagccatttaactattttaaaattataaacattaatttatttaggagcgtcgacgccgcttcaatcgctggtccaatccgagtcaaagcagccgcttcacacgcaacaaattccagccatttatcacgggcacattccaacagaaagcaacaagcagattgagggtgggggttttgaatggctcaactgatgcagttcacgcgaccaaacaatgagtatattccacaggttcttatggatattttttcttactttttataaactatttcatttttggaataaccaaaaacttgaaacccatttcatatttcaaattttggggttaaggaca

SEQ ID NO: 61450 - DNA, 731 bp, Heterodera glycines
  Genomic contig location: Contig_ID=SeqID_31078; Location=1..731; Strand=-
  SCN-specific regions: Sequence locations=1-297,355-567,589-611,645-731
aacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggggaaacggacagagctggcgtatctggtctgcattcaccc

SEQ ID NO: 61451 - DNA, 282 bp, Heterodera glycines
  Genomic contig location: Contig_ID=SeqID_31080; Location=567..848; Strand=+
  SCN-specific regions: Sequence locations=1-6,27-30,52-282
atgggcgaggaggaggaggaggaggacgaagctgatgaacaacgcatgacgatgtaatatgggagaggggaaaacatcagtagggagcagagaaggctgtaaaatggagggccaaccaaagaaagcaggcaaatattgattgatatgggcttaataggtattatatcattatcattagctctaaaaaatattattacattattcagactttgtgctttcgaatgctaccaaaaagatagtgtttgttcaaacatgaacaaagttattgtatttattgtataa

SEQ ID NO: 61452 - DNA, 163 bp, Heterodera glycines
  Genomic contig location: Contig_ID=SeqID_31080; Location=351..513; Strand=-
  SCN-specific regions: Sequence locations=1-11,36-102,124-163
atgcgcggcctccgcaccaccaccagcagcagcgcttggcggagaaggcgggcaccaccgtgctgctgctgcacggcggcgaaccccgcacaaatttttatgccagggcacatttgggccgagtgcttgtcgaccgactggcagtgccgaattgggttggcat

SEQ ID NO: 61453 - DNA, 1715 bp, Heterodera glycines
  Genomic contig location: Contig_ID=SeqID_31081; Location=54..1768; Strand=+
  SCN-specific regions: Sequence locations=1-327,352-449,471-812,835 -903,942-1221,1252-1425,1447-1637,1661-1715
atggacgaagctgagcagacgatgatgaacaacgaagacgaacaaaattgtagcgatcaacccattgttcaacggacaactcaagacgaatacgtcgtctctgaggattggccaaatgccaacaatgttggcacaaaaaaggcacgaaaaagcgaaacaacaacaacaagaaggacaagcgtgaaattgactgctggccaaaaggcattggaggtggtggcgagagttaattgagttatgccatgacaaacagaaattgtctcgagagcagctctcccccgccccgcctatcatttccaccctaaaagcggcttaaaaagggaactgaaaatttttataaaaaaatttaatgaaaaacgcgttgaaaatttttttagcgattttttggacaaatttttgaaaaaatttggtaattaattattaaatttacaaatttcaacaataagaaaaaacaattttaaaagatttttctcaacttgagtgagcctattgaatgcgatttgattgaaacaatttttgacggaatttggtaatttaatgaatgatgtggtgaccattctgcaggcattctcattccaacggcttcgttctgctgctggtccatcatcaacaacaattgaaacttctgctgttgatcaccttcacactgaaccgcaacaacgacaacagcaacgaacatttgctgatcaacaaattcagaacgaacacaattttggactggctgatcaaatcattttaccgaaaaatgaaccaccaaattcacaaaattcggtattttcaaaacagtttttaactgttttatgggccagtcaaaaagaaagataatttgttaaatggcggactcttattgcctttaattttcccataagattcaggccaatgcaatttttggaattttgattcaatttaataaaaatttaaaaaaatcataaaaaaaaattgaagttggatcaaaattaaattattcaggaccgaaatttgcatttgcctgaaacttgttggggacacaacaccttcaaatgaaatcaaaaacagtaaaattgattggatccataaaacagagggaagcaataaaactaatttccatacgatttaattgactactaattgttcagcagcagtactactacgattctgcagcagacgattgttgttgtccatcaacagcagcggaggatgaagcagttgctgctgttggctttgaatttgttggtacttccgccgctgctgctgatgatgaagaatggggttgtacttctccaccaatctcatcacaacagccaatttcacaatgcttttccgtcgtcacaaacacatcggcggcaacaacaagttgctcacaaatgacgcaacaattcatttatgatgaagagcatgacgaatttggtgatgagattgatgataatgacgatgaagcagcaacagcattgtcgtcgtcctcctcttttcgtccacaacaaattgtccatgtcgacatggatgtgttgcgcacaaattttgcacatcgttgtgaacagcagaggcgacagcggcgggagcacaacaatttgttgcggcaaagttgtggaggcaacgatgacggcggcacgcggttgcacgttgtcacaacttctgctggaataatgtcatctggaagtcaggaggaggagagggaggaagacaacgcgtcggtggaacaacgcttgtcaatgatgctgaagttggtcaatcattga

SEQ ID NO: 61454 - DNA, 879 bp, Heterodera glycines
  Genomic contig location: Contig_ID=SeqID_6411; Location=587..1465; Strand=+
  SCN-specific regions: Sequence locations=1-281,355-372,394-631,653 -684,732-879
ccgcttccgcaagcggttccaccaaaacggaggagcgttggctgttcgtcttcaacgatttgctgctgttggccagtgatcggagcgctttcattcgcggcaccaccggtgccggaaagtgcaaattacgcgcaatttttgccgcaaagtttaaaaaaaattttagctaaaaaatttttgggaattttttttttccagacacacccaaatttgtgaaggtgacagcttggagcgtgagcattcattttatttgcggggctccgattcgccgcagggtgatcaattaataatttaccaatattactttaattaattgaaatttttaaatttaaattttcaataattttttttattgggcaactttgagtctagattttcgacttttttatacttcgatttcgattttccgaggccaatttgtgtggtttcgtgaaaacactgaccaactttgggtatcatatcatccaatcaattaaattgatctgcagatttcctaattattcaaattttctctacatttaaccctacctaaaaatttataaaatttcgaaaattctcttcttttttttccaggccctcagcgatgtgtggagttgtgttgtgcttctcaggcagaaaaggacgcactgtttgacattgtttggaaagtcattcaccatgaagtgagttggagttataaaatggaaaattaaatatattttaatgtttaaaaatttttgaaaatttttttagacaaattcaaaaaattcggcggaaacattggccaaaaacacgaacaacaatagcagcaatacagaacagcaacaacagaataaaagttgtgcacattgtgacactgactttggatggtaaagcgattttgggaaaaatgaaaaatta

SEQ ID NO: 61455 - DNA, 997 bp, Heterodera glycines
  Genomic contig location: Contig_ID=SeqID_6412; Location=934..1930; Strand=+
  SCN-specific regions: Sequence locations=1-214,236-325,468-605,645 -677,699-855,893-997
atgaaaagttcggcttcacagttcggcacgcgcatcgaacctattgggtgacatggtaagactacagttcataagtctccttttccaaaaaaatctctctctattccccgcccccccctcccttaattagttttaatgagtcggatcatgtcgaatggatggcggcacttttgctgtcggcaaatgccaaattgccgggcgaaagcgacgcggacgaaagcggcggcggtggaggagaagggcataatcacggaatgcagcagcggaacaacgccaccaacaattacgggggcagaagcacccgcagcagcacaatttgtggtgcaatttatgtttttttgattaatttttaaattataaatttatttttatttcttctacaaaaatataatttttgattttttaattgagaaaaagcaataaaaatacgaatttataaaatttaatttaaaagttttattttaaatgtttcattcaatttaagtaattaaggctcataaattaaatagactaaaataccaaataggggacataaaatacgtactaaaaatgcccgaaatataaattttaaaaccatagaaatccaaaaaatataatttgaagcgataaaaaatttctattttaaattaaatttaaatttttttctcaattaaaaaagttgtatttctcaaagtaataaaacaaaaatgttgacaactaattgcaaatgattccccttttttcagataatctgaggggggctgcagtgatcaattcgccgcgtccaaaaccgtcattttgcgcctcaaacccattcagcggactcattgttcgacgctccgcttccatgggagacgcgcggtaattttcaaaaggaaattattaacaaaaaaaaacaattaaaatttaattaggtaattcatcattaatttttcagaattcgccaaatgactgctcacaatcggaccaccgaaaatggacaaaatgaaaaagacgaaatggcggaaaaaaattgaaa

SEQ ID NO: 61456 - DNA, 370 bp, Heterodera glycines
  Genomic contig location: Contig_ID=SeqID_31082; Location=69..438; Strand=-
  SCN-specific regions: Sequence locations=1-370
atgatgcctcgggtggatttgatttgggtagacatggagaaggtgctcaacgaggagaacagcgtgacgcccgagttcaaaccgtacggcacttgtgccgccatgaaggtgggccagcaaatatgagctggaatcggacaccaaatcccaatcaccaaacctaataaatgcgcgagtctcgcttcttagggtttactgaccacattcaaatctaatcaactccttgggatgattaaacactgataaaattttaccaagcaagtcacgaacctagccgtttgatagcatccattttaggctaactttaaagcctgaaatttttcaggacctgttttctgagattaaaatcctgcatttggctttgatttag

SEQ ID NO: 61457 - DNA, 683 bp, Heterodera glycines
  Genomic contig location: Contig_ID=SeqID_31085; Location=405..1087; Strand=+
  SCN-specific regions: Sequence locations=1-212,235-240,269-472,497 -501,545-683
atgaaagatttgatggcggtcggcaagaaaatgttcggctgtacacgcaaatgcatgagcagcaaggcgggcaactgcgagaagtcgctcaggtggggaacaacaattttcgttttgattgttcagaccgacaaagaaaaacaaaaaaaaagacgagacttttctagagcgagacagaaacaatgcccaaaaatcaacattctgacattggaattttcatttgctttgtcagtggcattcttctgtgttctgttttccccccaaaaaatgccgcatcaaattttgaattgccatgcccaaaaacattgcctttctccgcacattcgtcgttttgtgcaggtgcggcttgaacttaccgccggacaacgtgttggtccagcaggtgaagcggtgcgccatcaacagcggactgaacaccgccaacgcgaaagcgatgtgcaaatgcgcgtccgccgcgggcgttaagtgagtgtaattttaattatttttggtttgtcctcgtaaaaaaaacaattaaatttgattttaattaagttaataatttggttaaataggatgtcactgatcaacagtgactcaacagtcatattcataacgcaatttgtactaattgcctaattactattttaattctttccagaaatttgacgcctgccgtctgcgcaaagatccgagtcacctaa

SEQ ID NO: 61458 - DNA, 304 bp, Heterodera glycines; identical to SEQ ID NO: 53844
  Genomic contig location: Contig_ID=SeqID_31086; Location=234..537; Strand=-
  SCN-specific regions: Sequence locations=1-304

SEQ ID NO: 61459 - DNA, 304 bp, Heterodera glycines; identical to SEQ ID NO: 51570
  Genomic contig location: Contig_ID=SeqID_31086; Location=614..917; Strand=-
  SCN-specific regions: Sequence locations=1-304

SEQ ID NO: 61460 - DNA, 108 bp, Heterodera glycines
  Genomic contig location: Contig_ID=SeqID_31086; Location=1121..1228; Strand=-
  SCN-specific regions: Sequence locations=1-108
gtataaaatttatcaaaaaaagagatagccatttttctgggatagagtataaatttaaaaattccctcaaaaataaaaggtctattgcgcaccgccctccctatcatg

SEQ ID NO: 61461 - DNA, 1028 bp, Heterodera glycines
  Genomic contig location: Contig_ID=SeqID_31087; Location=297..1324; Strand=-
  SCN-specific regions: Sequence locations=1-633,662-666,688-776,799 -801,841-859,1005-1028
  Gene Ontology: Mol. function=store-operated calcium channel activity; Cellular component=rhabdomere; Biological process=light-induced release of calcium, from internal store
cggacgatcgagactcaaaagctgacgatggagaaccaaaagctgacgaccgagactcaaaagctgacgatggagaaccaaaagctgacgaccgagactcaaaagctgacgatggagaaccaaaagcggacgaccgagactcaaaagcttacgaccgagactcaaaagctgacgaccgagactcaaaagctgacgaccgagactcaaaagctgacgatggagaaccaaaagcggacgatcgagactcaaaagctgacgatggagaaccaaaagctgacgaccgagactcaaaagctgacgatggagaaccaaaagcggacgatcgagactcaaaagctgacgatcgagaatcttcagttaaaaattgagaaggaggcaaaacaattgggtaagtgcagcgaattacttacgcccccccccccccttcccctctctctctttgtcactttgtatttttaggtggaagaaaataatgataagagtgattgaagagtggaaagtgtggatttttttaattaatcttttttttcatcgtttttttcttttgttaataagcagggttcagattttggaaaagaaatacgcgaaaatattaaaaattatgttaacatgaaaataccaaaatttttacgctttattttttaataattaaatttaaaatgtgactaaattttcgtttcaataacaatactttttgccaaatatttaagctaaaatttcagtcaaacgctgcaaaaattgttttaatgggcaaaaaatagaaagtcagggccctgcttatgttttttaaaacttttcatcataattattaattttcaattttattatattattttaattgtatggaaacataattctcttttttgtttattttaatttcttattttattaattttttgtttttatctaagaacatttaattgcttttttctatttattattatttttctcgtatttttatgttaattaattttaattgattatcaattatcacttttattttttgttcttaaacctcttctaataaa

SEQ ID NO: 61462 - DNA, 900 bp, Heterodera glycines
  Genomic contig location: Contig_ID=SeqID_31089; Location=234..1133; Strand=-
  SCN-specific regions: Sequence locations=1-407,444-607,629-723,746-900
atgccgaccaatgcccttcattcgaaccgcgcaaattcaatttatctggtaaatttttaaaggataaatacatttgaattaacaaaaacgtctgaatatcaccgaaaagagcaatgataattgtttttttttcgctgttttggtgtcgtccttaaaatttcttttttggtgtcaatttttatcctaggttttttgaaagtattattactaataattagtctatgtttgtctatatttagcctcttgtctacgtgcttcaacgggtaaattcagccgaattccaaccacttatcaatactgcgccaattgaaaacaacctttatggaggaattgcttctattgagggcaacataaacagcgatttatcacttatagtacttgacacaggtaagaactataagattatctaataattttattttattcatattttattattttatgattgattgagatatttggatactttttagaggtcaaaattttgaaagtgccgggccatgagcttagtgcccggcccaaaaagactccttttcagggagccgctcacaacttttgagcctaaagctaattaaaatccacagagggtgggactggagaccaaaaattttctaatcctgaattttctacgctatttttcaaaggttttctgatgggtggaaagtccggcagtcggaaaatcgcatgaacaaaattctagaaatttcttcgttattttttttgctgaaaaaatatttttaattatcgagtttttgttaagcttcatctttaacctacatcgcattggcttatgcaattagaagaaattttcaaatcgacaccaattttgcatatgaattgatggctgcaggaaatgcaagaaatacgactttggggcggtaagcaaaaaaaaaaaataaa

SEQ ID NO: 61463 - DNA, 198 bp, Heterodera glycines
  Genomic contig location: Contig_ID=SeqID_31090; Location=24..221; Strand=+
  SCN-specific regions: Sequence locations=1-24,50-198
atgttacgcatcaaattgtccgttgtgcccggcccgttgctcagcgtgttcgtgcaaaacattgccaagctgtacaccttccaactgtgcaaattggaggcagacgacgattgggacggaattgaatcgttggacaatttgctcacctccaaattgcccgagtaccaatacactgaccatttggaggcgcaagagcgg

SEQ ID NO: 61464 - DNA, 779 bp, Heterodera glycines
  Genomic contig location: Contig_ID=SeqID_6413; Location=1309..2087; Strand=+
  SCN-specific regions: Sequence locations=1-319,342-443,465-519,541-779
atggtacaagcagaagcgataagcgaacgagaaggtggggttgcacttgctgctgcgacaaaaaatgcattatcggaacgcgggagtgaggttgaacaacaacatcagcaagtcgtagtgatggcccgtggaggaacaataagcaatggggatggtgcccgtgcaaaagcagaggccactggtggcgctaaaagtgttgttgaaacgaggattacggaacatcacggtgaagagaggctagctgcagctacagccgtcatacatagagaggaaaggagagaagaaagaagaagaaaaatacgcgtaagaaacagagaccgacaacaaggaggagaagagaggcagcgcggagaaggacataggcagtctcgcccaaacgaaagacacaacgacaactttcacagttcgctacaattgaatttaccgcccaacagaatggaccgaaaggaacaggaggaacacatgcatcattcacgagatggtttgatgggacagtcgaacaatcaacaaggagaagagaggcagcaaggaggaggagggcataggcagtatcgcccaaccgaaagtcacaacgacaactttcacagttcgctgcaattgaatttgccgcctagcagattggaaggaagggaacaggaggaacgcatacatcattctcgagatggtttgatgggacagtcgaacaatcagcaaatgagaaaacgaattcaacgagaatgtttttgcacgtgctaatttttttggtgtttggtattgtatgacttatattaattttctaa

SEQ ID NO: 61465 - DNA, 431 bp, Heterodera glycines
  Genomic contig location: Contig_ID=SeqID_6413; Location=2123..2553; Strand=-
  SCN-specific regions: Sequence locations=1-357,384-431
atgaaagacattgttcttgagcactacgatcatgatggacaaatgtgagtgtgttaattagaccttcttgcaatattaatctgctgctgattatttttagtgatgacgcactatattttgctgattatgatgacactttcgttttttctggctcatcgcgatcgatccgtgttgcttttcctcaaataggccgcaacacttctgctgatttatacacctatcaagcacacaaggattaccgcccccactatgttaaaggacgaataaggcccggaatggagaccctgccttttggtttccgaaatgcgcaacagcaaacacgacacagaacagaacaagatgacgaagaagaaactaatgatgatgatgatgataatgatgatttagaccaagaccgtctttccaatttgcctggttgctctcattggtga

SEQ ID NO: 61466 - DNA, 3877 bp, Heterodera glycines
  Genomic contig location: Contig_ID=SeqID_6413; Location=3166..7042; Strand=-
  SCN-specific regions: Sequence locations=1-1255,1303-1405,1436 -1457,1512-1523,1549-1960,1982-2112,2134-2197,2219-3076,3099 -3210,3232-3877
atggctaaccgaaatccattttctatcgagtctgtgcatgagatgcgcaataggccaaggaacactcggggagaagtggcacaagtgcgttttgtcccgcttgaacaagtccaacgaccggaccgcgtgttggaaatgcttgttgaacaattgtttgcgcgagtgcttggagatcggccaccgccctccttgattggcttacaattgcacccgcccacgtttgagaatccattcacaattgctcttcggcctccagaacaaaaaaatccggccgcaattgctgactatattcaacgtttgaacgatcaatcagcggcaggaatagacttaacagccgggacaacgcttaccaaagttttggctgtttggccaatgcatgatgatcgaacgggaaatggacgtgaaggtaaaagagaccacaatggatgttaattgaatcatttctataggggcgtgttcatgggatcatgaacactccgttgttcacaccgtcaactcattagtccggattcggaatccgaacgacagattgtgcctagcaagagccgttttaattgggttgaaagaccatcgttcgcgccagtaccaaaacacccgagctggacaacaaatgtttaagaattatgttggccaacaacgatttcatgggcctgatgctcgccatctgttacggagagcgggaattaagacgaataaaaatatgtacacgctggatgacgtcagacagcttcagcaatgggttgatgaacgctacgaagaggcacagattcgtctaactgtttttgagaaagtgcgacagtatcgaattgttttcaaaggggcgtctggccgtgctgcttgcttcaacctgtgcctattgttggagaacgcccattttcactatgttgggcgtattgaacaactgttccgttgcacgtcctattgcgttgattgtgaaaggcgggtgactcgttggtatcatccgcaagaatgcaaagttgtttgccgcctttgtctacgctatggtgcaaactacccttgccaacaacaacaatttgccaacggaaggaacagcaaacatttttgtacacagtgccaattcgttttcccagatttggactgctacaactatcatttgtccaatcgcgcaccggccaccttggatgggcgaagcgggcgcgcgttccgttcaatctgcgaatggaggcgtgtttgtcgagcatgtggggggatcgtctataccaatttccaacatgtttgtccaccctcggtccgacaacaacaacaacagcaagaacagcagcagcagcagcagcaacagcaatttgcatcattgtgccaccagtgtgggggacctcatgcggaagatggtccatgttttattcagccaatggatggacgtcgtgtttttgggcaaacacggcgtcaacaaaaacaacaacaacaacagcaacaatcttcagttgaaaactgtttgaatggcaacgatgatgctgccgataaagaagatgataccgatgatgacaatgatgcagaaggcgagtcccagcatggggctgggggtggtggccaccgtcgccaagcttctcaaaaaacaattagatattgtttcttcgatgctgaaacatctcaggacaggccattacaacttcgaacacaaattccgcaaaaacatgttccgcttttgattattgctcaagtgatttgcgagcgctgcattgccgatagaattaccatttacggcggtattggacagaaggcgaatggttgtgtttgtggcatgccatcagggccacggggccgtctttggtgtagcccgccctttcgtaacgcaccaaatgacgacactgagatgccaacaaacatcacatataatcctagacgtcttttcttccactgctttgaagacgcaaccaaaaacccagtggaccagtttcttgacttcctcatctcaacaggccctcgaaaatcgcatactatttgtttgtctcacaatggtggaaaatacgacatgcatctggttttggaggcactacatcatcgaaatttacccccaaaacgaatctgcacaacggggctaaaaatttactcaatgtcgcttaaaggaaatcttcagcgccaaataacctttaaagacacactcaattttttcttctgtgaacttgacgccctgccaagaacgttcaatttgccaaatgaaattgcaactgccaagccgttttttccatatttatttattcgccaccaaaatttgaatgttcgcctccaagggctgccaaatgctgtattctatcaaccagaccacatgaaaacggccaaacgcgaacaatttttgagttggtatgcttatgaaggagcagtcgccaaatttcagctcagagaacaacttataatttattgtgcgaatgatgtagctatcctgcgtgaaagtgtgctgaaatttcgccaattgatcatggagaataccatgggcttggatccatttgttattgcatctacgggtgcagcacttgcgttggcaacctttcgacgttgttttctgtctcgcaataaactgatcaacacacctgagggcggttatttacgaggaagacgcgcatcggcagaatccgcacgatacattcgcatgtatgaactgatgaacccgggtgtgcacgttcaatcggcgcaatggactgtgggggaagcgcatgttgaggattctggttatcgattggatggattacatgttcgtctacctcctctgcgaaatatagcgattgaatacatgggctgtttttatcatggtagtattaattgagttaaatgcgtatgaaaaagaataataattctcagggtgtcccaaatgttttccaaacgatcgtcaacaaactttggctggcggtagatctgctgaagagttgtatgaacgtacacaacgccgcctttgggagctagaacacacgcacgggttcgagcttcacgttgtttggggatgtgagttgaagaaaagtttgcgggccaatccagtgcttcggcaaatgtacaatgacgccttcgttcctcgcccgttggatccacgtgaggatgccctgcgtggagggcgcacagagccatttactctccaacacatttgcactaacgatgaggaaattgttctcatcgatattgtttgtcatacacaacagtgaagcaaacataatagcattttaattcaaggtgagtctctacccttacgtgatgaaggcatttgattttcctgttggaaatcctcgtgtgcttacacgtgaagtgcttttacaacctccggcatctccattaccatggagaaacgcaaactgcaatacatttcgagggctgctgtttgtttgtgttttgccgccagatccggttctaagccctcttcgtatcccgctgctaccatatcggacaaatgatgggcgcctgacttttcctctctgtgctcgttgtgctgataatcgccaacagcgcgcatgtgcacatacagatcatttacgttcttggaacgctgcgtatgaccccccccccccccccgctcatcgattggtttatacacttaggtacacacatgttgaactaaacaaagcgcttgaactcggatataccgtaaccgatctgtttgaggtaactcgataaatttgaaaaaaagttgtaaaaaaaaaataaaatataggtttggcattatgatgaatgggatgctgaaatgtttcgtggttatatgaacacatttgtgggcatgaaagttcaagcaagtggatggcctactggttgtgaaagcgaagaacgtcgcgatgactatattgacgagtttgagcgtgccgaaggaatacgactcgaccgtggaaaaattgcaaataatcctggtcttcgaatggttgcggtaacatgccttgagtaa

SEQ ID NO: 61467 - DNA, 619 bp, Heterodera glycines
  Genomic contig location: Contig_ID=SeqID_6413; Location=7134..7752; Strand=-
  SCN-specific regions: Sequence locations=1-153,207-489,511-527,577-619
atgcctccaagcgaaaatttttcaaatatctcgctagattttaatgatttggaagctcgaccgctgcctgagccccaacaacccgaacaacaacaagctgaattattgattcagattttggatgttgaggaggctttgcttttcaacgttcatgagggagaagaaagaggagaagaagaggaagaagatgaagaagaagaagaggattttgtgcaatttgaagaattgatgcgtttacatgccgagtatgtagcgcaaattttcaatgaaattgatgatgatgaaataaacaatgaatgatttttttgaataatcgatgatgaccgaaaaatggattctgttataagctccgccccttttgctgtaaatttatttgttattccgcttcttcgttcgaatgaggtcattaacatttaaaataaaaaaatgcgccaaaaatccatccccaaaaaaactgcttccagttactctgaacgcctaaaaaaattcgcaaatgaccaagtggaaaaagcgatgtccgaaattgaggaagagaaaaaacagaagaagaagccgaagaagcaacacaacaaaaaataaattcggagccatcgactagcgcatccctttgaccaataaa

SEQ ID NO: 61468 - DNA, 297 bp, Heterodera glycines
  Genomic contig location: Contig_ID=SeqID_31092; Location=1469..1765; Strand=+
  SCN-specific regions: Sequence locations=1-270,293-297
atgggtgaacaaaatatactaattaggctaaggatttatcgttataaaaattcacagagtttgaacaagtttgatatagtaagtgtcgaaaatttttggaattttgcaggcacttagtccttatgccaaaatattttccttaaatttaatgccattctgaaacgatgaacaaagatacaatatcttaaattcatgagatttttgtaacgttaaatccgtcctcatatatcattgtaatacgtttgtgtgaaataataactagagctgtaattaaagtcatttctttaaaaaattaga

SEQ ID NO: 61469 - DNA, 59 bp, Heterodera glycines; identical to SEQ ID NO: 52421
  Genomic contig location: Contig_ID=SeqID_31094; Location=60..118; Strand=-
  SCN-specific regions: Sequence locations=1-59

SEQ ID NO: 61470 - DNA, 59 bp, Heterodera glycines; identical to SEQ ID NO: 52422
  Genomic contig location: Contig_ID=SeqID_31094; Location=190..248; Strand=-
  SCN-specific regions: Sequence locations=1-59

SEQ ID NO: 61471 - DNA, 59 bp, Heterodera glycines; identical to SEQ ID NO: 52422
  Genomic contig location: Contig_ID=SeqID_31094; Location=320..378; Strand=-
  SCN-specific regions: Sequence locations=1-59

SEQ ID NO: 61472 - DNA, 59 bp, Heterodera glycines; identical to SEQ ID NO: 52421
  Genomic contig location: Contig_ID=SeqID_31094; Location=450..508; Strand=-
  SCN-specific regions: Sequence locations=1-59

SEQ ID NO: 61473 - DNA, 59 bp, Heterodera glycines; identical to SEQ ID NO: 52421
  Genomic contig location: Contig_ID=SeqID_31094; Location=710..768; Strand=-
  SCN-specific regions: Sequence locations=1-59

SEQ ID NO: 61474 - DNA, 59 bp, Heterodera glycines; identical to SEQ ID NO: 52422
  Genomic contig location: Contig_ID=SeqID_31094; Location=840..898; Strand=-
  SCN-specific regions: Sequence locations=1-59

SEQ ID NO: 61475 - DNA, 59 bp, Heterodera glycines
  Genomic contig location: Contig_ID=SeqID_31094; Location=970..1028; Strand=-
  SCN-specific regions: Sequence locations=1-59
aacatttgccttctctagtctggctctaacaaacactcacacgatatttgaaatgctaa

SEQ ID NO: 61476 - DNA, 72 bp, Heterodera glycines
  Genomic contig location: Contig_ID=SeqID_31095; Location=161..232; Strand=-
  SCN-specific regions: Sequence locations=1-45,67-72
atggtcacccacgcgtacagtgagctggccaacaaaattttgcaccgtaacggaatgaatttggagtgtacg

SEQ ID NO: 61477 - DNA, 1109 bp, Heterodera glycines; identical to SEQ ID NO: 31095
  Genomic contig location: Contig_ID=SeqID_31095; Location=1..1109; Strand=+
  SCN-specific regions: Sequence locations=1-13,38-135,157-166,188 -266,298-344,425-470,503-743,774-854,882-886,925-1010,1057-1109

SEQ ID NO: 61478 - DNA, 753 bp, Heterodera glycines
  Genomic contig location: Contig_ID=SeqID_31096; Location=125..877; Strand=-
  SCN-specific regions: Sequence locations=1-519,542-633,656-753
atggcacgatgtgtcacatcgctagcgtttctcccaattggagatttgacccctggaatcattgctctggacatggctcttcccgacgaacttactcccgtccttgactggtaaattgacaatctcagaaattgtttactatttattgttctttaattattcattaggttcatcatgaactacacgggtcgtcttaagcatgatggaagccgaacacgcccgcgatttgacccgaacatttggagtgtttacactcgaacactgcaaagcgatgaccggacgaataaccattcagaagccgcgaacagacgcctgcaatgtgcatttgcctgttcacatccatcgatttggcgtttcattgaccttctgcgaaaggatcaaaagttatccgatgatgacttcgcgaagtgttcaactggacaagaaccaccgcaaaaggcaaagaaatatcgcaaagcagaccgccgaattctcacgatggttcaaaattatttaccacttaacaacggagaccccaatacttttccacttcatcagccttttaaccatcaatttatcattgcttttttgtccggaatttctcgcaattatgagatgataccatgatttgaaactgataaaaagtgtttttttatttaaatgttttaagctcaatatttactactagggaactgatttttagggatgaaaaaacttatcaatttttacggaaatttttcgaaaattttttggtaaggaaatgaaccaaataaa

SEQ ID NO: 61479 - DNA, 988 bp, Heterodera glycines
  misc_feature (13)..(14): n is a, c, g, or t
  misc_feature (18)..(18): n is a, c, g, or t
  misc_feature (23)..(25): n is a, c, g, or t
  misc_feature (27)..(28): n is a, c, g, or t
  misc_feature (46)..(46): n is a, c, g, or t
  misc_feature (52)..(52): n is a, c, g, or t
  misc_feature (54)..(54): n is a, c, g, or t
  misc_feature (87)..(89): n is a, c, g, or t
  misc_feature (111)..(112): n is a, c, g, or t
  misc_feature (114)..(115): n is a, c, g, or t
  misc_feature (121)..(121): n is a, c, g, or t
  misc_feature (127)..(127): n is a, c, g, or t
  misc_feature (158)..(158): n is a, c, g, or t
  misc_feature (197)..(198): n is a, c, g, or t
  misc_feature (200)..(200): n is a, c, g, or t
  misc_feature (202)..(202): n is a, c, g, or t
  Genomic contig location: Contig_ID=SeqID_31097; Location=91..1078; Strand=+
  SCN-specific regions: Sequence locations=1-496,519-988
gcgccaaagcaanngganagcannnanncaaaagaagccaaaagangagccnancgaaaaggaggagaatcagcaaaaggcgagcannnccgacaagaaaaaacaacgccnnannaacggngagccnccagcgcgccgagaacgagcgcgagaacccncacacgccccagcgaaagcggacggaagcgacccgaaanncngncaacaaaagtcagccgatgacaccgctgaatccagcaacgaaatcaggtcattggtggcggaaccacggaaggacaccacggacaataacacgacaaacgcagcatttaccgactcggaggaggagggggaagacagttcgtgcggcgttgggtttatgagttgcgcttctttggccaccccttcttcggctgaatgcgcttcggcaccgaaacggcgacgagtgattttgtcatctgacgacgaagaagagaaaatgatgggaaatggacagagaaaagaccaaaagggggacgaaacggagaatgaaccccaaagacaggcgacgaagcgaaagcgaagggacgcggcgaaagaagcgaaggaaaggacgcctccttccgttgcccgtgtcccacgggacgaaatacagacgacgccttcggcaaaatgtgcacattcattcatcaattcatttgtatgccatctataattaagaattaatatcttttttatcctttttccaattcattacagagcatcgactcaccaaacgcttcttccgtgcagttgcccttttcatcgcttcagattcaaccaaaaaacttgaaaaaccgcaacaaaaatgaccaaatcgcagagagcgcaaacgacggtgatgaggaagccgaacgtttccctcacttggactttgactttcttcgcactgaaaaaatcaaagacgccaaaggacgaaagcccaatcacccggaatttgatgaacgcactttgtttgtgccggaacattttttgaagagccaaacgccgg

SEQ ID NO: 61480 - DNA, 419 bp, Heterodera glycines
  Genomic contig location: Contig_ID=SeqID_31098; Location=319..737; Strand=-
  SCN-specific regions: Sequence locations=1-419
atggcccctctcttccatcgcttctcatctctctttgtccttctgatgccgttcctttccgttgtgcttctcccgtcaactgtttgtaccggctctgacagtgccgccgcgccgttcgaccgaaagaattatccgaaaatcgatttgcgagtaattaaacgcctaattagcatattaaaaacaatcaaaaatcccctttttagctgttcgagtggcccattgcttcacattcgggctcgtccgctgaggtctcttttatcgccgtcgactgctacacccaattggaccgttctttcatctcgaccgatgccgtgctccgtctcaacaattcgttagcacttcggcaccgagcctgtctcttgcgcattccgacggggacgcggctgacagtgaccgaaatgcaaacgaccaacagaaag

SEQ ID NO: 61481 - DNA, 1433 bp, Heterodera glycines
  misc_feature (34)..(34): n is a, c, g, or t
  Genomic contig location: Contig_ID=SeqID_6415; Location=1..1433; Strand=-
  SCN-specific regions: Sequence locations=1-12,34-111,137-209,231 -564,589-669,691-1198,1234-1313,1407-1433
  Gene Ontology: Mol. function=DNA topoisomerase activity; Cellular component=nucleus; Biological process=electron transport
catgctaaaatgcttttaaaattttcaaaatttnttttcttttaaactaacttacaaattagagaacccaaaacaatcattttccatcaaaaaatccgttttttacataccaacaatgagagaagagtatgaaaaacaggcctaatttggtgtactacacccctcctcccccgaaaaatttttacatgagatttttctaaaaaaaaataaacattttgccacagaaatgcgtggccgccacggtgtgcgacgtgtcctccaaagagcaccgcaaggagaagccggaggcactgcacacggtcgaactgttgcgggtggcgtccaccgcgttgggactgtctcccgcgcaaaccatggctgttgcggaacacttgtacacccgcggatacataaggtggacgggcgggcactttggttgaaccgcttgtgccgcgcctgtctggttgctcgagactctcgacgcctttcccatattccctctgaaactcatttgggttctcgaatttctgatgctggcactgactcagtgcagtcggttggctataaacagtggagagcttcgaattttaaaacatttaaaattgatttgttttccgatcagttttattttctatcaatttttatattttgaccggcctttttgggtgatgatcaaaatcattcgatcactttcaattcttttaatattttgatcagctatttttggatgatcaaaatcgccgcctctcatcattctgctgtgatcatttccactgatctatgatggtgtttattaattggctttctgttgattgctgattagactaattagtcccctgctaatcgactcccagcaaaagtgccatccttattttttctatcgccgctcagttacccgcggacggagaccaccgcgtacccggacagtttcgactttgtcggcgctctgcgcgagttggccaaaggccaacgctttgtggacacggccattcagctgttgagggaaggcattgcgcggccccggggcggcacgaacaaaggcgaccacccgcccatcacaccgatgaaagcggccgacggatggctgagcggaggtgcgcgacgggcgacggaattttgcgaaaattttaaatttcttgaatttttttctctgatgaaattctccgtttatccatcgtaaggccgtatttacaaattctcgtaagaaaagaatacctacatatattttttaaatatttcttcaaaattttttttgctgaaaatttttatagtaatctccacaaattttaagaaaattgtcagttttttgcctctcaccccttctgctgattgggttaatttaaaaaaataataaaattattcataatttttattccctttttcatttttgagttaattttatatatttttgaaaataaaaaataattctttcggcaaattgttttgactctaga

SEQ ID NO: 61482 - DNA, 2141 bp, Heterodera glycines
  Genomic contig location: Contig_ID=SeqID_6416; Location=119..2259; Strand=-
  SCN-specific regions: Sequence locations=1-89,111-220,242-500,522 -1009,1054-1188,1258-1398,1449-1458,1482-1523,1562-1862,1968-2141
  Gene Ontology: Mol. function=DNA topoisomerase activity; Cellular component=nucleus; Biological process=chromosome organization and biogenesis (sensu Eukarya)
atgagtgagtaattaagcgttagttgcttcgaatgatagggttttcgaggactaacttcacaatactcttgacagagactgtagctttcaattgaaccccaaaaaggggagtctcttctcgggtaaaaactcgagaatccatttgaaaatattcaagagttaaatttcacaagaccgacatttggcacccgaatgttgagacacgaaaaaaccatagaaaataatgactcatcaacatttttctcgggtcgagactcttgatcagcatcactattaattaagcttggtgttgctaattgattcaagtttttttaatttaaaatttctccttttatttgtttttttgggggtccgccagtggcaattatttcccaattggctcaaaactgcgcatttttcatacaaaatgagaggaacgcagatcctgcttaatccttcacccgagaccaagactctcgaacagcgcaccactaattgagcttggtaactaatcattcatcatttcttctcattcattgaaattctgtttttttaacccgccgataataattattgttcagtccgtttcctttttagcttctcatcattctcttttccgtccttttttatttctgcctcaatcagactcttcattaattagctcattaaacataattgttgtccagcactgaattaattgttcgagtcgattaaaatgctttttttacttttatatattttggcgatgagtttattaatgaaaatttgaaatgtttaacaatttgttggaggagtcagaaatattttacgaacgcttttattttttttcgaattttttcgtttttgctttaatatatatttttttatcgctcctaacccttaaaaaattaaattaattgacttattgttaatctaaggtgttgttgcgcaatgaatgtgctaatggtggccgaaaagcctattttggcggaggcaatcgccaaaattttgtccaacggaaaatgccacactcggaaaggcatggcacggcataataaaattaaatttaaactaattaattttaaattaatttttgccccattttgccaggatggaacggcgcctgctcagtgtccgagtacaaagcatcgtttcggggaaaacaggccaatttccgggtcacttccacctgtgggcatgtgatgtgtaagtgccgggataataaattggaaatttttaagaaatatttcaaaaattaattttccgtttaaaatttaaaaatttgattttaaattaaatcgggagatttaaacaaaacttaaagctttgtcctttatttatccttatttaagatgtttggacaattgaaaaacttcattttttgaatttaccaattttcttagcaaatttttaatgttttaaatttgtccggcatttactaaatttttgaaaaatttgcttttaaaagcaaaaattttctgtgtttgaaactttttgtcatttcttttataaaagaaaaatcagaaacctttatttaatgaattttttttgaattttttggcctgtttttaaatatttaatttttcgaaattttaatttttaaggcgtcgatttccccgcccgttacaattcgtgggatcgcactgacccggccgagctgtttctgtgcaacattgagcaaaaagaggcaaatccgaagctgaaaatgccggaggtatttatttgtttttttttgcaaaaaatgccattaatttgcatttaattgacaaaaatgccgaaaaatcagggagaattttacggcattatatttatcttttcaaatttttttgaaaattttcccgttttcaccccctttaacatcaaaaaattccataatttttcattttctttttcgcaaaatgtccatttaaatttttttaaatctttgatttttaccatttatttttaaaatttaatttttccatttttaaaattaatttttattattttttaaattaattaaattaaatcaattgtcgtcctcctcagtttctcgcctctgaggccaaacattgcgatatgcttgtgctgtggctcgactgtgacaaggagggcgagaacatttgcttcgaagtcgtcgacgccgtgcggccggcgatgcgcggcgcgggcggcgccaattttatggacgcggcggtgttccg

SEQ ID NO: 61483 - DNA, 646 bp, Heterodera glycines
  Genomic contig location: Contig_ID=SeqID_6416; Location=2275..2920; Strand=+
  SCN-specific regions: Sequence locations=1-3,25-239,261-321,345-646
atgacatttttgtgtgattattttctccacgtgatggcatatttaaaaatagcatttccatacttttttaatgcggaaaggtgggaattgctggaaacggaggtgtttggtgagcagtgaaatttacacaattatcggtgaagattggttggtgaagttgccggatcggacggccgacacaaaccatcgaaggcctaataatgtggggaacgggggaggggagggggggggggatatgcgaaagatggaaatcaacgaacgatggatataaaaaagtggccaataaggttgtggatagcacacactttacttttctgtaatttgtttaaaaaatattgttttttgatcggaggcgacagattgtgagatgatcggtgtaaaaagcggtgggatgggaacattgcacgaacggccaagtttttgccggctttaaaatgatttgttgttggaaaatggatttcattttgagcaatttgtggaggagtggagtcgtacagcagttcattctcctctcctagtcgtaccatcccctgcttctattcgcatttctttaaacaattacatattcaatttgattattcattttttttaaattttagttcattgcttcatcctcttcggctatactgttcttgaactttgttga

SEQ ID NO: 61484 - DNA, 484 bp, Heterodera glycines
  Genomic contig location: Contig_ID=SeqID_6417; Location=878..1361; Strand=+
  SCN-specific regions: Sequence locations=1-51,90-287,318-484
atggtgaaagtgaattttgtcgaccaattgtttgcgggtaagttgtataagatttaaacatttaattttataatttcataatttatttaggcattgtcggaattgccaattcaatcgaacgctttgggggaccgttcccgagtttggatgtgttcggccttaaccgccacgacccaaattatgtaagtttaacacctgtcatgcagcgatctcaactgatttaaaatttcggcaatttatgccgcaattttgtgtgtgcttataattcaccccccccccccctccctcatccattttgcagggtttttgtattaacgaatttcgttgttaatggtacatattttaggcgaaccgcgtgatgaaagaagccgccgcaattgtcgatgattgctgcgactctcagctgtcaactgcggctgatattaatatgctttctgtctgagtgtgagttcatttttttgtaaaatattaatggttttggtaa

SEQ ID NO: 61485 - DNA, 731 bp, Heterodera glycines
  Genomic contig location: Contig_ID=SeqID_31103; Location=406..1136; Strand=+
  SCN-specific regions: Sequence locations=1-99,141-672,695-731
atgcagcatgagcctgcggacccgcatttccctaaacgaaagaagcatcaagtgaattttgtcactgcaaaagtggcatgtccggattgcatttcgaccggaaaatggaaagaaagccttcttggaaaattctgcaaaatctgcggctatcatcggacaataacattcagtcaaatgccgttccgtgagacaacggtcgacagacaaacaattgaccgccaccctcttgttgcattcgttaaatggcttctctacaaacttccaaagcaatacgaaacaattgcctattcccatttcgggggacgtttcgacatggtcttggtctttcgggaacttttcatggagggactgaacccctcaatgatcagaaagggaaaccgtctgttcgagatgagggtataattttccatgtgtttatttaatcattttcccatctcaggtgaaaagcagaaagaacttaaacccgaatgtgacatttcgtgattcttggaatttgattcctggaccgctcgcctcaatggtgcccatgttcggcttggacgtgcaggacaagcccttctttccacacatggccaacaaacctgacaattatggatgccaaatttttccgtcgaaagcagattacctggccgacggaatgaaccagagaaacggaacaatttgatcaatggtaccagcaaaacaaaaatatttcgtttctgctggatgagtcattggcaaggtgattatga

SEQ ID NO: 61486 - DNA, 1095 bp, Heterodera glycines
  Genomic contig location: Contig_ID=SeqID_31104; Location=101..1195; Strand=+
  SCN-specific regions: Sequence locations=1-355,379-845,876-1095
atgtggtaattaaaaatcagagctatgacaataaaagcattcattccattttcagttacattgatcactccgtcatcgcttttcttcgttcaaatcaccaaattttcgacaaaagaggcacctatttatatttgtggattccatcaccacacaacacggatggccaactaatttgggacatttttggtcgtgaaatttggccaattttttctgaaaacattcgccacttgggctttaacgatggtgttgatttggacaatttgcttcgtcgcacttcgccgacaattctcaccgatctcaaccaattgacttcaatcgattcctgtgatttgtcgcccgaggcgattggtggtgattttgatgggccaaatgcaacaatttctgctggccaagcattgtccaaatggttgcactctccgagaaaagatggacaacccaaacgattgcgttgcgatgattacaacgaacaaacggacttagattggattaacaatttcaaggaggtgtggccataatctcgaaaaatcactgatttttgttttcaaattgtttagcattttctccgtgccaatgccatttcttccgtcagttaccaaattcattttgctgttcatgcgctgtcaatacaaattgtgccatttgaattggtgaacgaatggacaaaggaaaagctgacattggccaaagcaaagggatgggacaaccgatggataatgaaacgatgcaaaattattggggagacggcagcggtcaattgggaagacggaaattgggacaacaattgtaacagtgtcttcgtttggctttttcgtactgattgcatcgggtgagcaattaaaaaaggcatttaattttgtttaaataattaaaattttgcctaatttaggccattgtctccgccaccagcagaagaagccggacaaaacatcacaaaagggccgtcatctgaactgacaatgagtgatggacaaacgaacaaaaacagtgatcagccgcagaaggaatgaatgaattgagaatgatcgaccgagcataattcaaatcagtgatcaaatgtatcttataagaaaaaacctctcaaatatgtatatgtaa

SEQ ID NO: 61487 - DNA, 554 bp, Heterodera glycines
  Genomic contig location: Contig_ID=SeqID_31108; Location=274..827; Strand=+
  SCN-specific regions: Sequence locations=1-134,160-167,199-388,410 -504,552-554
atggataatttgcttactgatttttggctcataaagtaagtgaattcattagagcccgccggcggggagaaatcggaaaaatacaaaaacatttttaatcccatggatttcgttcgccctctcatcgatggagattttgtttttgttttggtgttaatttacttagtttattattattgttattattattttaattatattttgtttgtctgtctttcactctcctctttttgaattgtctctcgtcgatcccgcccccgagagtctcgaggcgacacaaaattcattcgttgtttattgatccgtggagaatgaattttttgtgtgatcgagaagcatttgcattttatgacccatttttagcggcttaacaattccagcgcccaatttatttattacatttgaatttgccattttatctgggctcagtgtttccggaacatacattatggaaattagtttcaaggacgtccttccgttagcattcaaggacaaagctgagcctttttttataatattcatttttgtttatttttaattctaattttattgta

SEQ ID NO: 61488 - DNA, 703 bp, Heterodera glycines
  Genomic contig location: Contig_ID=SeqID_31109; Location=129..831; Strand=-
  SCN-specific regions: Sequence locations=1-39,74-703
atgtacagacgtggaaacaaccgacaaaacaacccaggtaataatttaaaatgttcattataaaacttaatttgggacttaaaaacaaaaaatgttaaaactgagaaccgattttctggataaatgcttaatgtttttcgtgcgtttcaggccacggggagctcagaaaaaataggcttttgcctaaaaatcccatcccttgttataaccgaattttgttttttctttttaagcgtcatttaatttgcagaaatttacgcccctgtctccgacttttgtggctttatcgcgtccgtcgccggctcgagagtgaagtgcatcgacccttacaatgctattacaatggcaaagcgtaaaaaggtgaccccataaggagaaggcgatgcttataggatcaagtttgtctatccacagacgattttggtatcatcgccttcctatgtattgtttgaatcaaataatatatgggcataatcgaatgttaccagtgaactgtcacaagtattgcgcactgccatcgaagatgctttcatacatggactcagagacgctttttttctcaagggttcacggcactcgaatcggccatccccagcaacaaaatggagaattggaattgtgtctcaaagataatttatcgggtaaatcgagggataaattgaaatttatgcccactttggggaaatgacttttaacaaataaa

SEQ ID NO: 61489 - DNA, 911 bp, Heterodera glycines
  misc_feature (862)..(863): n is a, c, g, or t
  Genomic contig location: Contig_ID=SeqID_31110; Location=55..965; Strand=-
  SCN-specific regions: Sequence locations=1-325,347-737,759-911
ggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatnngaactcgaaatggttatgttttggtcgaaatatccttacataatactc

SEQ ID NO: 61490 - DNA, 1631 bp, Heterodera glycines
  misc_feature (1524)..(1524): n is a, c, g, or t
  misc_feature (1532)..(1532): n is a, c, g, or t
  Genomic contig location: Contig_ID=SeqID_31111; Location=215..1845; Strand=-
  SCN-specific regions: Sequence locations=1-48,168-260,283-283,310 -395,420-641,665-779,861-1201,1223-1246,1313-1334,1358-1378,1400 -1423,1499-1573,1597-1631
atggtaaaaggaaataaaccgaaattaattttaaaattgcgccaaaatggaggagaattgaacaagcaaaaggaagaaaaggaaaaagaggaaacagagaatgatcaaaaaaaggaagaacaggaaaaagtagcggatgatgaacaaagggagggaaaaagggaggaaaattgggaaaatgcgaataaattccattggagaataattggagatgaggatgatgaatttacactggaaaaggaaggcattgagcaaaagcaaaaagtaagtgggcctgggtttttgaaattgttttaaaaagtaattaaagatataaaaaattctgttaaactttaattgacgataactattctttttttatccattaagctattttaagctgaaataagaacaataagaaatttgaaaaatttatccacaaaatccaattttttcttgaaaaacttggacacagaaaattgccttaactttgagctggatccagggaaaattccttgtcttggccaaacttttgttgtttttataatttgcctaaaaaacaaaaaaatatattctcatttagcatgtttcgtgtccagcaaaatctttgtcaattgaacaaataagaaaaaaagacgaaaaagaaattcccgaaggtaatttcattgttttctttttaattttaaactgtctttagagttattgcttgcgttgttgaaacgccttttaattgaatatctgaaaagcgatttaaatgagtcaggccaaatgagcattttatttacattggtgagcaattgaaaaaaaaaatttatttttaaattgccaatttgtactttttgattaaaagaaataattttttgattttatttatttatttactaattgctaatcatcctcaagttcgagtattactgctccatttggtatttgaatggcattgcgcacaaaacactgaaagttatggagcgaatggcgccgaaagggtcggattttgaaaaagaagtggcaaaattgaaggagcatcacagggaaatgaatgacaattttgaatttgatcagcgagggatgacggatcagcagcagagggcggagtttgtgaacaagtcaatgctgatcagagtgttccgtttccttgaacacatcgccaacaacaaaacgttgattgaaaacagcgcagattggaacgcatacagagaggaatacatggaaaaatgggtaaaaaacagaggagggaagtgagagaagatatagagaaatgaataatagggaaagagggagagagagacagagagaaaaaggaataataatgagaggaacagagagagagagataacgtgaaaataacatgagattgagaggagaaagaagagagataatgtgaaaataacatgagacttgagagaagaaagaagagagataatgtgaaaataacatgagacttgagagaagaaagagagagagagatagagagaaagagtcagcgaaagagtgcgagagataaagagtgagggagagaatttttttgtttgtcttttcatttanatcggctntgaattttgaatgacaaaattatttgaaatcacaatttcagagaaattaaaaagagaaaaatggactttatatggctgaaaagcacaaatcctaattaa

SEQ ID NO: 61491 - DNA, 180 bp, Heterodera glycines
  Genomic contig location: Contig_ID=SeqID_6418; Location=1..180; Strand=-
  SCN-specific regions: Sequence locations=1-180
ccgggactgaaatgtcccgctcaggccaaaaaatttttctatttccgggaaaaaatcgaaatttttccaaaaaaattaccaatcgatagagctcgaaaaactatgttttggaagtggtctccgtttttctgggaaaattcgttaaaaattcctaaaattcaaaaacccgaaaatcgtttt

SEQ ID NO: 61492 - DNA, 1420 bp, Heterodera glycines
  Genomic contig location: Contig_ID=SeqID_6419; Location=4013..5432; Strand=+
  SCN-specific regions: Sequence locations=1-554,576-1420
atgacaaaaaaacaagaagctaaaagaaagaatgatcaggagcgataccgacggcggacggagcaatctgtcagcccaggtcgctcacccgtcccagacggaagtgcagatgggaatggagaggcatctgcatctctccggggcaccaccaccccaagtttaagtgctttgcaaataagcacacctgcttcttccattggaagtaaaaaaaggggaagacccttgaaagcaggagcgaagccaattttggcaacgcaagaaactgtgtcctcaattgacacacctcgaactgctgtcacccaaagtgaccaaggttcgccgtgcaaaaaaaggggaaaggtcaccgagtgtgacaaacccacgtttgcaaatgaagctattgcttcaacgcctgtttcgactcaaagtcgtggagggcgacctgccaaaaaaattggtggcccaggccgaggcaaactcagtgattccatgagcaaaagctctgaaatggatatcaatcttgaaaatgccccaattccggcaacctcgcacactgtgtctgaaaaaattgacttcagcactgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttataaaaatatgacatttgggtacgaccctaatgttccggcagaagttatacttttgccagtacatttccctgcacattggactctcattgtccatgatgtgcaatttggcactcattttgccgattctttgcctaccacatatggcaggttggatccgcaactgacggataaaattaaaaatatcatttcggatattttgccgtcagcagtgttggaagggattgttgatgtcgaaaatctgacggtccaacacgatggtaatagttgtgggtactttgtgtgcctgtatgctgagtcatggcttatgaacaatcgcacatttgttctgcctgatttatccatcaattatgaaaagaagcgtattttatggcacattaacgagctgtatggctctgataatgtgccatatcatccaagggaaggggtgccaactccttgcccaattgtctatcgacatgcggatgaagcgcagtcgacatccatgacggtagcgccaatggaagttgatggtaacgatgacatcatgatcatcgaaccacagacgagtggacaggcacttaatgtcattccaacccaaacccaagtggcag

SEQ ID NO: 61493 - DNA, 92 bp, Heterodera glycines
  Genomic contig location: Contig_ID=SeqID_6419; Location=627..718; Strand=+
  SCN-specific regions: Sequence locations=1-92
acattgacgaaaatgccgacactttgatcgaatcggagggatttttgcaaattgaccaaaaaatgttgtgcgaaattttggaacgcgacgaa

SEQ ID NO: 61494 - DNA, 57 bp, Heterodera glycines
  Genomic contig location: Contig_ID=SeqID_31113; Location=646..702; Strand=+
  SCN-specific regions: Sequence locations=1-57
agagcccgtgaacgagctgaatcggatgcgagtaccgccgttgctgtacgcctaacg

SEQ ID NO: 61495 - DNA, 491 bp, Heterodera glycines
  Genomic contig location: Contig_ID=SeqID_31116; Location=221..711; Strand=+
  SCN-specific regions: Sequence locations=1-73,104-374,396-400,422-491
atggctgatttaaagaaaatgaaaagagatacagaggcagagaaaacgtgagtaaatagagcaaagttaggactataaaaattataagaaaaaaattttattacttcaaaaatgaattattggagggccgagtctagaccatcaaataacaaaatgttttaaaagtggttttggaaattccgaatttaattaagctaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaattcgagaaaaattagtgggccaattttcaatttttgcatggtcgggaaaaaatactaaaaaaattgaataagcaa

SEQ ID NO: 61496 - DNA, 84 bp, Heterodera glycines
  Genomic contig location: Contig_ID=SeqID_31116; Location=896..979; Strand=+
  SCN-specific regions: Sequence locations=1-84
atgcatttgcctgttccgctccatctccgccccattgtccgctttctgctgccccttcgccttcccccgctgttgcgttgcccg

SEQ ID NO: 61497 - DNA, 1532 bp, Heterodera glycines
  misc_feature (1458)..(1458): n is a, c, g, or t
  misc_feature (1471)..(1471): n is a, c, g, or t
  Genomic contig location: Contig_ID=SeqID_31117; Location=202..1733; Strand=+
  SCN-specific regions: Sequence locations=1-378,410-629,672-1129,1202 -1256,1304-1329,1351-1532
atgtggcatcaatggttctacaggcatagcatttacacgaaaagtgatagccaattggaaccgcatgaagacgataaaaaaccgccaaattttaatgtgatgccaactgagcaaatgctaattgacattttcgaggcgttaattaatgaacgcaattggggccaattaaagagacaaaaattagcgatcatttacaaaattggcaacgtgttggagcgagctttgcatgatgatccgatcaaaacattgaaatgcatgcataattgtgaaggttatggaccaaaaatgatggaaatggtcaaagatttttgtgaaaaagattataaccgaaaatggacaggagaacaccaaaagtaatgaatgtgacttataaagtgcaaataaaattttgttttatttatttaaaattcaaacaaattgatctttggcatgctggcaaaaattggcacaaaaaaaatccgcgaattgacattaaataggcacaaaaatcatacaattttttatttatgccatttagtagcaaaacacgtaaaacttaatcaaagcacttaattttggttaaatttcaaatttcaatgaaattattaaatattttagagttttttcagatagggacaaatttttaaagcaaaaattttttatcaagaaaacaaaataaataaataaattttggcgatcaatttttaaaaagtcaattctcagggatgtgtattctgaaattttttcgggccatttttgtttttcgtgcatatctgagcgtatcaagtgtttagaattagaaattcgatccttaaagttttgggactaattgctgcctgccgagatttgtgaacaaaatttttgaaattttccgtttctgaatttagaataactgaatttttagcaatttttttttagcgtatggcgcctaatttgcgacgtttttatatgggaaaattggctgtttaattacccaatgctcacagagaaagatttgaaaatgtttcatgataaaatcttaaaattggttggtcgcctggagaaaaaagtggagaaaaatactagttggattgagatgaatgtggtggacaaatctgtcctaaatattatcggccaaattctggtggcaagagtcagttcattaaatgagaaatttaattaattaaaaaaaataatattcaaatttaatcaaaaacaaattttttaaatcaaaaaaaaaattggatgaaacctaaggatgcctttacatttttagatcggaataaattccatatttcatatatatatcaattaattatttaattttatcaatgtataatatttaggtgctaattgatcatagtagcaaaacattcatcagttttgttaattacaatcagtcgacaatttgcaatttttgtgccaatcggacatcacaattttctggatgggagcacatttgtgtgtacaacatgtggctatttgtggtgggagcattgngcaatggacaggngcgcctaattatcatatcccttttctcaaaaattgatcgccagaatctaattattttataa

SEQ ID NO: 61498 - DNA, 315 bp, Heterodera glycines
  Genomic contig location: Contig_ID=SeqID_31120; Location=645..959; Strand=+
  SCN-specific regions: Sequence locations=1-315
atgcaaagtacaaaagcgcctcttttgtccacaactcaaattacacctaaggtaagggaggtcattaccactgaagcaccaccaattacaacaacgcaaacagtaaaaattgagctcactacgaagccgcgtaaaattgagccaaaggttaaagtggaaactccaaaatccttctccaaaggcattcaatttaaaagagtaataaatgaacaacaaatttacaaaattatgggaattaggaaaggcacaatcctgactactacaattccatttataagtacaactcaagcaccaaaaattacaaagccgaccaca

SEQ ID NO: 61499 - DNA, 1432 bp, Heterodera glycines
  Genomic contig location: Contig_ID=SeqID_795; Location=1700..3131; Strand=+
  SCN-specific regions: Sequence locations=1-266,313-405,427-707,729 -785,807-846,883-906,929-988,1010-1254,1276-1432
atgaaaaatattaaaaaaggtatggaaaaatgtctagacagaaaagatttaactatgtgtcaagaattagcagaagaggccaaacaatcaatcgaaattgccaaaaattatcggcaagaaattgggcatatttatcggaccgcttattcacagccagatttaggtattggagatttggcaaataaactaaaagaaacaatgcgcgaaaaccaaatacggtttgaaaggcaaagacctcaggaagaatttagggacgaatttattgcatataaaatataaaagaaaaatttaataaatgaaaaataaaaaaatgaattctgaaaaatcagaaaaagctaataccattttggtggaagctgcaaaaaaagagacagagagagcatggagggatgtagcggcgttagcagaagaagttggcgattttgccaagtcttctcgggaaacacttaatcaggcaataaaatctagagaaaaagctccttatgctaacggtgttcgagaattatatcttaaaatgtccgattcaatttgggaaattttcaaaatcgaggaccaaatcaatttggagtctgtaaaggctgaatctgcatggcgcgagttcgagagatgcaaaacttttgaccaggcaacaaaattcgaggaacaagcgcaaaattcgttaatggaagcccggagattacatttcgagtcccgaagggttcagagccaaatgttaaattatgaaaataggctcaaaacaattgtttgggagcacgttggtatataagaacaaaaaaataatgatataccaaaatggaaaattgtgccataattgagtcattatgtcataaggacttaaaatttggctttaaaaaatataaaaccaaattttattttaaaaatcctttcctaattaatgcggaggaaaattttaaaaatatcctcgcatcaataatcgtaaaaatttataaaaatgaacaaggaaaattcaaaagcattctgaagatttcttttggttttgaatcattttattgccctcttagataccctagcgaaaacaccgccgaggctttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaattaatctcgaaatttttgcaaatatgctttttaaacgggtgaaaaatttctacataacagcatttagtgcacctggaatggaaaatttatatttttcattcttagaaatgctcgaaaaaattcaaaaactacctaaacttattatgcatgagtatagaaaccaagcattagctatgcaaaaaatagaaattggactcaaagaa

SEQ ID NO: 61500 - DNA, 904 bp, Heterodera glycines
  Genomic contig location: Contig_ID=SeqID_795; Location=5103..6006; Strand=-
  SCN-specific regions: Sequence locations=1-114,136-179,258-405,504-904
ttggcagtccaaattgatgaaggaaatccggacagcagaattgcaccggatgagcacggtcgctatttgatcagcaaagttcatgccgtttatgtacaccaaaataatagaaaagcatattttctttcatttcatggcatgttttttatctattgaatttcttattaatcaaagttatgaattaaaaatatattttgagaattaatcaattataaaataaattatatacgttttaatgaaaataattttataataaaccatatcttttattctgtctactctcgcccctgagactcctggggtcgcttcgttgtcacaacgaaatgacccttggagtttcagggtgaaatcgggttccccctgggttcatatctgaaccttgggcgcccatcgccatcatgtctcttttatatttaatattaatactataattaagattttgtatatgaatttattcaaaaaacaacaaataatttattcataaaattaataataattttattgtgtaaaggtttattagagcaaatttgtatttttctagggtggcccggatatgaagaatggacgatttcagaagattgcgaaaatttggagcaaactaatgagtttacggaattggtaacagttgaagctatcttcgacttgatgttaaatagaccaattgcgcgtcatttggctaagattgtcgaaaccagtccgaaatatgtccaaggtagatacaaatcgggacgaaaaccattaaaatgactgtgtttcaaattctttagttcgtcaaaaatatgggctcaaaaacacaaagatcatgaagcttgacatttcgttcgtatctaatacggaagatcgaatcaagaggaaggccgttaacggattacaaaaatttatcgataatgtatttaaatcctaa

SEQ ID NO: 61501 - DNA, 789 bp, Heterodera glycines
  Genomic contig location: Contig_ID=SeqID_795; Location=3915..4703; Strand=+
  SCN-specific regions: Sequence locations=1-17,40-81,103-665,688 -732,754-757
atgtcatttgaaccaattggccaacttcctgagcttccaactgtgcgatactttgagtgtaaattgataggcaccgggtggttatataatttgtgattaataatttattatttctttagcgcgttcggaattggttttgcctccagaaaatatgccacccacgaatttgtggggtgggcttttgactcaataggctttgactcgatgggcgatgttttaggtagtatatgctttaaaattgtcgttttttaaccaaaattgccgtctttattattaatatcatttaggccttgaagaatttggcggaccttcggtgcttaaatggtggaccatgggggcggatgatgttgtgggcgcagggttttcgggcagttctccatttttcactttgaacggagagatattacgtaatatttcattcttttttaatgattttttttgtttgaaaggaattgatgatgttcgattggacgtcagccattttgcctttccaactgtttcgatgatcggcgcagacacttctgtgttggttaacacgggcccgatttttttatttgatataaaccaaatatttatgccataaaccaaataggcccgtaaccaaaaattttttagaagcctaaaaaatttctgaatttattttggaaaattgtcaattctaggagaaaaaatttgtttaaaaattagttaactgttgaattttttcctattcggagagaggtttgaggagaaatttcctccccttggtaactggcaaaaaccaaatattttattatttgttgttgttga

SEQ ID NO: 61502 - DNA, 2639 bp, Heterodera glycines
  Genomic contig location: Contig_ID=SeqID_796; Location=568..3206; Strand=-
  SCN-specific regions: Sequence locations=1-15,38-250,298-344,370 -654,676-1270,1293-1848,1870-2074,2096-2110,2190-2336,2431-2639
caataccttctaaaattctttttaaaattcccaactgtcttcaacatgtttggatgcattaatggaggaaagagacgcggaaagggaggcgcgaaaggcttttgtaaagtgagcaaaaatagaataattgcaaaaaaactttatgtacttaatttacggcttctattccaaaccacgttcatttaaaacaatttaagagaaaattttatgaactttaaattttgtttcgagggccactaatgcatttgtgataaagttttaattgtttaaatgtgtaaatttttgttgtttttccaaatagtgcatatataattattacctattcatattttagacagggcgtcataacatccaaggcatcaccaagccggtcatccgccgattggcgcgttgtggaggggcaaaacgcattcccggcatgaactacgatgaaattcatacggtaccaaaaaatgggcaggaatacttttttcttttgttcaacaaaaatgactatttttgacaatatttgttattcttttcgactcactttccatttttcgtaattttttcaaaaattatccatattcagtcaattttcaggtttcgttatatttcacaattattaaaaacgattagttattttctaaaattaaagcaatgattaactaaacgcattaaattttttcaggcagactatgacaacatccaaggtatcaccaacatgaccatcaaaaattttgctcgtcttgatggagccaacgacatcttcaacatgatcgatgagcaaatttggccaaacgattccaattttggaacggtgaatatttcttggtttcagaatcaaaaaactgaatgattataattaattgacaaaaaatatattaatgtggcaaattttaacaaatccatgtagacacaacaggtcaaatctcaaagtgttaataaaactaagtcaatttaaatatatttggtatagggatgaccgaaggcgctgccggtttttggagattaggtccaatttttaaacagtatcaaaaaatttaagaattttgtaagaggggaggtgggcaggcccgtgaaaaaaagtcagcgtcgcaaataagaaattcaacaaaattttatacaaaatttctcataggtaattcaattggtttttttagattttcattaatcaaattatgatcgatcaatcccgatttgtgaggaaaatttgtcgaatcgtaggaagagacggtagaaagaacggctaaaatttgcttttttaattccaaaaatttcatgctcgtccataaattctttatttttcttaaaatatggattgggtttaacaataaattagcatttttttggagaaaatcggttaacaaattacactcaaattttcaaaaaatattgacattcattctcagtcgttagcttgaaatttgttcaggataatgactgggactcaattgctgcaaatttacaaatcgatgagacggaagagcaaattgagttgggccatgacgtgaactcggcctttctcgacattggtgcaactgtggaaattgttggtgccgagtccgacattgacgatgagaatagaagttcgactttcgccaccacttcaacaacatccaagcgggcaaaaaacacggcaaaacaacaacgaaaacgagcaaacaaacggaataagccgaagccggtagaaaagcgaaatataaaaattgaatcgggaaattctgtataataaataattatcagagcccggtgattgggaccctcgcgggatttttacgggattcccagtcccacctccgtttttttttggtgaatgggattgtaacggcagcgggattctttgggatccccgattgggactcctgtcccagaaaattttatctcccgctcccgcctccggaaattttttaccgagctctaataaaaagtattaatccgcaccttttaagcgggcagtgcaaattgaacatggaattccggacagtagaataggtcctgacgaaaacgggcggtatttgatcagcaaagttcatgccgtttatgtacaccaaaacaatagaagagcctattttttgtcctttcacggcatgttttttaagaaatgaatttttgattaatcatagttatgaaataaaaatatattttgagaattaatcaattataaaataaattatatacgttttaatgaaaataattttataataaaacatcacttttattctgtctactctcgcccctgagactcctggggtcgcttcgttgtcacaacgaaatgacccttggaatttcagggtgaaatcgggttcaccctgggttcatatctgaaccttgggcgcccatcgccatcatgtctcttttatatttaatattaatactataattaagattttgtatatttattcaaaaaacaacaaataatttattcataaaattaataataattttattgtgtaaaggtttattagagcaaatttgtatttttctagggtggcccggatatgaagaatggacgatttcagaagattgcgaaaatttggagcaaactaatgagtttacggaattggtaacagttgaagctatcttcgacttgatgctaaatagaccgattgcgcgtcatttagctaaaatcgtcgaagcctgcccaaaatatgatcacg

SEQ ID NO: 61503 - DNA, 1915 bp, Heterodera glycines
  misc_feature (55)..(55): n is a, c, g, or t
  Genomic contig location: Contig_ID=SeqID_797; Location=1835..3749; Strand=+
  SCN-specific regions: Sequence locations=1-75,142-153,176-303,343 -425,554-786,808-857,878-953,984-1033,1091-1114,1245-1309,1374 -1390,1412-1430,1452-1455,1489-1677,1713-1915
atggccaaaattgtcggggttctgggtaggggcggggtcggggttgcaaccctanctatagaatttaaaggacatgagagagagaggagaggagataggaaaagagagagagagaagggtgaaagagagaggaagaaagagcgaattccggctttattgtttttaattaattattaattcaaagaccttatatttatatttgaaatttttggtaagtgtcaaaataatacaaataactaagatttaattgttcagtataataccaattaatcttgtatgctgcctccacatttccaatttccgtttataaacaaaatttattaatttattttttaaaatatacttactgtaatattttttgctttgttagatattattttccttttggtctcagtcgtgattctgctacattgatgtttttaagctatttaaattttaactttcattgaatataatttatctttattagttaaagaatattataagtttatacaaaaattgtttgtttcacatataatataatacatttttatatttattaatttaaattattcgagcttctttaataaaatataccatttttctcttcgggaaaaacaaaacaaaaaattattgcatttattttgacataatttttaatatttagaaatttctctttcattttttatttggatagtccaattaaatttcatttcttttactttttaaaagctttcattttaagattcatttcaattctttgttaaacatgatgttattttcgaaaattcagaatttatttgattattttttacatacaaattacataaatttatttccttattattggatatgtttaacatattattcatctttaaatatatatatatatatatattaattaatttaatcattctatttaattttaactcgtcgtttgcagcataatatggcgtacataatctgagtaggagaaaaatttgtaaaattttaaattttaaatagagatttaatgcacttatacatttgctcttgctctgcttgtaggatagccttttattattgattttgatatatgatttaatttttattaatcatttgatttttttatgattgtttgtgtcaatcaaagaactatttaaagaaattaaaatattgtaattagtttattaatcatttatattttaattatttttcacaataaataaaatttactgacttattttataattttttttattgcaaatataaatatattttttaaactcttgacgaaaaaaatcttttctgccatttttccaccgagagcaattcgttaccatcccattagatatataaattaaattactgatttaatactttattttttattataaatattaatatttttaattcttgtccacattcatgttatttaagtggtgaaatgttttgtggaatttagtaatttagaaaattagatttatgtaattgaagaaatattgtcctaaaatatttaaattacatctatgtttttaaatgtaggatctccgctctttttctcggcaataattttattgcctcgttgaatatatccttttaattaatctttgttaaatattaattatttccatttttttcaaataatagcaaaattttcaattatcttaaacatcgtaattgcttattacataatataattttatatgatttactcactttataacaattaaatttaattattttcattataactgatacttttttaggttcgtctcagcggggaccggtaaattggacaccggaaaattggacaccagaaaattggacaccggaaaattggacaccaagcggaaaaatggacaccgccggaattttggacactaaaggaaaattggacaccggaaaattggacactaagatttcctttttaaaaaaaatcaagaattaggtgaaa

SEQ ID NO: 61504 - DNA, 166 bp, Heterodera glycines
  Genomic contig location: Contig_ID=SeqID_797; Location=4710..4875; Strand=-
  SCN-specific regions: Sequence locations=1-17,105-166
atgagtaagacattgtgatataaaatagtatttaaatgaagaatattaatttaaaattatttttatatttataaataaatattaattacaaaaaatatttaaatgcacagagaacgaattttggaatccgacaagagttcgaatacatgagatgagagcaacataa

SEQ ID NO: 61505 - DNA, 1398 bp, Heterodera glycines
  Genomic contig location: Contig_ID=SeqID_6420; Location=54..1451; Strand=-
  SCN-specific regions: Sequence locations=1-95,122-363,386-454,476 -547,578-1232,1254-1321,1346-1398
atgccgacaactgttttcattgactacataatgtttagtgtacatttaacgctaatccgttggcaatttattctccatggaaaaagcaatttccgctttcaaacaaacagaaaaagaagaatggaagaagaaaaaaaagttttgagaatatgtaataatgtatccgatggaaaaagaagaaaaaaagcgattttttatgaaaaaaaaggttgcctagagggcaaaaatgtacttgcgaatttgggttttaggctatggtaaaaaaattttttttaagtgccttcgttgtaaagggacaaaaaaacaaccgtatttggcattgtcattgtgacgatttgaacaatttaaaaaaactattaccggatataatgctgctttaattattcttctaaaaatagttacaaattgtaatttgtcgtaaataaaaaaaatgacaggtaaatgtgtgggaaactttattttaaaataaatttttgtcgttaagtacattcatatttatagaaaggcatgttattgtgtaagtgtaagtggaaaaccaaatcatgggaaaaaaattaaaattaaaaaatgaatttttcacatgttaagctatcattgcataacaaaacaaacgaccaaacgccaccaccaaacacaaaaattgattataacatgtacaaatcaaacataacgccaacaacaagttttttttttaattttttgaatatttgacttacctccgttgttgacgccaaccagatcaaccaagtcctggcgcgcccagtgcggaccgcgcgaagatggcacaattgaggcggacatttccaagccccagcgtttggtcaccgtccgagcgtagagaccctttaacaaaaattaaatagttataaaagctaaaaggaaaaaacgtctgaaaatttttggaatatcttcgcgaaaaaccgagtaaaaatagaaaaaattcaaaatattccacaaaaagcgaattacaaaaaaaaaaatggcctcagggctaactgcactatatgaaaaaggacttgagagagatttataaattggaaaaattaaatgtacaaagatcaaaatgtttttttttaattatgggccggtcggtctacctcagttgggcgcacacggttgggcgccagcacatgtttttccactataacatttttctttgtcatccaaatccatcaatcttggtatcattcgagagctcttcagatgctctaattgcctgcaaaattccaaaaaattttgttaattttgaacaaatttatggccaaaaaagttggaaaaatttggtttttttaattcttctggccataacttttttgaacctaactaaattttttaaaattttgcaggctaatagaggacactttagagctttccaatgaaatcaacaatgttggatga

SEQ ID NO: 61506 - DNA, 56 bp, Heterodera glycines
  Genomic contig location: Contig_ID=SeqID_6420; Location=5931..5986; Strand=+
  SCN-specific regions: Sequence locations=1-21
gtcccggttcccggtcccgtattttgaaaagctcaggtcccggtcccggtagggca

SEQ ID NO: 61507 - DNA, 1285 bp, Heterodera glycines
  Genomic contig location: Contig_ID=SeqID_6420; Location=3817..5101; Strand=-
  SCN-specific regions: Sequence locations=1-618,659-757,786-830,856 -884,915-998,1021-1057,1099-1285
atgcaacaaatgcatttctcgataggtaaaatgaagaaatagcaaaaaaatttttgaaggattttgtatacatattatgaaagtatggtttctccattccttaaccatgtagaagaccgaggatatccgttatcgttttcatttccatgggaaataatcctcacgccggaggcagacaaatttgtgtgccaaagtgttcgttcaaaaatgcccatgtgacaaaattcgccgccatttggcgcgggtataatgttttttaatcctttaaaagggtgtacggatcagggacagaaattggtctcggacatttttaataattacccttacatagaggtggaaaatgaacggaagaacatttaaatttgtccatttattaatcccccgccctcgacagacaaaatcttttgcaaaaattttttgttttataaatttcttagagattttctaattaaaaaatgaaaataattttcttcaaacaaatttcgttcaaaaaattcttcttattttgtttgtacaattttcaaagaattttttaaacaaaaaagttttttaaaagaaaaacaaagaatttttaaaattgttttttttcaaggaaatacctctaacataagaatttacaaaataaatataaattttcagtttatttttataaaattatgtatagatatactgcagtagaagtgaaactaatgccattggggcataaataataattttagcacaatcactcgcattcattcccgcaggggccataggtgaaggggaaaaagggaaggggcgaggggcattggcaccgcctaacgcacaaatttggtattggcacttctaacataaattcattcattcattctttccgcctccctccctccccccgtcccgcgtgggaagggggtggggtaaaggggtgtaaaaattcggttaaaatatgcggaaatatccccgcagggcattgattttaggcacaagaaattcttccgctagccaatgtgtgttattatgccgcgccgccccgcgtggggatgtgagattacttaatactaattgagggcggtgctctttttgatgtttatttatttataagctacaattttaaattagctcgaatttgtttgtcatcaattaattgaacaaattggcaattactgtagagtattaatttctttttgtgttcgtcatagcaacattgtgttaattgttttctatcaaaaatttgattatgccacaattaactaaaaacaaacaaagacgaacatggaaacagtttaagtgaaaaatagttaataaa

SEQ ID NO: 61508 - DNA, 83 bp, Heterodera glycines
  Genomic contig location: Contig_ID=SeqID_31125; Location=326..408; Strand=+
  SCN-specific regions: Sequence locations=1-35,72-83
gatatcaagaaaattttggcagcctaattgtcaactaaaaattatataaaacaaatttgtataaataaatacgaataattttc

SEQ ID NO: 61509 - DNA, 540 bp, Heterodera glycines
  Genomic contig location: Contig_ID=SeqID_31127; Location=114..653; Strand=+
  SCN-specific regions: Sequence locations=1-21,45-166,188-205,236 -253,275-326,372-508
atgtacttagtattttcgggaattcattttggcttggtgtttaggtaaaatttaaatatttggttggacaacgcactgggtccacgatttacctaaaaacatagaaaaacctctaaaatgagcgcccgtagcaccgtcggttagagcattgcacagttggaaaggctgtgggttcgagtcccaccgggcgagtcaccttttatgcttttttaaacaaataaatatttttaaaatactttcaaagaattggcaattttggtgcccaaattttgtgcgccattttggcttacaaattagtttaacacaacaccgagggaaaagaaaagtaaattagttttataaattaaattttctttttttagaaaatataacttggcaaaaaacgattttattagcaaaaatctgattgaaattgatatgaatcttttcattcgtccaatgtcaacaccaaacacaaatgtcgaagttggcacgagttcaaatagcagcgggtgaaaagagaattttgaattttttaattttttaaaaataattaaatta

SEQ ID NO: 61510 - DNA, 650 bp, Heterodera glycines
  Genomic contig location: Contig_ID=SeqID_31128; Location=1025..1674; Strand=+
  SCN-specific regions: Sequence locations=1-592,621-650
atgagctggaatgagtcattggagcagaacaattgcgagctgattaatttggatgagattttaaagaatgcgggaccaagcggagagaagccggtgtctttgatgcaggtgtacggtaggtaattaaccatacggcttggcccgaagtcctcgaggtcatttattccactcaataattgctaaaaatacccacacagtgttacatagtgtataaaaagcaaaaaaaaaaaaaatgacatgattatgcgaattcataattacatagaaataatctaattaaaattgaactgctataatgcttttccgtttttaagtgtgccttccttcgagccgaaatggtcctgttttggtcctcctggcgaccacttttgtgtcggtacgagttattttcatgtgtttattaagaaaacactagaacaataatcgttcaaaaacagctcattgacttcaaaacgcgcaagcacattctgacacatccgatgacggacattcttttgcaagcggtcgctgggagcaaacggacgctaaaagcaacgccatttaccagaggtgtaaaaccaaaaatgagggcccagattttttagtttttcagtttatttaaaattataaaaagttaataacaaagaagaaaggtttgcaatttaaaaaaa

SEQ ID NO: 61511 - DNA, 1151 bp, Heterodera glycines
  misc_feature (11)..(11): n is a, c, g, or t
  misc_feature (1140)..(1141): n is a, c, g, or t
  Genomic contig location: Contig_ID=SeqID_31130; Location=53..1203; Strand=-
  SCN-specific regions: Sequence locations=1-94,127-167,202-292,314 -606,636-759,781-834,875-900,941-991,1022-1044,1066-1151
aaagacacccnttggacaaagaatttattcagaaagtgattgaagaaatacgaccattatacggtaaatatattaaaaaggcatatcattagggatgagattttaatatttaaatgaatatgagttagatcgatttttgtaactcaatttattccctttatttttttccaaaatgggttaaaaaattttagaaaatattttggcttactctcgcaaagttacatagatttgagtacacacacacaaacgggttgccgcgggacttggaaaacatagggaccgggattagggttgggatggatcaaaatctttcgggtcacgacgcagattttggggcgcgaaaaattgggaacgggattcgtgccatgatggctaaaaaattctggtcgggatttgggcagatacataatgggactcgggctgaaatactgatgcatacgaaatttcatacacaaatcagcattttaatgcaattaattttcatcttcatcataccatgtaattttttttttgatttcttttattaatagcgtgaattattaataattttttctgaaaatgaagaatggtaaattcattctgaaaattctattacaaaaacatttgttattttttaatttaaaatttatttaaaacgcagttgaggcgatcagagaccatctaaatatattggtcaagttgaactttttggagaatgacaaaggctttaaaaaggacgcaaaaaacatggaaaatttggtatgcaaaagagtcaatatgttttaaaaaataaacaaataatttagttaaagtaaaaattgatggctaatggatagggctggggattaaattcacaaatataaacttaaaatataatttttttagatattttaaaggtggattttttgacattttcttttgaaaaaaaaatttttatgttataatttttttttaattttttgtattttcataagaaagtagtttcttactttttagagcatgtcgaatccagaaaaaatatatattatatatatatttaaatgaaattcccaacattgtctaataaatataaaatttttgtatgtatccaaatattgtaactcgaaaattacagaatgcacttgagaatcagcttatcgccaataaggcatgcttaatcannggaagatgag

SEQ ID NO: 61512 - DNA, 205 bp, Heterodera glycines
  Genomic contig location: Contig_ID=SeqID_31131; Location=35..239; Strand=-
  SCN-specific regions: Sequence locations=1-205
atggccaatgataatccatggaaagggaacggaaacgacggcacaaatcggcaaaattcaaccggcggattaattagcacggcatttactgaggagaagaatgaaaagcgcaaaaatattgaagaagcagaaaaagacgaagcgtacccgagggaagcgaccacatggacagaaatggccaaacaatggccaaagtcgaccattt

SEQ ID NO: 61513 - DNA, 361 bp, Heterodera glycines
  Genomic contig location: Contig_ID=SeqID_6422; Location=1000..1360; Strand=+
  SCN-specific regions: Sequence locations=1-33,56-361
atgaaccgacggtaagcacaaattcgtcatttatttacctaacaaaacttttttcagttggatttgcaacgacgtttggatggacattttcccatcctttgaccgtcctcaactcggcctcaaattggcacttctttcgccacgtttcgatgcattggtggacaaacatttcgatggcaaaagcgaattgacaatttggagaactatcgaaattcgtcgcaagggcattggaccagaaacgaaactttatgtagagatcgattacgaatttgtgccatttccattgcccgaccgtccgttgcccagcaaaatccgttttaaatggcttcggattgagtaattcggaatcagagctatgaca

SEQ ID NO: 61514 - DNA, 788 bp, Heterodera glycines
  Genomic contig location: Contig_ID=SeqID_6423; Location=196..983; Strand=-
  SCN-specific regions: Sequence locations=1-13,35-788
atgaaccgacggtaattaaattaaaagtcacaaattcgtcgtttatttgactaaactgttttcccatttcagttggatttgcaacgacgtttggatggacattttcccatcctttgaccgtcctcaactcggcctcaaattggcacttctttcgccacgttttaattcgctggtggacaaacatttcaatggcaaaagcgaattgacaatttggagaaagatcaaaattcatcgcaaggacaaaggaccagaaccgaagctatctgtacgaatcgatgacaaatttgtgccatttccattgcccgaccgtccgttgcccagcaaaatccgttttaaagaccttcggattgagtaatttaaaatcagagttatggcaataaaagctttccttccatttttaggtacattgatcactccgtcatcgcttttcttcgttcaaatcatcaaattttcgacaaaagaggcaccgatttacagttgtttggccaattttttcggcaaacattcgccacttgcgcttttacgatggtgatcatttggaccatttgcttcgtcaaatttcgccgacaattctcatcgatctcaaccaattgacttcaatccattcatttgatttgtttcccgctgcgattgatgatggttttgatgggccaaattcaacaatttctgctggccaagcattgtccaaatggttgcactctccgagaaaagatggacaacccaagcgattgcgttgcggtaattacaacgaacaaacggactttgattggatcaacaatttcaaggag

SEQ ID NO: 61515 - DNA, 857 bp, Heterodera glycines
  Genomic contig location: Contig_ID=SeqID_31133; Location=79..935; Strand=-
  SCN-specific regions: Sequence locations=1-89,117-165,199-752,774-857
ccgacttaatcaaagaatggttcactgaattcgtacaagcacatgaaaggggttccgatatcagtggaagagatggaatcgacatggtgaatttttattatttaatttaatattttccagaaaattatttggcgctaaaatttctgtttgggggttttccacttgaaattttttgattatttaaatattttttttaaaccaatttttttttcgaatttctgaatagggtatatcaattgctcagggcttttgccgtcggcatttttgccgttggcgaatgtttgtggcataatttttttaatgaactgtactaattctttgaaaaattatcattattattcaataaattcattccattaatttattaattaattgtccagggcatttgcggtcggcatttttgccattggcggaatgtttggtggcattatggttggcactgttgcggacagattagggcgccgtaaatcacttctgtacaacaatatattggcgataattgctgcggcactgatgacactggcaaaatatatgaatgtttattatttgatcatcattggacgattcattattgccggacccccctgtacgccaaatctcattgaaaaaatgtgttgtaaaaagggttttgaaaagcaaaaaaggtcgatttacatggcttgagataactctaagctaaaatgtaaaaattataagattttttcgaatttttaagcaaaatttcaaaaataatacaggttgtcaaaaatttgcctgtacctgtacctggatccaggaaaaatacaggcctggatccaggtacaggtcgatctctaaatgaaattattttgcgatgtatgaaaggcccagtattgtaa

SEQ ID NO: 61516 - DNA, 979 bp, Heterodera glycines
  Genomic contig location: Contig_ID=SeqID_31138; Location=249..1227; Strand=+
  SCN-specific regions: Sequence locations=1-82,107-616,638-723,745 -781,803-839,861-897,919-956,978-979
atgccgaacgacctgccgggcgtggatgcagcaactgaccaacggagtgtcctatttgcacgaaaatcgaatcgcgcatcgggacttgaagccggagaatattttgctcttcgaacgtggcgttctcaaaatcaccgactacggcttcgcgaaacaggtaatgaatgccacgcttcaacacaaacgttcaatttcctttttcagtgcgatgatggcgacatgtcttcaaccttttgcagaactaagctttacaaggccccggaactgctgcagaaacatgaatatgacccgttcaaagcggacgtttggtctgttttgttcgtttccattcactgcttttttcatcttcccttttcatttcaggtcacttggcgtcatttgctttgttatgcggaccaacacaatgccgttcagcagaggcgtgagccgaacacacatggtggaggaacagcgaaacagtcaataccgattcccttctcacttggtcatcagtttgcagtgtcgcggcgccattgacacgattttgacgtttgatccggagcagcgtccggtgagcactttttgtgttttttgaattttcaatttcaattccttttttcagagtgtcttcgatgtgtcaagtttgccgtggttttccgaagatgtctctgaacgttctgggagttcttctgatgtgagtgccaccagtgatacaccgctccttaatgtatttacttgcctctgtttgtatatttctgtgtatttgtgatacaccgctccttaatgtatttacttgcctctgtttgtatatttctgtgtatttgtgatacaccgctccttaatgtatttacttgcctctgtttgtatatttctgtgtatttgtgatacaccgctccttaatgtatttacttgcctctgtttgtatatttctgtgtatttgtgataacaccgctccttaatgtatttacttgcctctgtttgtatatttctgtgtatttga

SEQ ID NO: 61517 - DNA, 380 bp, Heterodera glycines
  Genomic contig location: Contig_ID=SeqID_31139; Location=580..959; Strand=-
  SCN-specific regions: Sequence locations=1-380
tccgtctttgcatgctaccttttgcgaaatttttccttttaaatggttatttattttggtactgaagtgtccattttctctgggactcagttgtcccagtgcttagatggcattggttcgagttgataccttgttttttagacttagctcatcaagagctttcgaatgataccaaatttgtccgaatttgaccgttttaaaaggtcaggagccctctttttcattcaaattttcgagttttaaaccggttcaaaaaccagtttaaatgcttttccgcgcccaattttaagcttttctatcgttcccagtacctaagaaaacctataaaagtgtttttgtgcgattttgagccgataccatattcggcaatttttcccaga

SEQ ID NO: 61518 - DNA, 259 bp, Heterodera glycines
  Genomic contig location: Contig_ID=SeqID_31140; Location=287..545; Strand=+
  SCN-specific regions: Sequence locations=1-52,74-259
atgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgta

SEQ ID NO: 61519 - DNA, 5562 bp, Heterodera glycines
  Genomic contig location: Contig_ID=SeqID_6424; Location=636..6197; Strand=+
  SCN-specific regions: Sequence locations=1-246,269-329,354-670,693 -736,759-798,839-889,912-1416,1438-2361,2383-2574,2596-2775,2797 -2823,2845-2969,3001-4001,4023-4025,4048-4071,4100-4331,4355 -4441,4463-4482,4504-4848,4871-4945,4967-5562
  Gene Ontology: Mol. function=Rho GTPase activator activity; Biological process=RAS protein signal transduction
cagttttcgcgacgaagagacacgatttatgcgcgatttgaacttgttggtcaatgttttcaagcggcgactgtcctccggcattggcaccgacgcgaagggaaaggtccgactgaattcggtcccttccttaagaaaaaacttcgtaggggaaattgcttatcagggccatgcaatttgctccagcatcatcgtttaaaaatttcagcacggagcgaaaaaaaagaatttataccgattttgcgccaaaaaatgacaattttgccattttcgggtcaaaatttgaaaaagggtgaaatgggggtggtatcgttaggcgtcgccgggaaaaaatttggaaattttaatgaaatatggtaaaaaaattaagttaagtttttcaaaaaatttgtccattttttcttgaaaactttggctacggcctgaatcttccctcaaaattttacccaattttaaggatattatctccaatctgttcggaaatgtgcacgaaatcctcgagttgaccatcaaaatccaccggaccattgacgatgccattgacatgtccgacccaccgatgctcggaatgggcctttgggagttggcggagggctgcgaattcgacgcatacgtccaatttatggtgggggggggggggacaaatggggaaaaaccgaaaaatcttaattttatttttggaataatttcaggaagtctttcgcgaaccccttaacagaaagttggccaaactgctgaaggagacaaaacacatggaatattttgatgtaaggcaacaaattttgaataatcattttctttttttgaaaaataatttacatattataatatttaaaaacggtttcaccttcgaacttggaacaaactctgctcaatttcccttcttaagttttttttttaaaaaaaaaaaacgttttttattcaaaaatgaaaatttctcaaactaaagacaaaccataaaaagaaggaggacacttggaagtccctgctttacattaattttaaaattttgacggctgcctttttttctccgaaaattggcattttcagcttgaagaccgaatgtacagcggcacacccggggggcacacttttcgcatgaccgtcaaatatgttttgcctgcactgctccattcggtggtcgcccatttcaaatgttactccgaatttgtaaaggttggcaattcgttgccaatttaaaatattcgaaaaattcatttatttttcaattagctgataatggaggccagtgaccacgaggcggacagaaaagacttgtacaacacggacatgtacctgaacatggtgacgaaacgaatgaacgatttgagggggctaatgtccgcccaagtgtaagccaaaacaaaaaaagggaggaagacggcaatcttcggaaattacccttaattttgccaattaatttccatttcccgcgcctcagaaatgagagaatagcgaggggaatgcgccgggacaattcgcgctccttccaattgagtgccatccaacgcattcagcgcagcatcgacgggtgggagggcaaagagatcggatacatgtgcaacactttcatacgcgagggcaaactgttccaactgcgcgggtcgacgacaatcgccggttggtgggggaaaccgagaaaaagtcatttttattgaaatggacgaacgaattcagcggaaattgttggaagagtcaatctgtagtcagttgaacgacttccaaaagtctttggatggaaagccgggccaggaaaagctgggaattttacccaaaatgagttttttgaattggccaattcactcttaaaattggttagcatttatgggttttccatttcatcagataacattctgcgcaatcgaagcggagggactgaacggcacgtgttccttttcgaccatttgctggtcatttgcaagccgaacaaaccgatgaaaatgagcagcagcgcccatcaaacgacggccggcaatttcaaattcaaagaaaaactgtacatacgacgctgtgacatcatcgacttggacgacgaccacggtgaataatgccaataatgagttggggaggtccgaaagctgagattgtgccgatttcactggtggggtgatgaccaattgacaatggcaattaattccctcacccctccccctttggtgtgccaatggatgcctttaacaaaactcatgggttatatttttcccaaggttaaattgaatcttgctagttgcaataaatcatgttagacaattggcagaaatgaaaaacgccttcaaaatttgcacgtcggcaaaggctggcggcaacgacgagtacatgtccatgctgactttgttctgccaaagtccggaagagaaggagcaatggatggcaggaatggtggaaatgcaaacggcagggtaaaggggcgggggacattggcacatcctcggaacagacaatcggtccatcctccgaatgtgacatttcatttttacccgatttcgtacacaattgaaaaatgaatttgccaattttttgcaggcaattgtttccggaaatgcgtttgatattatttatagcctcacaatcagcattattttaaaagggcaggaacttacaattagctccgaaaaaggttgataaaattttaaaaaatccaaaaaacctaaatattctgtaaataggtactgtaagttttttcatatcaattcgctgtaaaaatttcaaaccatcacactaccgtatctcgttttcatgaaattctgactcatggacgcattttcgataactgtgcaagaaaaccaaccaatttccattaatagttatacaatttaaaaaaaacatcgttaattcgatttttaaatttctccctttgttttgtcagtgcggtaaaaagaagaataaaccgtataattcgatcacttttttcgcgtctttcattctcttttttcctcgaaattgatctcaatgggccaacaaatcacttcaaatgtttgtgtaaagaaagaaaggtaaggcgaaaaagaacaaattgaaaaggaattaattcttttacatttgtcccattggctggcattgcgcaattttcccttactttttgggcacttttggaaatttttacacatttttggcactttgaacagaacactgcagcgaatgttggacgcccatcagaaagaggaggagaagcgcattccgctgatcattcccacggtttccgagtaccgttacgcggagccggacaccgacgagaacatcattttcgaggattacacccacaacagcggcatccccgtggttcgtgccggcacagtgctgaagctggtcgaacggctgacgtatccgcagtaagtaaatgtttcatgaaattaattctgaattttgcatcgttttccctttgggtacaccgacaacgaatttgtcaaaacgttcatgaccactttccgctcgttctgttcaccggccgaattgttggcacttttaattgaacgctttgtcattccgacgccgcacattttcatggcattggacccgcagcatttgctgtcatccgtgatggcgaactcatcctggttgtttgtttgtttttttcatttttgtaattattttggcatgtttcgttagcaatgattcggcatccctctcaaatggttctctccaacattcgcaactccattcgttcgcccacaatttgtcgcagtcccaacttgagcaggcattccacaaattcaggcaggaataccaaaagcccattcagctgaagtgagtctttattgtgccgtcataaattggcagtgccattgccaaccattcgctgtttctcagagtgttgagcatcatcaaccactgggtgagcaaccacttctacgacttcgagtcggacgcccttttgctcgtccgtctgatcgattttctgagcggaaacgaccgatccatcaaattgatcaccagccacaagaaatggtgcaccaagattcaggtagaaaatgccaaagatttgctggattatcctgccaatgttttctttccttcttaaaacagtggcaaaaacaaaggcatttttaggaagtgataaagcgaaagcacaggcatcaacagcaacaacaacagcagcaaaatcagttggactcggctggtcactcggccgacggcgaagtggcggacagcagcaacagatttaacaacagcaccagcacagccatgtcgtcgtcgtcggcaccgcccgcctccgacagcggcaccgccggtgtcccagccgcagcgaatgctgcagcgactgcgttcagtgtacagtgtccggaagtgagttgggacggggggatgggatactgtagcatacagtaaaataaatgatgaaagtgaatcagaagacagacttacagtttaaactccatccatccattcatttttttgtttagcccgtttggcattatgccaaggagggcgaagtcgacgcctacgaccttctcacgctgcacccattggaaatcggtcgtcaggtgacccttctccaatttttcctctaccgcgccatcaaacccttcggtgattttatatattttttttgtgttttcaaatccgttttaagaactcgtcgacgcggcgtggacaaagcgcgacaaataccagcggagtccgcaattgctgaaacttatcgaccacagcaacaatgtgaggctttctttctaagaatttgcctaatgcttcccttggctttttagctcacttattgggtcgctcgttccatcgtcgagaccgaatcgttggaggaacgcgtggaaatgttttcgagagtgttggagataatgaccgtgtttgaggagctgaacaacttcaacggcattgtggccttttttgctgcgctgaactgtcaaccggtgtatcgattggacgaaagcaaatcggtgggtgaaatgggggcggatgagtacatatatctaaaaaacttgccaatttttgtatttgtttcagcgattggacaaagagaagaagggatggtatgaccattatgtgcagttatgtggcaatggccatttgactgaactgctccaaaaactgcgctccatcaatccgccatgtgttccatttgcaggtgaagaaaaaggcgaatgccaacaaatcaatgttcattaattgtttgtaggtacatatttaacgcaaattgtgcttcgtttggagagtctaaagcaaatggagggacggatgaaccaacaaacgacgaaagcggccgaattggcaatggcaaacattgaacagcaacaggtgggcaatgaagaggaaaaggacgtggccaatggcacggcgcccaaacgggcacaataattgcttttgtcgactccgaattccccgatttgccatttttagacttgtgaacagaatgccgactccgcttccgtcgccgcctccgccatgtcaacggaacggtcgccgctgcagacgcccaaagggaaggcggacgcggaaggggccgcgcggaaaatgatttcctttatgaaatgccgcaaaattgcggcgatcattcgcgaaattcaaatgtaccaaaatcagccctattctctgcgagtggagccgaccattcgg

SEQ ID NO: 61520 - DNA, 588 bp, Heterodera glycines
  Genomic contig location: Contig_ID=SeqID_31142; Location=809..1396; Strand=+
  SCN-specific regions: Sequence locations=1-21,62-501,532-588
atgcaatgttcggtggacagcttggaaatgatgaaaaatgagcaacaccaacaacagcagcgcgtgatgatggaaacttcggtggactcgttggaatttggcacaaaaatgacaacggcacaacaaaaggacgaagcagaaatagaagcattgttgctggtcgaacgagactcgttgagcagtgcacaaagtcagcaacaggacgacaacgagttggagcagtacagcagcagtcgaacagggacgacaatcacgacgacaacgaccacaatgacggaaaatgagcggaaagcggaagagcaccgtaagaaaacccctgaccgggacaccgtaatggagttaaacgatttttcggttttgtgcctatgtgaagatagacaatctaaaaataaaaaactatttgaatttttcatatttttattggattggaagaagtttttttgaaatagcatggaaaaattttcaagtaatgagctgatttgattttataatttttttcccaattttttaaattttaattatttatttttagcaacatcatcttcattcccattgcctttgccaactgctgctggaggcaatgggtaa

SEQ ID NO: 61521 - DNA, 182 bp, Heterodera glycines
  Genomic contig location: Contig_ID=SeqID_31144; Location=368..549; Strand=-
  SCN-specific regions: Sequence locations=1-108,145-182
atgaaacaatttcgcatacaaactcttggctttcgaatgatagcagggttgtttgtgggtccgggtccgggaaatgctctaaaaaggatttcaagcacttttgatcgggatcttttccaaaaaagaaggaaaaggaaaagggaattaaatgggaaggaggcaagcgactcggtggtcaagtg

SEQ ID NO: 61522 - DNA, 191 bp, Heterodera glycines
  Genomic contig location: Contig_ID=SeqID_31146; Location=136..326; Strand=+
  SCN-specific regions: Sequence locations=1-191
atgagcacaatgatcgaatggtaggcacaaatgctgctaatacatgttatttgtttgataaaatttccagcagtggtgtggtcaacggcgaaattgatgacatgaatgatcagcaggacgatgatgatgctccaacgtcaactgtttatctgaatttgggcaaagacgagcgcaccgcggaaaattattaa

SEQ ID NO: 61523 - DNA, 677 bp, Heterodera glycines
  Genomic contig location: Contig_ID=SeqID_31146; Location=377..1053; Strand=-
  SCN-specific regions: Sequence locations=1-105,127-168,195-553,577 -581,614-677
atgctttcccaagaggaagacagagggcgtagtgtggtaaattaaaacatataccaaaaaaaaaacataaataaaatttacattcaggagcgaacctctgtatgtggaactgaaggatctgatgatttgtccgggcgactcgccggaatgtctctcacgttgcggacgagcgagcagcagcagcagttattaccagctagcagtggacgagttggatctgcacagcgcaagcaacagcgacgacgacaaagagaacgacgcgacttggtgagagtgctctgccgattcaaccgatgttcgccaacttggcttcacaaaatgcttcagaaaaggaaggaagaaaatgtgaaattcttgaacaaactgtcattagccacccatcacctgaaaaggaatgtagctgtttccgcagatgcgctgtcccgacatggagccaacatgatgtttgcctaccgtggattcatgggaataactgttcaacaacatttatatgtgcgtcatcgcattatgctgaaatatccccaattaccatgtgttgtacaatttggtggcaacagtcaccaggacaattttccaattgaattactccatgttgtttcagaagagcaaaagaccgattaatatgtttattctaactattactatttttctctaacataatcatgatgaagaataaa

SEQ ID NO: 61524 - DNA, 581 bp, Heterodera glycines
  Genomic contig location: Contig_ID=SeqID_31148; Location=572..1152; Strand=+
  SCN-specific regions: Sequence locations=1-146,168-581
  Gene Ontology: Mol. function=receptor activity; Cellular component =integral to plasma membrane; Biological process=locomotory behavior
atgaccatctatcccaacttgctgaagcatgccaaacaggaggaggccgagatggacatcaaacagttcgcttttgccttcgtttgcccttttcatttgccctgcctttttcagatacgaaatgctggtgaaggtgcagtgcagtgccgacttcaagttcttcctgtgcactttgttcacgcccgtctgcaccattctcaacgaacccattccgccgtgtcgccacctttgcctttccgcgaagaacggctgcgaaacactgatgcgcaaatttggctaccaatggccagagatattcgactgtgacaaaatgccggagagtcgggacggaatgtgtgtgggggagagcaaaacggaggaaacggacggcggagcatcggcggacggaaagggcgcggaagagccgacggaaaggggcggaaaatgggccatggaatgtccgcacacaatgaaagtgctcagcaaacgaaggtaagcctaaattgggggctgaagtgggttttgtaatgcaaattcacttaggaaatttttattcgatattttttatatgggattttattgtttttttctctcttaattaa

SEQ ID NO: 61525 - DNA, 954 bp, Heterodera glycines
  Genomic contig location: Contig_ID=SeqID_6425; Location=713..1666; Strand=-
  SCN-specific regions: Sequence locations=1-268,290-387,409-455,478 -502,524-547,641-954
atgagtgccgcgttcttttgcccttttccacccgaaaacggcgttcgccaattggcggctccgcgtaaggcattcccaaaaaggcgaaaacggacacattattattgcccgggaggggattcagttcagaatgggtccgatcggctgggatttgctcgtttgggtcttgccaaggcgtccatggcaaatttggaatggtcacacggaggccgaccacttcgccaaccgaaagacgcaccagcacattcccccgagattcatcctaaaggcacaaatgaaaagaaaaacacggaaaaacagtcgaaccgagccgaaactattcgcagtagaagtgctgaaaaaggaaaaggcatgacaaaaagcaaagggacattcggcggattcacccaaaagagtcccacaaatcgacacttcgcgtcggttcgggaaattggcaatcagtgaaaatcagttgggcaatgaagaacagaaacgagaagaaatccattagctgctggaggtgttgaaatttgaaaaaaggggacaaatggacgaaggccaatggatcgatggagaaaaaaatggaggggaaaacggatgggaggagagagagagggaaagatgggaaggagggagcaaaacaaaaacaaacaaagagagacgaacagcgaacggacgacgaacccgccattcccaactcgcagggagaattcggaggtccgaagtgagggaggggggggggggcaatgaccaaagcgacagaagagagaatccctaagacgccaccttaacgcttttatgatttgttatcaattcacaaaaaatttgtttgtttttttttgaaaattcgggatcattaaggaaatcattataaaaccttcaaattttgcctgatgaatgaaaaaagatatcctacaatatcagagcaaaggctaatcgcagtgaatttttttgcatcgcaatagtcaaaataaa

SEQ ID NO: 61526 - DNA, 138 bp, Heterodera glycines
  Genomic contig location: Contig_ID=SeqID_31152; Location=533..670; Strand=+
  SCN-specific regions: Sequence locations=1-138
aaaggcatgcgcacccgtccgatccgccaagttaagcaacgattgctgactagccaaaaggttcggtgccgtgatgaaacgaaccagcactgcttaccccgcggcacccggcacggtcccccgaaggaatggatttaa

SEQ ID NO: 61527 - DNA, 894 bp, Heterodera glycines
  Genomic contig location: Contig_ID=SeqID_31153; Location=18..911; Strand=-
  SCN-specific regions: Sequence locations=1-548,570-824,846-894
atgtatgaagattgcaacaccgtttttgcacggtgccatgacgcgaaaaaggcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgtggtcaaattgtga

SEQ ID NO: 61528 - DNA, 355 bp, Heterodera glycines
  Genomic contig location: Contig_ID=SeqID_31154; Location=1..355; Strand=-
  SCN-specific regions: Sequence locations=1-312,341-355
ttggccaacgaaattgctcgacgcgttcgcattttctgttggattttgaccggcaaacagaaccaccaaaagcgggccattcacgtgaaggcgacttgggcaaaacggtgcaataaatttgtgttcatgtcatcggaggacgatccaacattgcccgctgtgaatttgaacatttccgagggcaggtggcgtatttaaaaaaatatttcaaaaaatttgtttatgcgtaccagaattgtttcgggtcactcgaaacccaatatttttctcgtcccgaatcccaacccgatgattttgggcgggattcgggacaaaataagaatttatattaaatttttttgaaacgattgtgttc

SEQ ID NO: 61529 - DNA, 336 bp, Heterodera glycines
  Genomic contig location: Contig_ID=SeqID_31156; Location=60..395; Strand=+
  SCN-specific regions: Sequence locations=1-28,50-110,139-170,195 -230,252-336
atgcatctactgttctcggtctgggaggcggttctgcatgaggcggaggacttgatggaggataatgagcgggagttggaggaatgggtggggatacgagaacgtctcccaggcggcggtggtggtggaggaggagcgggaggactaggtccacgtcgaggacgtctcccaggcggaggaggaggtggtggcggggcgggaggtcggggtggtgtgtctacacctctcaatcttcatcttcgccgcctttccttagcagtacacttattcctttcgtcagctcaactttggctggcctatcttcaagttccctcctcattttcaagtatcgcctaa

SEQ ID NO: 61530 - DNA, 378 bp, Heterodera glycines
  Genomic contig location: Contig_ID=SeqID_31156; Location=599..976; Strand=-
  SCN-specific regions: Sequence locations=1-111,133-378
atggagcggcataagcagcaacaagtaaagattggagagctgataaaacagaatcgcgactggttgtgtgctttggccaagacgaaatccggaaaaaaatgcaggaaacttatacgaaaagcaaacactgaacaactactatcgctggttgaaatttgtttgaatctcgtcgcttcgcgcttccatttgacaaccagacagaagaagcgactaatgccttatgtggatactgtacgccgaatcagcagagcgagaagtgaacggggtgccaagcgagtgcttgtccagaaaggcgcaggatttggcggattgttcgctgccctattgacacccgttctaatggaagtggcaaaatcctttgtgaacaaaaacgcataa

SEQ ID NO: 61531 - DNA, 820 bp, Heterodera glycines
  Genomic contig location: Contig_ID=SeqID_31157; Location=174..993; Strand=-
  SCN-specific regions: Sequence locations=1-192,216-820
taattaaatccattcctttgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcgactttctgaaaaaaatatttatgaaacaaaaaaatcgattttttcaagtgtccgtttggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaa

SEQ ID NO: 61532 - DNA, 870 bp, Heterodera glycines
  Genomic contig location: Contig_ID=SeqID_31158; Location=270..1139; Strand=-
  SCN-specific regions: Sequence locations=1-203,246-616,638-654,676 -836,858-870
atgacattttttcttatattgttacttattcaccctgttcacttttttcagaataatctggcccgaactgttgaaaccatcaaaatttgccttcagtccattctcgcggcccagcaattaaacagctgggacattaatcattgcaacgagggaatttacgtttatgattttttgttggtcgagcatttgtcgaaaaataactgtaataatattaataaaataaataaatatttaattttttttaagattttgtgtcggtgcgctcggttatgccggccaacagtgcctttggattgttttactttgaaattaccattatgcagatgcaatcgtgaatttaaaatgttttcaaataagtttgattatattaagggatgttggagttggacttgccccagagcacatgaggatgcatgaattggtcgggcattttgaggcaagcattgcgttgtggagcgacgggtctatccacagcaaattgccatatgtgccggatgtgcttgacggattcgcacagtttggtcccggtgatgttgtcggatgcggaatggacgcaaacaaccggggcatttttttcacattgaatggccacaaaatttgtaagtaaatgaatggattcaaaagacaaaacaaattcgaattgtttcattcttaagcaagccaatttttgcaagccgaatcgtttcacatgtatgcgtgttgtactctcgtggacatgaatgactccgtccaggcaaatttcgggcccgactttctgttcagcattgtcgacatgttgcccttctgatgggctgtttgtcaatttgccagtggattatcggttgggaattgcgatgttgataataattttcaacactgttaacaaataaa

SEQ ID NO: 61533 - DNA, 542 bp, Heterodera glycines
  Genomic contig location: Contig_ID=SeqID_31159; Location=283..824; Strand=-
  SCN-specific regions: Sequence locations=1-215,237-247,269-279,301-542
atgaatgaagatttggcattttcaattaaattttcgaattattgccatcgaaacggcgacggcaatggcacaaagaagaataacggacagaatgtaatagccaagaagcggaatggaattgctctttggcatcgcaccggcgacaatgcccagcagaacggtcatggcaagaagagaaccaaggccaagggacacctgagaagaaaatgccgtgtttggagggagctggggatgggaaaggggagtgatcagaggataagggaaaatggtagtgatcgaaggggagggaaagaggagaaatggaataaaagcaattaaatgaaaatgagtaccttctcactgcgcggcccttcgtttgagccgggcgtgaaaataccgagaatagaaagagcggagatcagaaagatgggcacgacgatcacagtgatgtaaaaaatgggacgacggcgcaaattgaatacgaaatggacctgatcagagaggaaagggttaagtagtgatcagagcattgggcggcaattttcagagagagtgccaataaa

SEQ ID NO: 61534 - DNA, 1190 bp, Heterodera glycines; identical to SEQ ID NO: 31159
  Genomic contig location: Contig_ID=SeqID_31159; Location=1..1190; Strand=+
  SCN-specific regions: Sequence locations=1-175,197-524,546-556,578 -588,610-813,835-1049,1075-1161,1185-1190
  Gene Ontology: Mol. function=acetylcholine receptor activity; Cellular component=integral to membrane; Biological process=synaptic transmission

SEQ ID NO: 61535 - DNA, 616 bp, Heterodera glycines
  Genomic contig location: Contig_ID=SeqID_6428; Location=167..782; Strand=-
  SCN-specific regions: Sequence locations=1-250,272-377,402-499,532-616
atgggacaagctcgtaacaattccaaccgtttgtctctccaggaactgatcaaagagttgggtgccgccgtcgagctgaccaccgccaagtcggacgcgtttggccaagcgaccgccggcggactcgcccgcacgctgctctccgtgtacatttttgtcagcgtcatccgcgaggtacgcctagtggacgagcaacggatgtgggacgacgcgttggcggtgttccgcgcgtgcatttggggccaaatggtggagcaatgggcccacgtggtggacagcatgacgcgggcactcgtcctgaacctgtgggttttcgtatcaatgcatctttgactttccagagccatgcactttttttgaaaaataattggcttaatgatttcttttgtttatttttgtgtgccgtgaaaatgaatggggaagggtaaactcatttttggacccgctaaaacccatcgaaatcctatcaattttgttcgcctaaattttgaaaagataaccgttaaaaaattttgttttcattaaatttttgatgtattttggtggttcctaaaggcattggaaatttgttaattgataatctaaaaattttcaacttttttgaatggaaaataaa

SEQ ID NO: 61536 - DNA, 929 bp, Heterodera glycines
  Genomic contig location: Contig_ID=SeqID_6428; Location=2834..3762; Strand=-
  SCN-specific regions: Sequence locations=1-46,69-246,306-725,748 -827,850-929
tcctattgcgagggcgcctccatttttgtggacgacgtcccatcctcatcatcatcaacagcatcatccgccaatgctcgtcatctccatgctggttcatcatctgcatcatcctccgtgccaatttgttccgctggcggttccggcgccgatgtccgtcccgcgcgcgcactgccaattgtacagcccgaacttgtggagccgtcaaccgccgccgccggcaatgccaacaacggcgcaaacaatcaacagcaactgttgctgcaacaccaccaccatagtcatcatcaccaccatcatcatcaacaaccatcgtctcagcttagctatcatcagcaccattcgtcctcctccgcctcgtcggtgtcttcgtcgcccacaaattcgtcgtccgcaaagttgcgatttcgggaacgggcacagaacctgcaggtgaatgaacaacaaataagaatttcgaaaaaaaattaagaaacttcagcgaattttggaaaactttggaatgaaaaaccgctcgtaaatttttcgctaccaataagttttttttgaaaaattctacgggcaatttttttttaatgaattttcggggcgtccagagggaaatgaagtgcacccaattttatttgtgttttcagatttatttggacaaatttctcgagtacaccactcgggagacgaccaaaattgactgggccgacccggcacggcgtgcggacaccgtcagcttcatgttggaccgcgtgattgtcgcctacattttcgaggtgttccccgacgcggaggccaacggggtggacgtgttcggcggctgggagggcacctcagctgatgaggcggaggaggagggcggcggcaccggcactgacgcggacggcgccattgtgcagccaatgctggacactgttgacccgatcatcatcgccaggtga

SEQ ID NO: 61537 - DNA, 1143 bp, Heterodera glycines
  Genomic contig location: Contig_ID=SeqID_6429; Location=971..2113; Strand=-
  SCN-specific regions: Sequence locations=1-216,238-278,302-313,335 -338,361-480,502-1143
atgttgcggaaaaagccgcaccaagacttgcagaattcgttgaaccgcttcgcggagtggggccgggacccggtgtccagagcaaaacatttccgcaatgcctacgaatgcctgagtgtccaggtggggcattattgcatttttaatgcaataatcgaacgcatacgaaaagttggatttcatggcaattcgtagactgaaaatggactgggtatttcagtttctttgagaattcttggtttaacacaacatttaattcctggtagttccttttgtttaacaaaaatcttaaaaattttgagtcgattgaaagtgtttatgccactgatttatgctgtccaatttccaggaaaggcgccaactcttcgaggggttcagtttcgaaattttccacctgatcgatgcgctttttctcgcccattacgacgcggccatcgtcgacccgcaaaccatcgccgacgtcgagtccgcactttggatcctggagcaggccatgtgttgtgcacccgaacttgtcggaaagggtgaacaataattatttccgcaaattcgaggcccttgatttgggttggaaacgcttaattcatacaaattggttttcttgggttgtggtttcgattttaggaaattttttacaattcaactataaattttgaaatttcattgacgctgcccaacaaaaccagccggaaacacatccatttgttttcttacattgcgaatttggcttgtgacagtttttgggtccaattatagaaaaccatcccgtaaaatggcgaatatttgttcgtttttgcgtttatttctccatttcctgtctcactccctccatttactttcgctttttaggctggcaaaagaatggcatcgaatttgtgctgaaaatggcactccatccggacaatgtgttggcggtgcgcaagttggccatccgtctgttcctgatctggtaccaggaattggccatgtttggccacacaacgcgctgtttggacaccgtgttcaagtgctgtttgccgcactttcccttgcgcaaccgggcccaatctgaccaacttttactggtacgaaatctttttcgggcttcatttttcgtttttttgagtcctattttaaaattaacactgctgaaaccctaataaa

SEQ ID NO: 61538 - DNA, 1149 bp, Heterodera glycines
  misc_feature (1087)..(1087): n is a, c, g, or t
  misc_feature (1142)..(1142): n is a, c, g, or t
  Genomic contig location: Contig_ID=SeqID_31162; Location=210..1358; Strand=+
  SCN-specific regions: Sequence locations=1-108,130-284,315-580,618 -836,865-914,937-938,960-1149
tgagtattcaagacaaaaatatgaagcacaccttggaaaattgtggagaaaaatttgaagaatatttaaaggaaatgttcaaaaaatcggaagaaaaggcaaaaaaagataaacaatggaaagccaatgaaataaataatggcaaacatttaataattaagcattcgaaatttgatgatcaagggacatgggtgaggagacttaacaatcaatgaaagttatataaatccaaattttagactgcagatgctctattttcggaatttgtcaaaggtttagcgacaaaatcagagaaattttttaaaatggcggaagaatattcaaattatttaagtcgaagtaaagagaaagttttatttgatgaacaagcaccaataattgttgggttatgcgaatttgtggaaatgaaaaagcatttggccagaaaatatgaggcccatcttggccttgtgtatttgatgcgagcgaattggcaatgttcctattttttcaattttattcattgctggggacaatgccaaaaatttcgcaaatatttggacattttgtacgaatatttatttcgactttatgttgaaggttttatttttaaattaatgatttttaaatattataatgcatatttaaggcaaaagcaatgaattgacctataaattaccagcagtgaagccaatatttatgaatcattataagaactcaatgcaattaatttcagtcgtcagggctctaaatgaaattgcgatattattttggtcaaacgacaaaaacaaatttgaggataatgattattggaagatggttttggtaaatgatgtcgaattgaattatgagattaaagaggagaaaaatttgtttaatgaatttaaacaaaatattttgaaaaagtttaacgcaccaaaaaatatgcaaaaaaatggaaagaaaattttaaatttatcaaatgaaattgaaaacaatcttcggcaagaatttgatcaaaaaatggaaaaaatatatgaaaatacgaaagaaaatgccaaagaagaaaaggcaaaattggaaaaagcaattgaaaatgcgacaaatagtgaagaaaagaaagttctgngagttgaatacattgacaaatttggcactttcaattcatcgccatttatttacgnaatttga

SEQ ID NO: 61539 - DNA, 682 bp, Heterodera glycines
  Genomic contig location: Contig_ID=SeqID_31163; Location=468..1149; Strand=-
  SCN-specific regions: Sequence locations=1-682
atgtcaactgaagaaattctcatggatttggtcactgcgacattgaaaggctccgaagagcacttaactttccgcgtgcactttgatgaacggatgcgtcaacttcatctgatgcaaattgacagaaaggcggcttctgactggtcaaaacttgaccaagagaaccgcaaattgtatagtttagcaaataatttaacgaccataactttaacttctaaattcaatttaagactttctacgagaattcagcgtttatcttcactcctcgatgggctcaaagaacaaaatgaaggcgagtatttgctgatttatgacgacgagacgcttcgattagtgcgggaaaggaataccggaaaagcaaaaaagatggaatattccgataatgagggcgaagagatgggtctttgtattcaggaggacgaggaggaaagcggtgaaaggtgagcatttgaattcgcattttgttggcaaatttaatttgattttctccagaaatgccccctctgttggccctgtatacgacttggaatggatcaaacattttatcaaaatgaagccaatcctttcacatgcgcctgtcgaggattattggaatggcattgaccctcactatcctctccagtggcacattgttcgtggtcaaattcctggtgcattatacccaaaaaatcaaaggaattga

SEQ ID NO: 61540 - DNA, 235 bp, Heterodera glycines; identical to SEQ ID NO: 55997
  Genomic contig location: Contig_ID=SeqID_31164; Location=1617..1851; Strand=+
  SCN-specific regions: Sequence locations=1-204,226-235

SEQ ID NO: 61541 - DNA, 1126 bp, Heterodera glycines
  Genomic contig location: Contig_ID=SeqID_31165; Location=190..1315; Strand=+
  SCN-specific regions: Sequence locations=1-462,497-570,592-602,626 -1098,1121-1126
atgaccatggcccgttgtcaaccgctgaacgcgttagcaatgttgggcggggcccgactgtgccaccacacgccaccaaactgcacggacgccattcgtccgcttggtccgaaaagcaatgtgccgagttttaaggttttcttccctaaactgataaaaaaaataatatttgaatcacatttaagggccaggcaattgtgaacgcggaaatgaagaccatttcgtacgacgactacaagggcaaatggttgatcttcttcttctacccactcgactttacggtactttgcgaaatattttctcgggaatttcttgtcgtaatttatctgaacttgacaaaatttcagaaatttgactgatttatagagaaaactcaggaaatttgagagatagagaatgtttaggctcttgtttctggtttcctaaatttggtgccatacaatttttacgtgctataatcaattaaagggtcccctttttggttttagtaaaatttccactgtaagtagcgccatcaattgagctgtttttgtgcaaccccgaagttgaactttacttttagttttgctttttaagttccattcttttccccgacccttcagtttgtgtgccccaccgaaatcattgcgttcagtgaccgcgtcgccgagttcaagcagcttggctgtgaggtgatcgcctgctcatgtgactcgcagttctcgcatttggtccttatttgttccattttctgttgatttaatacgatccgccgtatgtttttaggcttgggtgaacacaccgcgcaatgatggcgggcttggcaagatggaaattcccgtgctcagtgacttcagcaagaaaattgcggctgactttggcgtgctggacaaggagaccggactgtcctatcggttcgtttttctcggccaaattctaatcggtaattgaaaaaagtctaaacttttcccctcatttcagcggtctttttctgattgaccccaatggcactgttcgccattgtttggtcaacgatttgccggtgggccgaagtgttgacgaggcattgcgcattctgaaggccttccaattctttgagaaacatggcgaaggtccgtcatttattttttttttaaattttggcata

SEQ ID NO: 61542 - DNA, 273 bp, Heterodera glycines
  Genomic contig location: Contig_ID=SeqID_31167; Location=83..355; Strand=-
  SCN-specific regions: Sequence locations=1-145,174-273
atgccaaaaaagccaggcactaatcattcttcgtgccgtcgaatacgtccttttctctcggaaccgtgtgccatctgtaaatcagctatacaatgctataattttggggccccgtcatgtcaagcttgctcagattttttcaggcaaaaaattaatttaacttttttatatttgctcattttaatgcttttttaaggcgaactattcgtgaaaaacgcaaatatatctgccgatctcagcaacaatgccaaattgatgaaagtgaataattaa

SEQ ID NO: 61543 - DNA, 676 bp, Heterodera glycines
  Genomic contig location: Contig_ID=SeqID_31169; Location=148..823; Strand=-
  SCN-specific regions: Sequence locations=1-281,307-307,329-343,366 -546,568-676
gccgtcttcacaccgatctgcacaacaacccggtgcgtcagctgggcgagcacacatgctcatcaagtgcggcacgggtggagcggttgcgcattgtcagcaacattcgcaagcgtgcgctggtcacgggcgaagacccggcaaccattcgagccaatgaattgatgaacgtgccggatgcggtgctgtccgtgatgccaagcaaaagtgccacaaaaaaggtgcagttttgctcaactccgaacacccccatatttattttcttgtcaaaaaactataacaaaaaaaaaaaaaaaaattaaaaatcccttttatatgagaaaaaattctatgggtttttctgaaaaattattaattaaaaaaatgtttttcagcgggaaatgaattgtacccgaaatgaaaaaaaaacagtttattagacctcattattattgtttatagctgattcaacgagcacgccatgaaataaatgaagcgcccccaattcccaatcaattgtgcaacttggaaatcccaaaggcgtaccaggtgggggaaaaaaattcgaaaattaaaattttatttccgatatttccccatatttccaggtctacaagcatagtgaggacagtgaggagcaattcttattggctgattccggggtgtacaaggaggagggacttcctggtgatcagag

SEQ ID NO: 61544 - DNA, 1691 bp, Heterodera glycines
  misc_feature (136)..(137): n is a, c, g, or t
  Genomic contig location: Contig_ID=SeqID_31170; Location=27..1717; Strand=-
  SCN-specific regions: Sequence locations=1-722,744-882,904-1395,1417 -1691
  Gene Ontology: Cellular component=mitochondrion; Biological process =embryogenesis and morphogenesis
atgaagaatgcggcgcaagcggaggagctgaagattgcgattggcgccttcgagatgaacgacaaaattgtgaaggacgtcatgacgggaataaaggtgagaatttgtttgtactttttgtgtactttatttgttnntaggacgtcttcatgcagccgcaggatacaattctcaacgcaaaaaacatcgccgaaattgtgcgctcgggctacacacgcataccgatattcgacggctcgcgcggcaatgtggtctctctgctttttgtcaaggacttgattctgttggatcccgacgcccaatttatttgtgggctaatatcttgatttttcatttttatctaaaaaaataattcaggttaagactgtgtgtgagtactaccagcatccagtgcgtcatgtaccggaaaataccccgctacgaacaatgctcgaggagtttaaaaaaggcggtaagtattaactcttactgataaaaacgataaatattcgcttgtctttaatttccagattatcacatggcgctggtggaccgtgtcgttgccccttcgacggaggacaaagaaagcaaatacgaactggtcgggcttgtgacgcttgaggacatcgtcgaggagattttacaagcggaaatcgtcgacgaaacggacgtcgtcacggacaatgtcaccaaaatcaagaggcgccgccaacaagtgtcgttaagaaaatggaagagatatcacaaaatacccctgaaaaaatttaaagcaccgtgaccttgaattgttcatcgacgacggggaagcttgtcagatttctatgcaaatgcaactcgtaaccattcaggtgtgtatgcgtgtgagaataaataaatgtgctgactttgtgtgtaggggtggtcaagatgggattttgttctttttagattcaattcataaaatcatttgttttattgtcctcgtaaaattctctcgttttttgtaaaccttaattgtaaaatataagctatcaaataacttaaaaactagtttgatattgtacttttaattaattttatgttgcgtcattcacttttcttgtcttatcaccattctgattacgttttgtgttagatcttcgtcggatatgtttttgactttcgcttgcacctatcactgatcgttgatttaccaatgactatacccatcctttcagtttttggagggcactttccgccgtgcgtttcacacggacagaatcgcgcaggccatcctcgagaaggtcatccgggcgcatgtgcaccgggtggaggtgtcccatttggccgacttcaactgtccgaagacggcgctcccgcgcaaagcgcggctgtatgtaaagaagcagccatcggacaaattcattttgattttggagggtcgcgcaatggtcaccattgggcaggtaaaggaaaatttacaattggaaaatagaccatttttagactaacaataagctcttgaatcactgatttctgtgacttaatgcctttcgttttagaccgaaatgaagttcgaagttggtccttggcactttttcggcaaggagctgctccaacaattgaaccaaatcatcgaaggcgaccctggcaatcccccggctgcctcgggcgccgcggttagcggaacggcgtcagttgtaccagcagcgacaaacggtggtgccaattcgcacagtgacaagtgctgccgg

SEQ ID NO: 61545 - DNA, 1193 bp, Heterodera glycines
  Genomic contig location: Contig_ID=SeqID_6430; Location=167..1359; Strand=-
  SCN-specific regions: Sequence locations=1-739,761-1193
atgagagcattttgttcaatgcgttccctttatatacgcattttgaatttttcgagtgcttattttcaaggacattttgaattcaatgatattttcaagtaagagggccaaattccaaggaccatccttgccaaactgaaaaggaaataacataggaaaggatgagaaactgagcggtacgattcgattcacagcagttcatccaatcctaattttatgcatacggatacaacatatatgcaatggcataaataacaatttaccaacaaatatgaatccaatttatctcatatatcatcaatcatatcgtcggttcatctatattttatggcaccagcatcgtttcaatctcgtctctctgctcattgttcacacaaaggcacatccgttcttctgcttctgatgaatgcacatattaagcgattttgccacgggtttgtcgggttgaattttgctgtggccacgcgttgcgatcactcattccattaatctaaaaacaattcgtacaaaaaaaaatatagaaaagtaggggatacaaactccattagtaccaaaataagattgggtgacttgttgtgaaccgtaccgttcttgtttcatcattacctatgctatttcttttcagtatctttcgaatgataccaaaattattcgattttatagggaatgaagcgagttatggctgatcaagtgtgatcaaaactaaacaacgcaaataaggcactgaaaatagtaaatactaactaaatttaaaatattatctctaaaaaacatctattgacttatttgaagtgggttggaagctttgacgttgattaggcatttgatcaagcataaagactctttgttttttatttgaatttactggcattttgtttttttacgccatttattttttggcaatttttttctttctttttttcgctgcccgtcaaaatgtcgccgcgtcataatgtcgccgcgtcaaaatgtcgtcgcatcataatgtcgccgcgtcaaaatgtcaccgcgtcataatgtcgccgcgtcgaaatgtcgcccaagctaaaaaattagtgaaaaagtcggaaaattacatttttaaggcttcgtaacacataattcattaacgatttatcagaatagcataaacaaataacaaaaataataaattttgcaggaaaaaggaatagttcaaaaaatgaatgaataaa

SEQ ID NO: 61546 - DNA, 188 bp, Heterodera glycines
  Genomic contig location: Contig_ID=SeqID_6430; Location=757..944; Strand=+
  SCN-specific regions: Sequence locations=1-188
atgatgaaacaagaacggtacggttcacaacaagtcacccaatcttattttggtactaatggagtttgtatcccctacttttctatatttttttttgtacgaattgtttttagattaatggaatgagtgatcgcaacgcgtggccacagcaaaattcaacccgacaaacccgtggcaaaatcgcttaa

SEQ ID NO: 61547 - DNA, 1437 bp, Heterodera glycines
  Genomic contig location: Contig_ID=SeqID_6431; Location=2245..3681; Strand=-
  SCN-specific regions: Sequence locations=1-59,81-392,417-716,738-1416
atggcgccaagagcatgcaaaaaaactggatcaaccccaaaaagtgacgaaaattgatcaaattaattttattttaaaaacactgcatttttcagggttaaagcagaccgaagccgtaccaacagcagatggagaggggacatcgacccaagccgccgaaaatgggccgtcaacgtcaactccggaccttcgtaagtcaaaaaatcactattttgaagcaaaaaataaattaaggaccacgttcaagcccaaggccattgtcagcgactccgatcaggcgccatgtgggtttccgtccaaaaactaccgacaatgcaacaaacatggatttgacaatgatggacaaggcaacggacgtggatttggcttatgaggacgccgcgacacaaaccgagcagttggacaaacagctgaaggagcaggaacaaacgatcagctttctacgactgcaggtccgcaacagagacgcaatgatcgctgatctgagccgtcaattggaacaacaggcgcagaatgaccagctgacaacggccaaggcttcacaaaaataaccatttccttggcccatacttcacatgcaaattctccggccaacaatttcatcgtggcagcatttcccgcgaaggacaaaagggaaaatttgatcaaattctgcggcaacatttggcaacagatcggcaaattgaatgaaattgcgggcaaaaaaaatcaaattgtaaattaacatattttttctggagtcaactcaatttttcaggtttctcggcggtgatctgagcttcttgtgggcactgattgacactgtggctctgccgttacgacatttccatcccgtttgcgattgtcgccaggaccaattattggacgcgaaaagtgccaaatgaggacatcggaggaaactttgaagtaagcctagcagtttggacgacttgtggaaaatggagaaaaaccgactgctgctgctcgagcgctcaccaggggaactgtcgatgagccacttttacaatcaattgagtttgaacgaataattctggcgccttttcacgtcttccagggcattggaaatgctcttatcaaagagctcgaagtgacggaaaacgcggaaattgcgaacgaatttttccggagcatcaggggccaggaggggaagtgttcaggaaaaaaggacatgacgggaaactcaatcagaaaagttctgattcatgcggaccaattggagaggctttactcagctgaatggccacaaatcattttttgcagagcatggcacatttcgttcctcaagttgaatactcctggcataaaaggattgatttggatttatgaagcgtattgtccgtcgtttttgtataaaaaattattgaattctatattaatgggtaaattttatatatcattgcaaattgcatcgattgcattgaataatccagtaataaa

SEQ ID NO: 61548 - DNA, 285 bp, Heterodera glycines
  Genomic contig location: Contig_ID=SeqID_6431; Location=2429..2713; Strand=+
  SCN-specific regions: Sequence locations=1-285
aaatgatttgtggccattcagctgagtaaagcctctccaattggtccgcatgaatcagaacttttctgattgagtttcccgtcatgtccttttttcctgaacacttcccctcctggcccctgatgctccggaaaaattcgttcgcaatttccgcgttttccgtcacttcgagctctttgataagagcatttccaatgccctggaagacgtgaaaaggcgccagaattattcgttcaaactcaattgattgtaaaagtggctcatcgacagttcccctggtgagcg

SEQ ID NO: 61549 - DNA, 207 bp, Heterodera glycines
  Genomic contig location: Contig_ID=SeqID_6432; Location=1548..1754; Strand=-
  SCN-specific regions: Sequence locations=1-207
atgaaagaagaagacagacactggaatttgattgtgcaagattacaacaataacccacaaaatggaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattga

SEQ ID NO: 61550 - DNA, 64 bp, Heterodera glycines
  Genomic contig location: Contig_ID=SeqID_6432; Location=402..465; Strand=+
  SCN-specific regions: Sequence locations=1-64
gctgattattttggtttgtaactttctttaaatgttagaattctcttgttttctcctattatta

SEQ ID NO: 61551 - DNA, 715 bp, Heterodera glycines
  Genomic contig location: Contig_ID=SeqID_31172; Location=731..1445; Strand=+
  SCN-specific regions: Sequence locations=1-6,29-231,294-487,510-715
ctgaccgatcacttcctcaattggctggtctcaaatgggtacgaaggcgacgcgttcgatcggcctgacattgggccaagcggaagtttcggaggcaaactgaccacggcacaacaggtgagaatttgggggggggggaaacagtcaattaaaatttgaattaattgtttttttagataacgaaagaaccggtcatttttatacatggaacggtgggaatattttaatacgattaaattaataaaatgattaaaatgctcaaaaataaattatgtaaaaaatatttaaaaattcgatgggcagggagacgccgcacttcacacgcaggcgccccaagcgacaggtgacaacaaattagcatgaaactttgcaattatgttaattaatgcaattgctttcttttaggctggagtcggtccatccaatatttcctcgagcaaaatgtacagaaaaatcattaaaaccaaaagttaaattgtaaagcctgattttttcattttgctacttcagtacacaaatgccgaactttacgccacgacttggggcgacacgtgggggacgggaaatattctgggtaaaattgataataaattaagataaatcaaaaacaaaatccatttttaataaagaagagtttcctaaaaaatttaattggcactaattaacagatggctatgccaccatgcacacctgcttcctatttggtcaattttga

SEQ ID NO: 61552 - DNA, 691 bp, Heterodera glycines
  Genomic contig location: Contig_ID=SeqID_31174; Location=630..1320; Strand=+
  SCN-specific regions: Sequence locations=1-173,206-246,268-353,405 -563,587-691
atgtgccatctcggtgacccagcccatcagcccgaaactgcttattacactgacatcaatgccttaatttcatattgtgccgaatttgtgtgctatgcgctgatttggctgatcatttggagaagaacagcacaaagtcattcagtttaattaggattagagaaacgattatattaaatttggaattttttaaatttgatttccatttatagaaccctattttgaattagcgaattaattaatctatgaaaaataattaatgcatttttagttacggaacatgtaaaaaagttgacaatttctgtgagtgttctcatgtcaattgggctcttatgctacattttggtcaacacataatattttaaattaaaattaattaaaataatattaataataatttatatcccatttcagaaccttttcattgtgaagggcataattccgctgctcagtttggacccatttgcaattgaattttgtgtctttccgatcagtctttttttccaaacgttggcatacggaagcagcgcaccagtgctttacttttgcaagtgcaaaacacgaaaataaaagtttttcaaaaaagtttggatcagaaattcatgcctacccatggctggacctgttttttcccctgaaaatccaagaaaactcctagccctggctggacctatttttttcctaaaatcca

SEQ ID NO: 61553 - DNA, 244 bp, Heterodera glycines
  Genomic contig location: Contig_ID=SeqID_31175; Location=1..244; Strand=+
  SCN-specific regions: Sequence locations=1-244
cggaaccagcacttgtgaaaagcggtttgtgacggaacggtggtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatgaatgaccgacccgaaattttgtgtattttcgttgttttttatgaatgaat

SEQ ID NO: 61554 - DNA, 839 bp, Heterodera glycines
  Genomic contig location: Contig_ID=SeqID_31177; Location=234..1072; Strand=+
  SCN-specific regions: Sequence locations=1-385,407-441,463-528,574 -723,751-758,780-839
atgggaaccatctcattgggaacctacacgttgttgaaggctgcgttcccgctcggttcgcttgttgccagtgccttgaatattgcaacaaaagtgagtcaatatccccatatatgaaaatacggtatttaaataaatttcagccatcgaaatcccaacatttttatttggtcttttaattaaatgagtttccctgatgcttacatatcatgcgtttgtttttttcttctgacgtgctattgggattgaaaaataattattagacactttttaccagttatttaggtgctaattgggaaacctcgattatttggcagttttcctttattacacttatcgctatttacaaaatatatttcccgtttatacattttgtttttggtttagcctgaatccgaggaatacaaggccttccaacagcttcacaaaaaaatggatgaaaattttgataacatcagaacaacaattggagtagcgaggaaggttatatcgatggaagcacgattgcttgactacaaaaatgtaagcttaaaaataagtttaaattattatatgatttaagtatatttttttcagaaggttcaagttccaatcaatccactccgtgacctgctggacttgttttggaacccggctgttccaaaaaaggcatcggatgtcgacgagtttcgattgctgtgctatcgttctcacgataagacgcccttaacaattcttcatgtgaatatattttttaatattaaataattagtttggtaaatactaatcagaaggaaaattttagagaaaagggattgttttcattttttgcgtaggtattttacattttttgaattaga

SEQ ID NO: 61555 - DNA, 646 bp, Heterodera glycines
  Genomic contig location: Contig_ID=SeqID_31178; Location=255..900; Strand=+
  SCN-specific regions: Sequence locations=1-364,388-411,434-543,565-646
atgagtggccttgaaataatccgacgcttctgcattatgtttccactggacaaaatgatcatgatttggccaactgttcgcaaatgtcgcgtttccaggaaagtggcggattgggtgttgcttacgcatgacccaaacataccaataaaggaccaacaaataataccataccaaggtatgtcatgccaagtaaaacacgacgcggttatattacaatttttttcatttttccaggcctatgggaacaaggttttcccgattttttgtcgtccccgaattccaagttcgaacacgaagattttaggcattgattcgggacaaaaaatatccccctacctaaagatgcattaaaagtcatggatggataaattttaaaaataattttttgtgcaacaattgtcaactttttccatttttaatatttttaaattttgggcaaaatccgatccaaaatggcataaaatttcaatttctgcaatatgtttttgctttcagacagtgaggcagttctgttatcaaacacttatgtggacttgttaaaagacaatgaactgtttgaatcaggcacagatgtatcacagatatatcgcataattcaacaaagcgacaaatttttattggcagcaatttggctggtaaattaata

SEQ ID NO: 61556 - DNA, 150 bp, Heterodera glycines
  Genomic contig location: Contig_ID=SeqID_31180; Location=1..150; Strand=-
  SCN-specific regions: Sequence locations=1-100,123-150
gaaattgacacctttaatgttttgacaaagctgtgcccaaaattttgaatgacaccgacgtgtgggtcagcttttcactgtccttggtaattggaatccaattgcttttgttttttctctcaattgaagttgacagataaagaaaaattt

SEQ ID NO: 61557 - DNA, 505 bp, Heterodera glycines
  Genomic contig location: Contig_ID=SeqID_31181; Location=68..572; Strand=-
  SCN-specific regions: Sequence locations=1-1,23-31,53-133,155-265,287- 295,317-397,419-427,449-505
caaaagttttttacaacaatttattgccaatctaatttcttgcagattgaaagccatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccttacccaaaagttttttacaaccacttattgtcaatctaatttcttgcagattgaaagccatccattgcctgccggttctcggcacagcaaagcactaatagggtgtttgactc

SEQ ID NO: 61558 - DNA, 4415 bp, Heterodera glycines
  misc_feature (2114)..(2114): n is a, c, g, or t
  Genomic contig location: Contig_ID=SeqID_6433; Location=2569..6983; Strand=+
  SCN-specific regions: Sequence locations=1-391,413-2323,2345 -2464,2486-2597,2619-3002,3025-4176,4198-4327,4349-4415
atggacgcgcaacagctacaacaattgcttaatgcactccaacaaatggtcactaatgccgcaccagcaaatttgagcaatgccagtttggcaagctctatcgatgctcgcctttcggcctttcattacaatccggaggtcggcaccacatttgaaagttggttcaaacggtttgggaaattgatcgaggacgacggaagcacactgccggaggcctcaaaagtgcggcttctcctcggcaaactcggagaggaggagtacagcaaatatcgggacacgatcagcccaacccagccggaccaagtgaattggaatgacaccatttcgcacctcaaacagctttttgccgagacacgttcgctgtttgtccgccgctacgaatgcttcaaaattcgacagcaaccaggacaggacgtgtcgtcacttattgcgcagatcaacgcatcatgtgaaaatgccgacctgagtctgacaaaggagcagctcaagtgcattattttggtcatcgcactcaacgatgaacaccatgatttgcgacaaaaggcattgaaaatgttggaggacgcgcagaaaaacggcaccaacatttcgctcaagaaaattgaggaggaacttcgggcaattcagcttgtcaaggagagcgccctttcgctggtcaacccaccaattgccacaaacgccattcgcacaaggccacggcaatggaccgacccagcgcaaagacaaagcggcggctccaatcaaaggcaaactccaaatgccaattcaagcggaaagccaacgcgtggtcaaccaacgcttccgtgtggatcatgtggcaaatccgaccactggcgctccgactgcacattcaaggacgccacttgctttaagtgcaacaaaaaagggcacatttcaacaatttgccggtcaaagaaggcaaaggcaccaccgaacagccaccggtcattccacactgtcaaaatcgacgcaaattgcttacatgtcggcacgactcaaggacgatggtggaaattgtgcattttgattaatggaaggcaaacttctatgaatggcgacaccggcgctcaggccacaattatttcattgcaaacatggcgagagttgggagaaccggaactgactccatccgacatcgatgccaaaaactgcaatgaccagccattcgccttgcttggcaaattcatctgcaccgtccaattttccgacaaaccaccgcaaactctgatcgcctatgtgagcggagaagtcggacacaatttattgggattgccgtggatcgaagctttggagatcatcccccgccaaattttatttccgtccagcaaatcggctgatcaggcgacaaaaatgattgacaatttttcggcagtgaagccgccaaacaaatcgatcaatgatgtgtcaacgcttaaagcggcactccaaaacgatttcccggaagtctttgaagaaggactgggacactgctcaaaggcaaaggcgcatctcattttacggtctgatgcaaagcctgtattttgccgagctcgccccattccacacggcgccatggaagctgtgaatgccgaattggatcgtcttcttcaaattggcgcaattaagccgattgatttcagtcattgggccgcaccgatcttggccgtaaaaaagaaaaacggcaagacgagagtctgcatcgacttctcgactggcctcaacaatgcattggaattgaaccggcacccactgccaaggccggacgacatctacgcttcactgaatggcgcgaaatttttctcaaatttggatttgcgcgatgcatatttgcaaatggaaatggatgacaaatccaagcaattgtgcgccatcaacacgcatcgcggactcttccaatgccaacgcctgccattcggagtcaaatcggcaccggcaatatttcaacatctgatggaccaaatttgtgccggtatcccaggtgtattcgcgtatcttgacgatggattaatcgccacaaaaacgcttgatcaacacatcacggcactgtacactctttttggacgcataaaagaatacggtcttcgcatccaactggacaaatgcaaatttttgcagcccgaacttttgttccttgngcatattgtgtcagcaaatggcattcgtcctgacccatcgcgttcggacgcaattcggaaaatgcccgcaccgatcgacaaaagcacgctccgatcattcttgggagctttgaattattatggcagatttgtcaaatgcatgcgtgagatgcgtgcaccgctcgacaaactcctccaaaaggacgtagtttggaattggacgtccgaacagcaaaatgcttttgaaaaagcaaaggaaacgatgacgtccgaccttctgctgacccattacgacccggcacgcccaatcgtcgtatcagcagacgcctccaaggatggaatcggcgccacattaagccacacattccccgacaaaaaggaaaaagtggtggaacatgccgcatgcacactgacagcagcgcagcaaaattacagccaaattgaaaaagaggcattggccattgtgttcgccgttcagaaatttcaccgcatggtatacggcagaaaatttattttgcaaacagaccacaagcctttattggcaatttttggctccaaaaagggcattccgatctatgccgcgagccgcctccagcgttggtccatgatcttagcgaattatgattttgaaattcgctacgtcaacacaacgtcatttggccaagccgacgttttgtctcggctgatcgcaaattattcgcgtccagaggaggacatcctgatagcaaacatctgtgccgatacggattgctacattaattctgttttcgaaaacagaatggatcagctccccgtgacaacagtcgaaattacagcagaaatggccaatgatcaaccacttcaaacggttcttcaatttttgagaaatggatggccagcaaaagtcgctgattctgaaattagtccatattttccaaaaagggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccaggaatggactcggcgattgaaaaagttgtgagcacgtgcgaagagtgccaactgggccagaaaaacccgaccaaagcgcctctttcgccatggccaacgacggacaaagtgtttcagcgagtccacatcgattttgctggcccctgctcagacggtcaccaatatttgattttgatcgactcattttcaaagtggccagaagtctatcgtatgaatacaatttctgcttatgccaccgtatttgttctccgatcaatcatttatcggctcggaatcccagaggaaattgtttccgacaacgggacccaatttcgatccgccgaattcgccacattctgtaaagaatttggaatcaagcacattttcacaccgccatttcatcctcaatcgaatggccaggtggaacgcttcgttgacaccttcaagcgatcaatgaagaaaatgtcaaaaggtggaaaggattggatcgaaaagatgctgttctcctacagaaccactccccacgttgccttaaatggcttttcacccgatcaattatttttcggcagaaaattgcgcacgaaattgtcgctcgttcatccgaatggagaaaaagccgaaaattttgatcaaaactcattcaaaaagggacagtcaaaatacaccgacaaaatggctcaaaattttgatcggaagcatggatcaaaactgatcaatttctttccaaatgatcatgttcttctgatcaattatcgaaacaacaagacggagtggctgcaaggaaaagttgttgagaggcttcacaaatcgcccacatatcgtgtttatgtgcctgttctgcgtcgactcgttcatcggcacgcgaatcagctaaggcgacgccatcttttggaagaagaagccgaaaaggaggcacctcaaatcgaagagccaccgccggttgtaaaaccacctcttccacctcaacaaaatctgcctcagccagccaattccccgttggtagtccgccgatcaacccgagtcaaaaagccccgccaattttattcgccatcaaaataaattttttttttggcttaaaccttcgggtttcgaatttaagaggggaggtgttagagaaggaagtaattattgattaggtgtatgaccccacgccacttcgccatcttccccctccgattcccctcattcaattgttttatttgtgcccaccaattttgacctcccaatttattttctctgcatttttattattttattttcttcggcaa

SEQ ID NO: 61559 - DNA, 430 bp, Heterodera glycines
  Genomic contig location: Contig_ID=SeqID_31182; Location=46..475; Strand=+
  SCN-specific regions: Sequence locations=1-124,146-207,229-366,428-430
atgccaaagtgggggaggagtaaaagatcaacaacagcacatactgtaagtgtatttgttatctcttttcgcaccaaaaaaaaagtgtgaaagaaaagcaaacaataaataaattttcaggcaattttctattaattccatttaaattcatgctcattattttacttaattctcgataattagttataaaatggtatggaaacattaataatgtaaagcaatttttagttccgacctacgaaattgaatttcgtgtcatcataataccgtacccattttcaaaaatacgggtaatgattatatgaacttttgaaaatcacaatgataaagaatcaaataattacctatgcaaaaatctgaaaatggatttttttttttcataacaaaattttttttaatgatttattttacatatttaaaaaaaattcca

SEQ ID NO: 61560 - DNA, 445 bp, Heterodera glycines
  Genomic contig location: Contig_ID=SeqID_31184; Location=399..843; Strand=+
  SCN-specific regions: Sequence locations=1-445
cgttttaaagttgggcaatgcctttgccatttttgaaccgggccctgcaaatgttctcgagcgtcgatttgcccgatttcgcatcagattggcactgttcgacgccgtgtcactttcacagaacgaggctgctcaatttgttggcacgaaatttgttgatgacgacaattatggcacttttgggcgcctaaaaattgggcattttgccacaaattatgccaaagacagtgccgtcgttgatgatgacacaaccaattcgaaaacaatcaccgattttggaccaattgcttatgccattcaaacgtcgggctctaccggtgcaaaatttttgttttttgtgccaaccgatttttgtgtgaaagtgccaaaatttcgtttttttcggattttcaggcattccgaaggtcgtcttggttccgttctctgccattttgccaaatgttga

SEQ ID NO: 61561 - DNA, 516 bp, Heterodera glycines
  Genomic contig location: Contig_ID=SeqID_31187; Location=702..1217; Strand=-
  SCN-specific regions: Sequence locations=1-516
gcagaacataactcgaaatgtgaagcagaaacaatggaagtaataaaagcagaacaagtggatagaaaacaaagaaaaaaaatatttaaatgtaatagcgatgtaaagactatctggagacaaggccttgaaaaagttagggaagaagatgcgcaaaaagatgtcgattctttggaacaaaattccttgactaacctctatccatcatggatagaaattagaaagtcttataacagaagacgtcagcaagcacacggatcagaagcagcagaaccatttgatgtgcctccgaggcttcaattaaccaaatttggggcaatcaaattaacaatggggaaaaaaattgctggaagtgaatggctgatctataaaaatcaagaaataggtgtaatgatattcgcctctcaaacacaattagacgcagcaaaaaattgtcggattatggtcgctgatgcgacttttgaactagccccaaaaggcttcaattcgaatatggccacatctaaaggcatttga

SEQ ID NO: 61562 - DNA, 477 bp, Heterodera glycines
  Genomic contig location: Contig_ID=SeqID_31188; Location=609..1085; Strand=-
  SCN-specific regions: Sequence locations=1-104,149-199,221-300,326 -363,385-477
atgtccactttggctaagcgacaggaatatacggtaactaatgcatagaaaaaaaaaattaaattagcaaaatttaaaaaaacgaccatttagagtcaaaattcttttaatttaaactacaaaatataaaattatttaattaatttatgtgaataatgacaaaattttagtctgaccaatggcaggaattggaaagcgaatttgagaagatcaaatacccggatgcttatatgcgcgaagaattggccaaggaaatgggccttacggcggagcaagttaatgtaattgagggggacgcccaaattatttaatttatatttattttcgaaaattaatttagaaatggttccaaagtcgacgaacaagagaaagaaaatgggataaactcgcagaacacacggcacagataaagaaaaaagtttgtggaaatgattaatgttaacagacaaacgccgtagaaaatttgaattcattaaa

SEQ ID NO: 61563 - DNA, 848 bp, Heterodera glycines
  Genomic contig location: Contig_ID=SeqID_31190; Location=309..1156; Strand=-
  SCN-specific regions: Sequence locations=1-67,89-192,214-214,302 -357,380-390,412-466,488-620,643-777,803-813
atgcgatttttgatggagaaattatattttgtgcacaatgaattggatatatatgttcttgagtaagaaaaatctaaatttgatcattaaataatattcataattaaatgatcaaaaaatatctatggaatattataattaggacgaggatttttaggagcgaaattccaatttattggcctaaatagtggcgaaaaatttgaaaaatctgtactttttttcaaaataatataacttaatcaagaattttaaatataaaaaaataatttcttcttttttgaataaaaacttaaaaaaatttcggttttacggcttattctgtagtataactggaaactattaataaattaattaagaaaataaagagcaaattaaatttagtgagcaaaatgaaaggagtttaattaaaacaattgagtatttggaggcgattgaactgatgaaaattgaaaaagaaagtgccgattttaaaacccattctcccaaacaaaccgtgtcaattcctcaaaatgataaaaaagctaatgggctaattaccacccaatttgggtcattcaaaagcacagaattcaaccaaatgttggacattcttcacacgcacatattttcagttttggtagcaaaaaatgtgcaaaaaattaccgcttcaaacgaatcggatgaaacgaaatgcgcaccaaattggcaacgttattattcacacataataaacatggaacggctgaattcccttttcaaaagtgtggaaaatttggtgaaatccgtggagaacattgaaaagatggaaaaacaacagaaaataggttaaatgtcttttaattattattttttaaaatgttttaattaaa

SEQ ID NO: 61564 - DNA, 1088 bp, Heterodera glycines
  misc_feature (23)..(23): n is a, c, g, or t
  Genomic contig location: Contig_ID=SeqID_31191; Location=207..1294; Strand=-
  SCN-specific regions: Sequence locations=1-297,320-684,710-992,1014 -1088
atgctatcgctgtgcgccaattngagagccgaaaccattagttccgtgcggcatcagttggacaatttgaaggattacgtcacgccgccggtggaccgtaagtgttgcgaaggcaacagaatttgcagattttttcacgtttctagctgcctcttacaacaattagtctcgggttttttttttgggtttccaggaccaatacccttggaattttttccatgaggcatccattggtcggtttgcggtgtctatgaaaatgcgtgcattttgcaggcgtcgaaaaggtcagtcggccgcacaacaacgaatttgtggactccatcaaaagttgtatggccgagattcagcgctcaatgcaggagaaattgcagaacattgtggaaaagcgactggtggcagccctaggaaaagtgggcgaaaaaagcgaatgatttattattttcatttgtttgtaatgaataatttaattttattaacccctccccccaattttgattaggatgacattgtgttccccaacgtggacgaccaaacgcaataccaaaatcgggtcggtttgctgaagaagcacttgcagcatttgccggaccccgtcacacggctgttcctcctccgctcgataaaccatctttcggtaatgactcattaattaagtcttattacactaattacccagcccctcacttattttaaagtttttctcatttttcagcattatttccatgccattgccatcagcgatttgttgcccaattcgttctcgctcgattatctgaagaccaaaatgtcggaacacatgaacacatcggacaacccccagttcaatcagataaacgccgatttgatgttgcgatacaccggttaaaaaaggggggatttagaatttaaaaaaatggaaattttgtttaatttgagccacatttaaaaacgaattgctttattttccagagcttgagcgtcatctgaagcaaattcagcttgccgaattggaggaacaagagcaaaagaaaaggacacttttggccaaggggaaaggcgaatgccaattcaatttggagaagaaggaaattctgaaccgactctaccgg

SEQ ID NO: 61565 - DNA, 215 bp, Heterodera glycines
  Genomic contig location: Contig_ID=SeqID_6434; Location=2031..2245; Strand=-
  SCN-specific regions: Sequence locations=1-143,165-166,208-215
atgtgctggtgttgctcaaattggccgacttcttccaggtggactggttgaagaggcgctgtgagacgcaattggcaaattgcgtggaaattccgctgatcgaccgtttccttctgatcgaaaaatttggactcatcaatttgaaagtgatttttaaatatttccgaaattaaattttatttttatatatttttagaattattttttgcatttga

SEQ ID NO: 61566 - DNA, 386 bp, Heterodera glycines
  Genomic contig location: Contig_ID=SeqID_6434; Location=1058..1443; Strand=+
  SCN-specific regions: Sequence locations=1-386
cggtaggggtcaactccgtctggccaactccgtctcagcaatgttcaaaaagctataacttttttctttgttggccaaacttcacaatcatggtatcattcgaaagccctagatgtttagaagatatttataagctgtttctcagtgattaatcagctctcaaaaaagttgtcagtttaaacccacaaaaaaggcagaattttcagttttttctttctatcttttttttatagttcgaaattttctgtaatttttagtaggctaatagagcctgtgaaaagctttcgaatgatatcaagattgtttgattcggtcaataacttcaagagttatattgactcaaagttggctcagacggagttggccagacggagttggcccgttcc

SEQ ID NO: 61567 - DNA, 838 bp, Heterodera glycines
  Genomic contig location: Contig_ID=SeqID_6435; Location=728..1565; Strand=-
  SCN-specific regions: Sequence locations=1-38,60-126,163-480,525 -579,615-629,683-704,729-838
atgcgggagaagcagcatcgactgatcactttgaacgagttgggcctggacatggagcagttcaaggactttatggaggcaatttcgctcgttgctcttcagtgtccgattcttccaaatcgtaagtttaaaaaatttcaattttcattaatttttataattgcatattttgctaacctaacaaagggaagtgtccgtgggatttccaaatgaaacttggttaggtggatagagcacccataggttcttaagaaaaatggttttattttctgccaaatgagtacgagtgccgagttatgacatgccagtttttagcttttttataattaaagaaaaggaacatttatttcgtgttaacaagcaattgttggtgtagcggtaatgtgttagtcaaaaacttttcggtcacaagttcgaatcccctatgtgtaaatccattttgtaattttgtttttgctttttatgtgcaattcaattatcaaaaaaaattatttctttatcaaaatatttattttaattttattcctttaaaaatcaaaaaattccattaaacataaagatgtaataaatatcctgtcgaattaaaaaatatatttttgtctaatatttttattgagtatttgctgcactaaataatttcaaaaaaattaaaaataaagttttttttataaaaaaatattttgataattgacttggcataatagaaaaaaattaaaaaaattaatttacatgtaggggatccaccctgggttaaatgatgctaactagcgcactatcgctacacaactggacaccgtgcttaggtacaaataggtatttcttttatttgatcattaaa

SEQ ID NO: 61568 - DNA, 378 bp, Heterodera glycines
  Genomic contig location: Contig_ID=SeqID_31193; Location=870..1247; Strand=+
  SCN-specific regions: Sequence locations=1-151,185-378
atgcttatctcaacgttacaagtgcgtaaaaattttaggtatttaactaaaaatcgcatccctataaatcagtcagaattttgcttttttcaggaaaggcaagcgcacctcaatgcgttacaggccgtctgcgatgccgacatcaaaagtgtcaaagaggaagaggagaaggagaaggaggccgcgcaaattcttttacaggcggaaaaacagcgtgaagaggccgcgcaaattcttttacaggcggaaaaacatcgtgaagaggccgcgcaacttcttaaagaggccacagaacgtcgcaaaaaggcggaagaaaaaaaggaaaagtctgttccaagagcttcgatgtcactggtcacgaatccgttatccatttag

SEQ ID NO: 61569 - DNA, 75 bp, Heterodera glycines
  Genomic contig location: Contig_ID=SeqID_31194; Location=240..314; Strand=-
  SCN-specific regions: Sequence locations=1-75
atacttctgattttatggttgatccatcttttgctgatggctcattttatccattcgttactttgtttgactctg

SEQ ID NO: 61570 - DNA, 205 bp, Heterodera glycines
  Genomic contig location: Contig_ID=SeqID_31198; Location=878..1082; Strand=+
  SCN-specific regions: Sequence locations=1-205
gccattcccaaagcattttgtgcgttgactcgccgagttgggacgatcaaatggtcgcctccgggtccaaagacaattccattttcttttggcgcattggtggagtgaagacggactcggccagcgatgggcaccaaaatttgacggatgcatttatggccgacaaaattgcagtggccacagggcacactcattccgtggcaag

SEQ ID NO: 61571 - DNA, 797 bp, Heterodera glycines
  Genomic contig location: Contig_ID=SeqID_6437; Location=362..1158; Strand=+
  SCN-specific regions: Sequence locations=1-631,653-747,769-797
caaaactatcgttcccaatccgtaaatgtgtccatgtcatcgtcgatggtgggccagaacgggttgtggacaaaaccggcacttttcacgaaccgacccaaagaagagcggcagcgtgagcaggacgatgacgcacttaggtagcaattagtccgggcgcaaatgtctggacgctggtctgacaaatgagacacgttgtccgggttttttttttgaatatagctcggccaaaaaaatttgggtagcgaaaaactacaaacaatctccgccgaaaaaaatagattgactgtatgcaaaattggtccattggtccccggatactaccaccgcccatcatttttttaacttccattgtatggccgactatctgtgacacattttgttaaatgaaaattcttatagggttatgcgtgagaaggagcggaggaaagaaatgcgccgaaaatttacgcaagagaaccaagcgcaacagaaacggcagaaggacattgagaaacggcacaatgaatggacgaaacaaatggaagaggaaagggaggcagtgaaagaacgaatccggtgggaatcgcctgatgaaaaagatttagagcaaatacctaattagaactcggagagaaaattacttcaaatttcatgttttaaataatttctgaaaatgtgcatttttcttgaaccggaaattattaaaatattctaatcgcaattatataattttcaggatgaataaacaaaagttggaggagcgcaagaagtcgggcatgaacggggaaggggacgacgatgacgaagaaaattaa

SEQ ID NO: 61572 - DNA, 268 bp, Heterodera glycines
  Genomic contig location: Contig_ID=SeqID_6438; Location=619..886; Strand=-
  SCN-specific regions: Sequence locations=1-199,227-268
atggctaaaactggttttcccgattttaaatcggtaggtttaaattgttcaacaaatgtgttatttttaagattttccttggcaataaaacggtaatacagtacctgagagaagccgaattcctcctttatgtggtagttgatgaactcatttttgtgttgccatgcaacaaaccaccttaaattcaacagatggaaaaacaattaaaaaatgtttatttttgaaacacgcctcgggtcccattgttttgatgacttaaatgaataaa

SEQ ID NO: 61573 - DNA, 2695 bp, Heterodera glycines
  Genomic contig location: Contig_ID=SeqID_6438; Location=1014..3708; Strand=+
  SCN-specific regions: Sequence locations=1-169,191-836,858-953,975 -1151,1173-1534,1563-1664,1687-1878,1915-2023,2103-2264,2287 -2597,2619-2627,2649-2695
  Gene Ontology: Mol. function=NAD+ synthase (glutamine-hydrolyzing) activity; Biological process=nucleobase, nucleoside, nucleotide and nucleic acid metabolism
atggaaatgtgcgaggaaatgtgggcaccgttcgggcccagccaacggctagcgctgcaaggagtggacatcatttgcaactcgagcggctcccaccacgtgttgggcaagtcgcgcatgcgcatcaatcaactcgtgttgggtgcaacagcgaaggcaattaacacatattttagaattataccaataatcagtgtccacttgagaattggtttcagcttggcggcacttatttatacgcaaaccatcgtgggatggacggtgagcgcgtgttcttcgatggaatgtcctcaattgcgcaggtgattttgaaacgtacacttttaccaaatcttacaattaggcaaatattgtgctttttgtccaggatgggaagctgtacgcccagatcgaccagttcgacatagaagaaaccgccgtttgcagttgcactttgaatttggacaattcggtcgcttaccgggcaaaaattgccagcctttgccaacaggtgaccattaccaaagtggaaatattaaaggagtttctttcatattaaattttcaaattcctctttttttgaaaattaattcatgaaattagatccatcaaaaaatgatttattttttgctttttgcataagcgaaaagtgctttttccgtccagtccagcaaagtcgtgccaatgccatgcgttcggtgcgatgcgcaattattggccgacactttggcggtcggcggcggcgctctttcgcgtcagatcagcgtggaacagcggacaaacgttgatgagctttgccatgcgcctgcggcgtggctttggcattatttgcggcgcagcggaatggtccgtgggggaattaataaattatttttaatcaaaacatcctttttctctcttcccgtagagtggcttctttttgcctctatccggtggccaggacagtgtttccgtggctctgatggtccgtttgatgtgtgaaaaagtgtgtgatgccgtaaccaaaaatccaggtttgttggaatatttttattttttaattgttgaaatggatgtaacttttctctcccacttttcggcttgagtcctcctgcagcagaagaggaatccctgttgcaaattttgagtttaacccatacaaaaaaataagactaccatactactgaattaaaaaccctgggctttatttttctaccccctccgtcgaaaggggggctttatttcagggcatacatggaaaagggaggtgggtcaaccgaaatttttgcgaagggatctgggagggggagttctaattgagtaaatacgtttttgtttgtttcattttttgccataattcattcgtccccattcgttgtcagactctgatgacccggcctattttctgtgcggtgagcgcgtgccgaccgacccggcacttctctgcgcccgcattcttttcacctcttttatggcgtcctcaaattcctcagaaatgacaaagactttggcggcgggcattgccaaagacattggcgcaacgcattcaaagtacaaaattaacaaatggagagagataatttatatttcaattaaaattcattttgatttcgcatccattcttttagcattaacatcgacggaattgttcagtcgtaccttcaaacattggatttcactccgtcctatgaggcacatttttcgaatttattttctgatataatttttataaatccacaaattttctctaaattaccaatgccttttgcgcatttttcagtcttcggacctccgtgaagggatggcccttcagaatgtccaggcccgtgctcggatggtcctcgcctatttgcacgcgcaactgacgctgaccaaagagcggcgtaaaatttgcacttattgataaattgtttaaataatccctccttttcagggaaagggtctttgttggttttgggcgcttcaaatgtcgacgaaaggttggaaatgtttatttttttattaattgtagttttaaatgtccctttcagtttggttggctatgtcaccaaatacggttggttggctctcccccccccccctctcttttctctctcttccccttttctctctctctctttctgttgcttttcatttcctcttccacagattgttcctctgccgacattaacccaattggtgctatctcaaaggatgatttacgtgagtttctgtgccatgtgaatgctaatcataaattcccacacttacaaaggttcggcaattttttattttgtttccgaattacattaattcgatcatttgttgtgtttgcccccttttcagtgtcatccattcggtgccaaccgctgaattgcgtccactgaaggacggccaaattgtgcagacggacgaagccgaaatcgggctcacctatcgggaattgtccacttttggcaaattacgtcgtccaggctgttccgggccgtacagaatgttccaagaactcgtccacatttggcatcccgcgcgcagctatgacgaagtacactaaacatgggatggatagagttaacaggttctcccccccccccgactcattttctaccgaaaattttaaatttcgtctggaagtaaaaaaaacacatttttattgaaataaataatttggtttttatttttaagatagcggacaaagtgcgcattttcttccgccgttatgctatgaatcggcacaaggcgacagttgcaacacccg

SEQ ID NO: 61574 - DNA, 504 bp, Heterodera glycines
  Genomic contig location: Contig_ID=SeqID_6439; Location=75..578; Strand=+
  SCN-specific regions: Sequence locations=1-52,75-292,314-360,385 -415,437-504
gaacaaccggttgactacgatggcacagaaattcaagtggtggacgacggggcggaagaagggccgacaatggcggacggtcagcagaatgtccaatacattctgcaggtgcttaccaacatttaaaagcattttttaaatataagtttccccgataatttacgaattcataaatttccacaataattttttgtacagtacgcggacagtggtgagatggaaaattcgatggtccagttggaggacggccgaataatccacgccacccaaattgggcagccaattccgttgtcctccgccaccgaagcgaaccttccgattggacagccgctgattatgagcatccccggcccgaacagtcaccagcagcagatgcagcagcacttccaagtggtgggcaactccgtcgccgtgccctcctcctccgccgcctctcttccgccaatcgcttcggcgccatcgccgcaatttcaacattcgccggcggagggggaagaacaatga

SEQ ID NO: 61575 - DNA, 963 bp, Heterodera glycines
  misc_feature (950)..(950): n is a, c, g, or t
  misc_feature (955)..(955): n is a, c, g, or t
  misc_feature (963)..(963): n is a, c, g, or t
  Genomic contig location: Contig_ID=SeqID_31202; Location=647..1609; Strand=+
  SCN-specific regions: Sequence locations=1-771,793-963
ccgaaaaaacccgaaaagtcgtcgaaaacgcagcagtcaatggcatccaaatcgacgacggcaaaagcagaatgggcgaatgcgcttccgtcagacgttttttcttcaggtgatgccgcattttgtgtgtgtgatgtgtcgagaatttccctccttttttcagaagccaacatggactatgggacattgcggaatttcgatactcaattttttggaggagcatcgccgttgaaaccgcaacgcggcactggaaagaaaggcgagagaccaaaatggacaatttggaaattggaataattgttttttgtttttcaggtccggcgccgcccgtcgttaaaaagccaccgccgtcaaagacaaagccaccggagaaagggaaaaaagtgccgccgcagccaccatgtcggtgttgatcctttgatttgaaattttcatgtgtatagtgactttttgctcccatttcagcgaagaaaaggccccggcaaatgggcaacaaacaaagtgatcaatttaaacgattatgactgaatggcacacacacttttctctttccccatttcagaacagacaaatgccgacaaattcaaggaatttttctcccagagaaggccgtccagttcaattagtaggatgacaaggggagaaattgggcaattaatgcttttaatttccatttcagttggcactcctcaaaaaccaagccccggtctcgtaccatgtaagaactatatcaataatgatcatcacaatcaatttttgacgaattttccccccatttagcaagccatcctgactatggcacacttcacttggtggacaaggatcttttcaccaaggagcagcaggcgaaaggtgggcacatcaggcggagaaaacggcacaaaacactttatccatccctctccattttcagatgccaaacgaacgccaccaaaggctgggcctctatntgttncgagtgan

SEQ ID NO: 61576 - DNA, 313 bp, Heterodera glycines
  Genomic contig location: Contig_ID=SeqID_31204; Location=449..761; Strand=+
  SCN-specific regions: Sequence locations=1-218,254-262,284-284,306-313
atgcaattgatggagccatgccttttccaagtccgtcttgtgctcgtccttaatttgtgcaaattgaatagcgctgttcgcctccttaatgtactgcttggtgtcgttgctgatggtctccaaatcgccagcaatcacatcaggcatttccacatgaccacttttgttcattttgatcaactcattgctggccccgtcgagcacaaccttttgaacagaaaattaattatgtaattaataattgtaaaattatgagtaggatggaaattttattcaacaaaaattaccaaatattttgagaaaaaatatttaa

SEQ ID NO: 61577 - DNA, 420 bp, Heterodera glycines
  Genomic contig location: Contig_ID=SeqID_31210; Location=54..473; Strand=+
  SCN-specific regions: Sequence locations=1-46,68-93,139-217,239-420
gtgtccgtgattcgttacgaagcgccaattctttttcataatgccaaacatttcaaatactctgtattggaagcagctcgtcaaattaaagggtaattattatataattattaaatttattatgttaatttaaatattcagccaattgttgggcattggcattggcactcggacgggcagtatgaaaagcatgaaaagcacaaatgccggtgaaaagtttagaaaaataaatgctaatttagtcaacaaaacctttaaaataaatttgatgcttttcaatttcattaatttagttttgttcaacttattctttatttgcttaattaaggtaatgttggctccggcgcaggtccttcagctccaacaaacaaggattcaattcaaatgaaatcaacactgttgatcagcggcgacattgtg

SEQ ID NO: 61578 - DNA, 788 bp, Heterodera glycines
  Genomic contig location: Contig_ID=SeqID_6440; Location=2778..3565; Strand=-
  SCN-specific regions: Sequence locations=1-133,155-461,509-709,740-756
atgacccgttatcgtcgaaccggctccatttatccccgctccgcgcaactcattcaccgacgaccccaccatcatcaaagcgcaataccgcctccgatcagttttatcaacgacatggagatggctgatcaggataaattaattgaaaataatatgtttgatgagcatgccattctcccgtcggcatttcggccaccaccattctcggcatgtgtttcagctgctgatcaccggctgtcaccaatttgtgcatcatccgatcagtccgggttgtccggcgctgatcagcgtccgatcgtttgccatgccgatggagcagtaggacagcaattggaaacggagttgaagcatccataccttgtgaaaaggtaagctaatgtgccaaattatcaaaagggcctaagcatttgcctggttttttgattagagggatttcgggaattcatatggactaatccgagtaaaaaaaatattttttaaagaaattgaaaagtaaatttaaaaaatagaaataggtactcgcgttcaatttattatttgtttcaatttttaaatcaatttaatttagacttttggattgctaattggacgacaaaaacacttcagcatttatgaaaactgtgataattttttactgtgatagaacaatgcattatttgaaaatgtgatcaattttataaccattcatttttacaatgttccaaacaaatttcacttttaatgtttaaattaattttgattaggcatgcgaattaattaacccttttttattttgtaaatgaaataaa

SEQ ID NO: 61579 - DNA, 790 bp, Heterodera glycines
  misc_feature (4)..(4): n is a, c, g, or t
  misc_feature (24)..(25): n is a, c, g, or t
  Genomic contig location: Contig_ID=SeqID_6441; Location=260..1049; Strand=-
  SCN-specific regions: Sequence locations=1-145,167-370,393-681,718-790
cacnagcagtggccacattatccnncaagtgaacgaactgcttcaacaacaattggcccacctgaacaatggccaagtcctcctccaacagcacaatttgattgccaattgtgctgcagctactgcttccgcatcagcggccatggacaacaacaacaacgacaatattaggaacaacgactgtatgtcttccacagtaccggtacttgcacaagcggatactgtacagcgaaaagaaacggtggtggacaataatgatcacactatgcacggcacaaacatggacaaaaggatgacggtattgtccgccgctgctgatcagttggagtccttttgtaagagagtgggcaatctttgtgatccattattgattaatttataatcatatattcccaacaatttaatggatattgtagtttagaatacggtatcaatttcagctgtatattactatgaaaattattgtcattagtcaaaagaaagtttgttggtctttgtgacccattaggtgcaaattggcaaagaacaaattgccggaaatttacaaaaaatttatacacttacagaaaaaaagatgagactaagtgactagtaaatttttttttacaataaattttgtaattttcagcacgaaacaagttgggccgttcctacaatcctggtcggccactggtaatgcgctaatattttttaattaaaattcacaaatatttttttctagggcatgttggatcggcaaaaaattctgaacctgtaccagagggggctgaagattagtcacattgccaaa

SEQ ID NO: 61580 - DNA, 707 bp, Heterodera glycines
  Genomic contig location: Contig_ID=SeqID_6442; Location=1055..1761; Strand=-
  SCN-specific regions: Sequence locations=1-103,129-380,417-509,532-707
atgtcattggccgccagtgaaactgccgccacgagcaacaataattataatcatcattatgaacagttgtccgatcagttcaatttggcacaacttttggctaaccaacaacaacaagaacaacagaatgaatcaccactgatcagcagaatgcttcttgaacatcagcagcactatcagaaccaacaacaccatttgttacttcgtgccgcaaattcgttgtccattagtggcaataatgataatttgccgttgttggcaccgccaaacaatggctttcatcccttgccaatgcttcttcgactaatcacaatgacgtcaccacaaccagcaacaacaacaatatgttgtgatgttgggagaagcaacatgaacatgagcatggatcaactgcagatgatgatgaagacaatgatcaaagttgaagatgtaaatcaactaaaactgcaggtggaagaacctgtggcgacaaattggcagaagtcggcatttgttgcggcacaacagccgcaatttcagcaacaacagcaacttttacaacgccaaatgatcatggaacaaatgctctgggaactattagcacgggtaattagcattaattatatggattatttaataatgcttagaatgttactggattaatagtttagaaaaatatttgtataaaagctttttttaaatatggttttttggtgtaaaaaaataaa

SEQ ID NO: 61581 - DNA, 1036 bp, Heterodera glycines
  Genomic contig location: Contig_ID=SeqID_31212; Location=258..1293; Strand=-
  SCN-specific regions: Sequence locations=1-355,378-437,469-487,516 -785,807-1036
atgcacgcgttttgcgctcgagctatttatcatcgggcttatcaatccaaagcgaaacaacaaagatggtgttttgaacgaataaagggcataggttattttgaagaagtgtcaactaacatgcagcaataagcctgcaaaatctaataagtggaaaatacatgagtatagaatttattttcagaaagtgtcaacagacttttggaaaaatatgtttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtattgtaaagcataaaattggaaattaatgcaaaattactccctggggagaacagtcaagaaaaagaaagaaaaactacgcaaattaacatttaatgcaaaaataaaataaataaaaattaaatttcaactaaaacgttatttacaaataactttaattcgaatttcactttaaactaatctttcgtttcacacgatgttcattcactttgaccccttccggccattaccgccgatgctgctaattgcttttacagtcagctgcttgcatcttaatggaatgatgcttatcaccgcgttcaatcgtcaattgactatggaaacattatgtaatttcccatcaaaagcgaacggaaactaagaaaattctttttatttggcaatatttaaaagcatcgaggaaaagcaaagaaatcattatcactcccgacaacaatttcttatattgcttaagcttaaaatgatgaccaaaattcaaatatttatagcataaaatttctttgtttagccaagcatatattcaaatcattcccaaatatcccctcacttatttcaacacagcaatcagtgcacattttcgtggcttatgtcacactcaaaaaagactggctctagggccaccagtcaagagagggatgaagaaataaa

SEQ ID NO: 61582 - DNA, 348 bp, Heterodera glycines
  Genomic contig location: Contig_ID=SeqID_31212; Location=1..348; Strand=+
  SCN-specific regions: Sequence locations=1-3,25-74,97-348
tggtttggtgttattttagggtttgataatttcagcaagcccacactccgttagcatttaaaactcccatattcgtgtttacttcctctgccattttatttaaggcccttgtgtttgcatatgcccttcgatttacaattctaaatgatctatttacagattcctctaggcgtagaacttctatgtgggctctttccaaatcgggaacctttaccgacgttttaccattccaaaaatttcggtcaatgattgttatgtttatttcttcatccctctcttgactggtggccctagagccagtcttttttgagtgtgacataagccacgaaaatgtgcactgattgctgt

SEQ ID NO: 61583 - DNA, 836 bp, Heterodera glycines
  Genomic contig location: Contig_ID=SeqID_31216; Location=212..1047; Strand=-
  SCN-specific regions: Sequence locations=1-20,42-469,574-725,747-836
atgcaactttttgtcagtcaaatgaagcttttggaaaattcagttgggaacccatttattagtgaacgaagaaaggcggacgagtcaatggcaactcgtagaaaaggcaattcgtatgttacaaaataaagccaagtttaagcttaagcttaagactaaagcctaggtctaacctaagcaattctacgagctgcctttgcacaacattatacgaattgtcatgacaccaggcggacgaaaccaaatttccaaattcaaaaataaatggcccataaatttatatttgactatgaaaattcttattttctaatatcataaaaaatattcgaaatttcttttaggtcagaaaaggaacccaaatcccatttgtaaaaatgcgattctcttcaacagccatctttctgttggtgttggccattgcctcccatttgaacttttttcagtcaacggaatgcgttagttttttgccaaaaattattttaaacgataaataaaaataatttttgccaaaaaattaaaaatatttaaaacaaaaaatacgcattcaaataaatgttttaaaatattatttaagcaacaaatggtaatgcagcaggtggtgaaagcgtaaaaaacaagtcatcttctacgacacagaaaaaaacaaggtaataatgacaagaacgggatttttaaatattaggatacatatttctatttttttcaatattttgataaatatgttggcaaaaatttttaatttcagttttatttgagaaattgagtgatcattttctgtttacaaaaatttcttatcaaaaaatcatatgtgctttaccttcggaatctttaataaa

SEQ ID NO: 61584 - DNA, 215 bp, Heterodera glycines
  Genomic contig location: Contig_ID=SeqID_31219; Location=643..857; Strand=-
  SCN-specific regions: Sequence locations=1-113,135-173,195-215
catcttcggttgtgccctgtcccgctgagttggcactgtgccgtcaggcggtgttggtcaattcggatcagcagcagcaacaacagttgcacgactatgagcagcgtccggtcatcgttggctatgatttcaacgccggcattcaatgggaggcgttgttggattcctttttgaccaccggcttccaggccagccacatgggcatcgccatccag

SEQ ID NO: 61585 - DNA, 367 bp, Heterodera glycines
  Genomic contig location: Contig_ID=SeqID_798; Location=1479..1845; Strand=-
  SCN-specific regions: Sequence locations=1-71,108-281,303-367
atgacccgccccatctttacctgtgcgtctcctgctgcttgtgcaccaatgctttatgatgatagcgttgttggtgatgatgttggtgatggtgatgatgatggtgagcatgtgcatgatgtggctgcggaatttgaagcattgtatctgaaattttcaaaaatttcatgaaaatttttaaattccagggcgataggtatagccttagggtaccgtaccattgttggcatccgcttcatcggccagggacaaaacgtcaaatttgagccgcatatttctggtggcacacagtccaccttcagtgttgttcaatcccatcaatgtgccgtttgaggttgctgaacaaaaatgttgagtcaaaaataaa

SEQ ID NO: 61586 - DNA, 1354 bp, Heterodera glycines
  Genomic contig location: Contig_ID=SeqID_799; Location=4306..5659; Strand=+
  SCN-specific regions: Sequence locations=1-346,381-440,480-573,615 -692,717-1110,1156-1180,1252-1354
atgccgggcgcgccccgtttcacgcagaagccgtccatacagcagaccgcgcagggcgacctgctgatggagtgcctgctggaagcggacccgccgccggaggtgcgttggcaacacgcgggcaccgccatcaacgcgtcaacgcgtgtccaactgacgctgatcaatgtgtcgggcaacatgtacagggccaaccttgtgatcaaggtgggggtaattagtgttaatgcggcgctaattggcaaagtcatatattttgaattttaaaatcaagagtggacccttgtggtttgcaaaatgtacaatataatttttgtttaatgtgtttgattttgcctatcaaaccatttattttaaaatttatttttaaaaatttatttcaccaatataaagcaaataaaagtgatcagcagaatcgcacatttttaatgacttttttgtaattaattatttttgttttatattttttaataaattttgggacccataataaaattgatctgaacagcaacaaatttttaaatgaacacaaaaaagacaagaaaaagcttatccaaaaatgtcacaattttgaattttatttatttatttttatgcattttttaataataattcatttttgaggtatttatttaggagtttgatcttttatatagtagtttttcaaaaaagtaagtaatcaaagcactacaaaatttaaagagatatatcccataaggataaagctaatatacaaaaggaaaagctacaaaatttgaattcttttttttttattttggaacccatattttttgtttggcatttttagcaaaatttcgacacccccgcattttgttaaattcgacaattatgttttaggagcccagcgcttcggacgggggcgcgtacaaatgcacggcagcaaacaagttcggagaatcaaatgcaaacatcaatttgaactttgccggcggggaggaacaaaagtcgaccagcagtgggtcggcaaaagggccaacatttgttggcaaaccgcgcattttgccacgcgacggtggtgcactgattttgatggagtgcaaagtgaaaagtggcacacggccaaccgtcaagtggagcaaggacggtgagttaattggtcaattaattaaaggattgattaataattaattaattcggtatttatgttgattacggtgggttaattgacaatttaatcgatgaacccttaactaattaattgattggttaacttaattgtgttaattaatttgctctaattctcataggtgctccactaagcatgggcagcctgtaccaagacgtgttcgccgaccttggggacggcacctatttatgccaactggagatcagg

SEQ ID NO: 61587 - DNA, 917 bp, Heterodera glycines
  Genomic contig location: Contig_ID=SeqID_799; Location=281..1197; Strand=+
  SCN-specific regions: Sequence locations=1-145,167-384,430-432,454 -497,519-555,584-718,741-811,842-917
ttccatccaaaatgaaagcagcaattatccgccctttctctatgtgattcacacttcggaaatgtcttcctcaccacatggcgacgaggacgagggcgaagaagcggccgctgcatggggccaagactcatacgaaacgggggacgaaaatgaaatgagtgggaaattttgacaataaattaagcaatttcattgtgctttcattagtaaaaaaagtgttttgtggccattaaaatttcatttaatttatcataggtccaataatagaacccccgtaattctaaaaaataaaaaattttagcgggcgggggtggggttaagaacataaaccgagatgggagcaactcgtccccgaccgcgaaaaagaaaaatctttcaaaaaagaatattattaagataattacaagaaaaaaaaaatttttttttaaacaatttcaagggaatttttcaaaattttatgaagaattactaaatttttccaaaaaaaaaaatcgctgaaaattattaaccttgaattttcttatataaaagaatttgtaaggtttttttaaagtctataaattttcaaattataaaaaattttgtggtggggggggcgtagtacatacacccaaccgaatcagccttttatgtattcctttttctgcttttcgccccaaaaaattttttccgtgactattttcctcacgagtaaacgaagcatggaaaaaaggacaaaggctttatttaaaacttaatttcagtagtttttttcctctttttcagcttattattcatccgcttcatccacttttacattgatcagaaagcattgtggttgttgctgtttttgttgtgttgatcacttgctggaccaacaaaatcatctgctgcagatgatcccaaacacaatcgccggacagaaaaatgccaattaa

SEQ ID NO: 61588 - DNA, 402 bp, Heterodera glycines
  Genomic contig location: Contig_ID=SeqID_801; Location=36..437; Strand=+
  SCN-specific regions: Sequence locations=1-46,85-147,191-241,263-402
atggaggtggacacgaatggaactgctgcgcagaagaagcggcgggtgccctcatccaaaaaggaagaggagaaggaagaagaccaactggtgccggagaagcgagtccaaatccatgtgaggcctgagggcaagggatgttgagggattttaaaaattaaaaaaaaaatacacatttttatattattttccaatttcttaattttaagagtccatccccttcggaaagcggtgccacaacgccaacaaaaaagggcggcaaaaaatattccggaagtcgccactcgacccaggaagatgtgggttactgtaattcactaaacaagtttactgtacaattctttaagcattaaaatagtcaaacagcgttttatgattttttaatagtctaattgatttcga

SEQ ID NO: 61589 - DNA, 1977 bp, Heterodera glycines
  Genomic contig location: Contig_ID=SeqID_801; Location=1187..3163; Strand=+
  SCN-specific regions: Sequence locations=1-83,105-249,271-870,923 -943,978-1087,1116-1171,1210-1231,1290-1977
atgtcatggaaaaacgcggacagcagagagtcattttcgtccgcctctgactcaccattgtcccacccgttggacatcattcacgaggaggcagctggcccgtcaagtccgagcagtacaacaggcggcggcgtggaaagtcatgcggaatcgttgtcctcagtttctcccgcattccgaagcccaacaccaagccatgatcatgatgtcattgcacatggaggacatgccaagacaacaatcagcaacaattggacaacactccgaaatcatacaaagaccacaacggcgccaagcagtacaacggcggctacacggaatgggaccaataacaatacgctcgtcaagccagctgcagctgcgccaagcttccggagcgccacccgggccaagcagttgcgtgaagaggcggaagaggaggcacaacggaaccgcgcagttgcgcaacgccggatcagcgcggtgcatgagttcgtgctgaaccggctgccacgccgttcggtggccagcaacgcaattttggacaacatcattgacttccatgctgcgcaaccggcactgccaacggtggaggtggagcgggcaaggagtaccgctgagccggacgtgccatgggcggctaagcgccggaacagctccgtgtttaacgcggtcggtccacacattcgactaaagtgccaaaaactgtcatcaactaatcacggcacgacttcaaccgaatcacacctaacacgcccaggcacttgagaaacttttgccacactaatttattcgaaatcatttcctcgtttttacaactcgagaatcttgggcgataatgtgggaatatttaatattaagttaaacgaatttttaacttgaattaattcgttataaaaaataaaattaatcaaataatttattcattttaattatataatttgtttccctatattaatccgagtataaaaaataattttttaaattaatcaaaaattcttttaacatgtttttaatccgactatattaaaaatgactttcaaaaatttttttaattttgtttgttttttaaaacgccgaacaatgatcttccaaaaattaacatttaatattggattttaatgtttgtatttatattttcaaaatcattttacccgcgctaagccttaacaaacattgtactaagaaagtcttaatttaaatttaaaatatttctaatcataataataactgttttaaaacacacttccccaaatttaatttaaaatatttataaaaaccaaaataactgattttttaaataattttttcacccaatttcagatttcacaagtcagcgacgacattccggccagcggactgaaaattccgccggagcgtcgccgtgaactgctcgcgctctccggcgggggtggcgaatcggaggacgagcgaacgtcgtccatttctgaacaaccaccagcaaaaaaagcgacgacaacaatgaaaaagccatcagtgaccatccaaaaagaggaggaaaagcagccagcacaagccaaatcaaaatcgccatctccgcgaccagcaaagtcaccgtcaccgaatccgaaagaggtgggtactgtacaaatggtaccggtgccgtccgcgtgcatcattaccatattccctccggcgggtcgccgggaagtggtcgaccaattcggcatttgcttctactcttttaaatgcattttcagtgtgtgctaattagccacttaagtattcatgatacggtgtcctgaatttgatgagaccgtaatcatcgaaaattccgtaaatttatgagccgacaattccaacgcctaatttttgcagttttttccgtttattttcattttgaagcttttttgaattaaattgcatatattttggcagttattccgttgcaactaacaaagctaatcaacaaaatgccaagtcaacagccgcggcgcgtaattttgaaaaaaaaacgaatcgcattttttggatgga

SEQ ID NO: 61590 - DNA, 709 bp, Heterodera glycines
  Genomic contig location: Contig_ID=SeqID_802; Location=649..1357; Strand=+
  SCN-specific regions: Sequence locations=1-201,229-709
atggccacttccatcagcaccacatccggcattaacggggacgaaagtgggccttccaagccggccaaaacggcacggtactcaccagttggaagcgtggccaaccgttttgagtcgcgcggtgccaaatcatccgtgctcaccgaaatcaatcaaacctcgttgcgggtgaccagcccacagcgcaaaaacgcttttccactacaagctgctgctgctgctgatcaacaagccgaaacttctccaacaccagaatatgtgcccatggaggaggttgagttgttgatacagtaatttgaatcatgggttttcgcgcgcgcggtaaaatttaaattcgaatgaacggcgcaagaaattttttaaatgctttcctatggcacagcgtttttctttttgccaaatttacgcgcaaaaaaagcattttgataaagcaaaggcatgcacttgttgagtgagcaattttcttgtcgtattattgcgtttgttctttgtccacagtgacactcacttacagtatactgttgtgtctaccgtatgcaattttttgtttgaaaaaataccctcgttgcttgccttaccacctccgtgctcaattttttggtttgattccaggccaacggtcgtaccccaacaatgatccaggttggccgtaaaaagactggccaagcactgatcagcgagccgacggatgagtaccgggaaagctaaa

SEQ ID NO: 61591 - DNA, 1230 bp, Heterodera glycines
  Genomic contig location: Contig_ID=SeqID_803; Location=140..1369; Strand=-
  SCN-specific regions: Sequence locations=1-97,119-386,409-437,470 -816,858-873,916-943,965-1023,1045-1230
atggtagcgtctagccaaactgtaccctcatgctggcccgcctgtactgctccagctgggtggcctcgcgcgcctccgcgctctctggccgcaacgaggcgcgcttcagcgcctgcacctcttccggacgcggtgacagactgtgccgcggctcagacaagcggtgcttcaagtctaccgcttccagcccctccttttggtcctccttcttggttttggccgttttcttcagctgcacctggaggaactcgtgctccacccgcttcttgcccacttggacgccttgcaggcgttgcattgagttgcgcttcaactgtgtgccatcctgggtgagatttgtggttgtggtgtgtgtgtgtgtgcatttgggagattgtatgggttttaggtgggtgggtgggtgggatggatttttggcatggggatgaggaacatggattttaatttttttttaatttttttatttttacgaataattcccgatgagggagtttcccggaattttctcaacctaaactcgacaaatgattgggggggggggattttgtcctggtcccgccacatttctatcccgatggttcggtgagtaaccctaatttacgaaaaatttattttatggtttaattttttaatcccggcacaatgcttttaagaaaagttatggcaaatttagtcgaaaaattactgtccaattaactaattaagattttaccagaatcattatcttatcacctgttccgacatcatatcattattgggaattattagtagcacatgttgaattatttgaacagaatagggtaaagggtttcaaccaaaaaataaaatgtaaaataaaaattattataaattataatgatgaagtttggcaacaaaaaataaacatttgtaattaaataaaaattaattaattaagtggggaaacatttaaaattgagcaaacaaagggagaacaaggggaaaagcagcagataaacacaaaattagaagaagtgcttcttcatcaagaaggacgaaatgagtaagatgaagaagatgaagattacaaaattgggatgcttttgaagagcaaaaatttaaaaaaaggcaaaaaggaaaaaaatggcaaataagacgatacgacgataaaacacgaaaaaagctttcgatcgatcggaaatttcaatttcaaaaaaatttcgctaatttaaatgagcctaattcaagcaaacttaactcaatggtaataaa

SEQ ID NO: 61592 - DNA, 268 bp, Heterodera glycines
  Genomic contig location: Contig_ID=SeqID_804; Location=517..784; Strand=+
  SCN-specific regions: Sequence locations=1-139,184-198,220-268
gtttctctgattatttccaaatgtcgaccacaagacgaggacgagtacacattgatggtgaagaatgcgcatggcaaggacgaagttggcgccaaactgcttgtcacgccagcagctgaagtgaaagaaaaaattgccctaatttaaatttaaataataattttttttttaatttttaattttcagtcaaatttggacttccgggccaagttgaaaaaacgtgacacgagcattagcatttcggaacaagaaaaacagcgtcaacgga

SEQ ID NO: 61593 - DNA, 172 bp, Heterodera glycines
  Genomic contig location: Contig_ID=SeqID_6444; Location=257..428; Strand=-
  SCN-specific regions: Sequence locations=1-172
atggagtgcaccctttttcttggccttttattctgtgccacacccaccgaaaacggagctgaagtgacgcataaagggactgttggaggcgaacaatacggtccaattcggcatcactttggcgttccgtgcacaccgcaaacagttcaatctgtgacaaagaagagtgatg

SEQ ID NO: 61594 - DNA, 1265 bp, Heterodera glycines
  Genomic contig location: Contig_ID=SeqID_6446; Location=152..1416; Strand=+
  SCN-specific regions: Sequence locations=1-16,42-155,177-265,287 -424,448-557,579-825,882-997,1057-1218,1256-1265
atgctcgagccccgttctgcttcagctgctgctgctgttcactcactaaccaattttgagaattgccacgaattggaggaaatgcagcaattaattgacacattggccggctcattaagaaagcaattagatgcccttgtgtcggtcaaccgggtgaggaaaaaagaagaaaatatttaccgtattccctaaaatacagcccccccccccccctaaattagaacttctctgaaatgaagccctcaccccctctttgaggggattcaaaaataaagcccctgggggatttattttaggaaatacggtaaattttagattttcctgaaaacatttttcggaattttctaccatttcagcagtttacggaaaatatccctttttggctctgatttggtcgcaaatccgtttttctccggaaatttactaaactttttcatttctggaattgaattttttttttcaatttagtccaggccaattttctgaatttattggacaccatttttggtttccgaaatatgtgcttaaatttctagaatttactgacaatgggcccttttttcctaaacaaatttattaatttttcgggagttttcctgaatttaatcgcatttatttaattcatttttaatcacttttttttaactttcagcaaaaagtccagcattgttctgttcggtggaaaaatgttaaaaattcctttttattcgctgatgccatcccgggcaaagagcgccgaaaattggagtcacagacggacgaatgccgacttcgcagttcactgcttaccgacaaaattacggtagggccaataccgtagtgtagtataaatttgttttttttttgtatgattttgaattaaatattatattatttattttggcatagaattgcttggactatttgcaaaattttgacactctgctcaattccctgcaaagtgaacaaaggcggaaaagcggtggtaaataatttgatgttttttaaggctggggggatttatttatatttatgaaaattacaaaatattaaaataaataatatttatgaaaaaatctccaaaattcagtaaaataaatttagaatttcgaaaaaacaatttaaaacaaataagcgtgttgaaatgttttcaggaaatgagatgaaaatgttgaatttaggttgattcacttcaattttagtgtccctgtaaagtttggtgagcttctgagcacttatcgaaaaattaggagggaaaaattttaggaattaattttgtaaaaaaa

SEQ ID NO: 61595 - DNA, 280 bp, Heterodera glycines
  Genomic contig location: Contig_ID=SeqID_6446; Location=1593..1872; Strand=-
  SCN-specific regions: Sequence locations=1-110,137-156,180-280
tggcgcccccacaaagtgtccaagccacgaaatgtccaaaagagtagaaacccacgaaatgtccaaaagagtagaaacccacgaaatgtccaaaagagtagaaacccacgaaatgtccaaaatttttcaaaatttataacaacaaaatgagtctaatttaggatttttagggttttcggggtcgctgaatacgaatataccctttatattactccttgcctaaccttaggcccatctgaataataaaaaactaaaattcgagacttggatatttcgtggg

SEQ ID NO: 61596 - DNA, 214 bp, Heterodera glycines
  Genomic contig location: Contig_ID=SeqID_31222; Location=458..671; Strand=+
  SCN-specific regions: Sequence locations=1-13,35-214
gttaatggagaaaagaatgtttgattatttttgtcagagagcagctgcggaatggctgacgaatttgccaagccgaaatttgacggcaaaatcttccaaaaccccgacagcttcacaacatggaaaaacccgccttcggcaggggacccgagaagttggcgggacttcattaaatggaaatgggatgcaaagagcacgaaactgcccaatttga

SEQ ID NO: 61597 - DNA, 976 bp, Heterodera glycines
  Genomic contig location: Contig_ID=SeqID_31223; Location=96..1071; Strand=+
  SCN-specific regions: Sequence locations=1-72,168-271,308-554,597 -605,642-976
atggcaaaattaattttgttggcgttggcctttctgagcatgtttggcattgtttgtagtttggaagaaccgtaaaattttctaaaataaaaaatcctataaattttaaaaataatttaaaattgaaattaaatatttactaaaatcttagtttaatttaaattattgccaaaaattggattatccataatttaattggccataattttagtcgagatctaaatgtgttcaaatttcaaaccgctttaaatgccaatgttataatttttggaatttttaattttaaaaatttatttttatttttttagctccgtttgctgtgaccagtgcggcaaagagtttttggaatgccaaagcacgtgcaaactggagcatcgggcaggcaatgtggaatgtccagagtactgcaatttcgtgttggaagactgctcgcgcgataagtgtcgtaagccatgcccacgtcccagagataaacactgaaaaaagagtcatcgagaaaaatgaattcgatgggaaaagcgatggatggaaaattgtgataaaatccatgaaagaattaaacaaaatttacataaattttatatactaatattattgtattttgcaaattgattttaaagaatttaaagagtaaaaatccaactcatactaggcaatctcgtactattttatgacaaaaaaaaaaacaaagtcgtccaaattaaacattcttggcatattccatatcccttaagattttctatctatactcagacttcaagaaaattttattggttttcaaaaaaaccaaaaatcgaaaaaaaaagattctttttttttcgtcaataattttttaaacttcatcaatcagttttttagtttgcaaagaaatagagaagcttaatgttaaatttggttgacttaagcaaaaattatgaccatttttttgcctacaaacagcatttttaaagatgaattgtcacattttaagcgacaa

SEQ ID NO: 61598 - DNA, 308 bp, Heterodera glycines
  Genomic contig location: Contig_ID=SeqID_31225; Location=567..874; Strand=+
  SCN-specific regions: Sequence locations=1-257,280-283,305-308
atgtgccattggaatgaaacgaatgccacaaatcgaacaatggcaaatgccaacacttcgcccggcccatttgggacacggagttgcgactcgccattggtaagagaaaaaattggaaatgaatttatagttggaattgaatgaatttgagcattttcagtctctcgttaattttatggtgaaagaagcacagaaacaattggaaagccccgattatgtgatttggacgggggacaatgcggcgcacgacgaatacgacgagaaaagtgaaaaggaaaagcagaaataaacattaaaataagaaggaa

SEQ ID NO: 61599 - DNA, 489 bp, Heterodera glycines
  Genomic contig location: Contig_ID=SeqID_31229; Location=429..917; Strand=+
  SCN-specific regions: Sequence locations=1-32,54-55,77-171,193 -194,216-383,412-489
tgccaaaaattggcaagaaataaatagggaaatttggcacaaaaatgtgcaaaaatttggtaagaaataaatagggaaatttggcacaaaaatgtgtaaaaattggcaaaagatagggttaaaaattgtggcaaaataatgccaaaaattggcaagaaataaatagggaaatttggcacaaaaatgtgcaaaaatttggtaagaaataaatagggaaatttggcacaaaaatgtgtaaaaattggcaaaataaagggttaaaaatttgggcaaaacaatgccaaaaattggcaagaaataaattgggaaataagggggcaaaacaatgccaaaaaattgcggcaaaatggcacaaaaaacggtaccataataatgccaatctggcacataaataataaatggcaaaaagtaatgggtaaatgggtaaacaaatgccaaagaaggaaaaaattaaggcataaataaatgataatggattattgattggct

SEQ ID NO: 61600 - DNA, 87 bp, Heterodera glycines
  Genomic contig location: Contig_ID=SeqID_31229; Location=1670..1756; Strand=-
  SCN-specific regions: Sequence locations=1-87
gttggtggacaaacatttcgatggcaaaagcgaattaacaatttggagaacaatcataatagacaaggacaaaggaccagaaccgaa

SEQ ID NO: 61601 - DNA, 437 bp, Heterodera glycines
  Genomic contig location: Contig_ID=SeqID_31230; Location=465..901; Strand=-
  SCN-specific regions: Sequence locations=1-236,264-330,352-437
atggaagcaaccccccgccagattgatctccaaaagttgtacaatgatctgatcggcttgcccggagtgatcggtgtccactctttgcgtgtttggtccctgaaatcggacactttcgccgctactgcccatcttgagttggcattcaatggcgggagtatcaaggacaaatactttgccgattctgtagtggcaatggcacagcaaaagtgaacattttgcctcaattccatgtcaattaataataatatttaatattaaaaccctttaaattactcaaaaaatgaataattattttaaaatcattttcaacaaaaaaaaacacttaagaaatatcattatcattttttgggattgttaataaaagtgaaaagcgtgcaaattgcttccttttcagaatgatttcgcggcatcacattcgctttgtcactgttcag

SEQ ID NO: 61602 - DNA, 494 bp, Heterodera glycines
  Genomic contig location: Contig_ID=SeqID_31231; Location=664..1157; Strand=+
  SCN-specific regions: Sequence locations=1-137,182-393,415-430,454-494
atgaccacaattacaatgccaatgtcaatgttaatcccgataacatcaaccatttgctcgttggtgtttctcgaaattatgaaatgcgcccgtaatttttcaatgctttgttatttttttttgttgttaacacattgataaatattttttgataataaattaaacatttttagaaaaaaatcagaatataacccatgtgacacaaaaacagcttgccagactaaaacgaccccctgactaaaacgtcccctcagactaaaccggccagactaaaacggccagactaaaacggccagactaaaccggccagactaaactgacccggtccgaggcaatttttgtcaaaatgatgatatatgcctctattcattattttaaccgaggtcaccattactctcgatcccctccccttccgtcatgtacgggtcggggtccctttcccctttacttcattacgttagcatatcgtaccttatgggatatctgccttcgga

SEQ ID NO: 61603 - DNA, 322 bp, Heterodera glycines
  Genomic contig location: Contig_ID=SeqID_6447; Location=105..426; Strand=-
  SCN-specific regions: Sequence locations=1-322
atggcttcttcatcacatttatcttcgcaactacaaaattgtggattttctggacaagacactgcgtttgccattgaatacgagacgggtgctgcagatgaattatactgcacaactccaaaacgccgaaaatccgacctaattgcgggaattgatatttccaacccaaataaccgaagagaatggtcagaaagccgaacgtttaaccgattttatgactgtgttctcgataatggaggcaatttaacttcacttgtcgcatgcaaattatgcaatcaatctaattgaggtaatttctctaaatatctaaaaaatcattaaa

SEQ ID NO: 61604 - DNA, 96 bp, Heterodera glycines
  Genomic contig location: Contig_ID=SeqID_6447; Location=5063..5158; Strand=+
  SCN-specific regions: Sequence locations=1-96
accagggatgtgccgagccagacaaaatccgattccgattaaatcgccgattccgattatggcccaaaatccgattaattgcgattccgattacga

SEQ ID NO: 61605 - DNA, 2268 bp, Heterodera glycines
  Genomic contig location: Contig_ID=SeqID_6447; Location=2438..4705; Strand=+
  SCN-specific regions: Sequence locations=1-52,74-423,445-503,525 -573,595-689,712-786,808-838,860-1059,1081-1761,1783-1865,1887-2268
atgaccaaaatttctaatgttttcctccggcggtgcgtagggctctcaaaactttttttatataaaaaaaaaactggctcaaaatctctaaaatattttgctgaaaatctgctaacaaattgcactcaaatttgcaccgtcggaccccaaaaagtgttttttctgaaaaagctttgcaaataaacaattttaatgatttttttaaggttctgctcggttttatgcgtcccctgctggggtaggggtcactttggcgtagacaagaaaaagtttgattacttttttttattcaaccaaataaaataatgttgatattaaacgataggtctaaatgttctttattagcctgcaaaatttcaggaaattatattcggtctaaaaagagatatggcgcgctgcgccaaaatggccagaaaaatgcgatttttgaggttttagccataacgtttttgtatcgcggctaaattttttgaaactttgcaggttaataggcactatcaagtcattaaaatcataccaatattatttaatttggttggtaaataaaaatgctatgactttctgcgccaaaatgtcctgcgccaaagtgaccccgacccggtcccctgagaattttaagccataactttttcttacttggccaaaagctatattcttcgtatcaaacgaaagcttacatgtatagaagcttttgtagaactttatttttatctaaagtacaatagaaaaaaaattatactcgaaaaatttgaatttcgtgtttctcaaattttaatgccagtatttgcccttttctttcatttataaatcccgggacttaaaactttcgtttgataccaagaatatattccactatagcttttttatttgttatccaaatccatcaatctaggtatcatttgaaagctcttaatttcgacttttttgcaatttaatgttataacttttttagtaattaagaatataggcattgaccaagtaagaaaaaaattaggtcctaagaaacagaggatgataattagtggtaattcatgggacgcataaaaccaagcaaaatcattttttcaaaatgataattttttgccggaccggctcagttcggccccagcccaagtttttgatctataacttttttctttgtcaaccaaatccaacattcttaatatcattcgaaagctctttacatactctattagacttacaaaaagcaaaaaaaaaattttcaacaagcaaaaaatttatgatgaaaaaacttgaaagcttcgactttttcgcaaaattttcatatataacttttttggtaattgtctaatcgttaagcaatagcttagaaaaagcttctaaatacattaagctttcgaatgataccgagattgttggactttggtgacaaagaaaaacgttaatagtctaaaaattggctgggccgaactgaggtagaccgtttttggccccactttttgttggcaaaatggtgattttgaaacctttcatctgctggcagacagacctcttgctgaataaaagcattccattttcaggtgcattgatcgctctgtcatcgcttttctccgtgccaacaagcaaatttttgacagaaatggcaccaatttgcagttgagtgtgtcttatgcattcaaacatgatgtgatcagaccaattcggcttgtttttgtccgtcaaatttggcccatttttgcgacaaacattcgctgcctgtacattcagcgcattggtgattttgtcaatttgcgtcgtctcatttcaaagacaattctcaccgatctcgacattcatatggtcgattccaattttatatcgcccgatgcaactttttctactggccaagcgttggtcaaatggttgcacacgccgacaaaagacgggcagccaaagcgattgtgtttcaaaaattttgacgaacaattgatcaacaaattcaaaaaggtgtggcccataacaaattcccgcccaggtcgattttccaagttccggccccggtcccggcaatttcaaaattccggacgtcaccaattaaaatatggttttctctaacaatacaagttgcagtgctgcactttgaacacaccgagtcaattttgggcttccagttcaataaataaattggcttttgtaagatagtaaagggacaaaagacggaggttcgagtccgttgtgctacatgtcatttttttattaatttttgtccaaaaaattaaaaaatttcgattcgaagtggattcagttcttctctattgacagagataa

SEQ ID NO: 61606 - DNA, 1959 bp, Heterodera glycines
  Genomic contig location: Contig_ID=SeqID_6448; Location=53..2011; Strand=-
  SCN-specific regions: Sequence locations=1-110,134-503,530-620,642 -658,680-813,836-976,998-1143,1170-1204,1301-1474,1514-1570,1593 -1694,1718-1749,1832-1959
atgcataaagcattgcataatttatcagaatgggcaaataaatggcagatcagaatctcaattaaaaaaacttttgtacttcatttggggaataaaaaccccaaagaaatatataaaattggtggaaatataataaatgtcgtggatacaattagggatttgggcataaatattgataataaattgcaattttccaatcatgtcacacaaataataaagaatgcatatttacgtatgcgctctttatttcgggttattaaatcaaaatcttctaggatttggattattttgtacaaaacttatgttagaccgttattggaatatgctcctgagaacgctgctcataatggcagtttttaagaaacgacccagcacgatttgtcccacggtctctcgatttattagggatgtgcgagaaatgatttctaccgagaaccgagaccgggaaatgaccccgagaaacgatacaataaccgagaaatgaccccgggaaacgatacgagaactgaaaccccaaaaaacccgagaaatttctcgactcgggaatcgagtttttagccatttttcaccaaaaagtactattttttccatttttggtctccataaatgaattttccaaaattcagtgctcgtagggcactggttctcttatagaaaaatttttaagatttttgaaaaattgatgtttataattggatatttcatttattgacgcctgaagtgaaatagagcagaaatttaacattttcccgtttttggccaattatgttatgattcatttccaaaaatataagccttctccctaattaaaccatttttatttttaataaagtttcatctcaactttttttgcccttttcccaaatatttctttccccgcagttttgcccatttttgggtcaccgtttgcccaaactaaaaggcaacaatttgaataaataaaagataaaaacggaagaaaactatgagttattcaaatatttattattcttatcttttgcccgtcgcattttctccattttttgggtcatcgttttgcccataaatttatttactttttggcctataaatatgtgcacaattacagcggctatagcagaatttagccttcatttgctcatgttttttctgaatgcattaaacaaattaaaattaaaattttaaatttaggttttaaaattgacgaattttctcctctccaacgtaaaaaatttgttaaaattcataattaaaatacaataataaaaacatttttcaataattaaatttgctaaaattaattttttttaaattaatttttcattttcagcaatttttccaaatctgagcacatcggaggaaatgagtgttctgattgcccgaattgctgagctgaatcgagccaaaacaatggagccatctgttgccagttctgaagtgtttggacaagacggatacggtagggaattttgtataattgagtggatacagtatgaaaattatacaataaaagaaatggttttgaaattttaaaatcaaagaaattattttgaaatttattaatcaaataaagcgaaaaatttggccctattgctgcagttcacaggacaataataaaagaaatggcctaaattatttgaaagctttaaactatagcattttatagaagcaccagccaaattaacattctttgtatcatttatagctccaagagtccttttattctgcaaaatttcataaaatttgttttgttcaaaaaaagtaatggccaaaaatatttagaaaataacttttttatttaaaatagagccaaaaattattattttaaattttatttcataaattttattttgaggaatgaatgatgatcagttcagtctggaggaagaagaaggaaaagaacagcaagaagacaggaaaactccgacaaaagatggtaatatacaaatattagaagacattttcagaataatttggtaa

SEQ ID NO: 61607 - DNA, 1400 bp, Heterodera glycines
  misc_feature (1019)..(1019): n is a, c, g, or t
  Genomic contig location: Contig_ID=SeqID_31232; Location=62..1461; Strand=-
  SCN-specific regions: Sequence locations=1-247,271-1237,1273-1400
atgcctggcggtagcaaaaccaactacaaaattcatgtgcaaaccatctcatggaaggttggtgcggttaaaattcacaaaaaattgaaatttgatccctaatcgtgatttatggggcgggtttctgggtcactgatcacgaacgaatctgacattttcgggttcgatattcgaaattgatcaaaatgaatgtcagatttgtgatcagcggcaacccgaaaaccacccataacatattttcatgactttttgaacaaaaattcttcaaaaaaggtggcccaccatctagaagttgatttggaacggttttacacccaaaaacgtcaattttttttggatttattcataaattcagaaaaaaaaccgttgatgctaacgggcgctggcagaaatgaaaaagttgaaaatttaaaaaaaaaatgccgtgacagtgcttgaaacgatattgtaaacaattaaggaatatgaagcgaatgcactgaaatcggacggtgaattggagcgcgaagaagtgagttcaaacggcaaatggttgacaaaaaaatttttaatcaaattttgccaaaacccgtaaataccaaattcagaaccccggacccgatttcttacaaaaagtcgaaactaaaattttcgcatttcaggtggagccactgtttgacccgatctacgaaaaggacaccaaacgaatgaaggcattgattggcacattgagcgaggagaagcggcgcggcttcttgcgcacgcgttacgccccggagggcaccaacaaaacgctgacggcactgatgctggcctccgtgttgggcacaggcgaaatggtggaaattttggtaggaaaaaacgcaatcaaaaactaaaaatttttttatcgtaatcgttgcagttggagagtggcgccgatccgaaccaaatgtgccttcgcaaactcatcgacgcaagaggttcccccaccatgaccagtgagtgagaagattcattaaaaaatgctttttgggggtcagtgattcaaaagggtgacnccttcgcacaccggggggggggggtgggtcaaaacgaagggtacacctcaaaacatcgacgggcgaaacttcaccgggacataacttatcgcaaattaaaaaaaaagaagattttcgtaatactgctgagggtacccacctttttggcagaaaaatgtttgaaaagattgcttaaagacatcgatttcccatcaaattttcatttctaacggcggaaaaattagaatttttatttatttttccatcaattttcagttgtgacgcccctttgggttggcgcaatggatggccatttcgaagtgtgccaagcgttggtcaaacacggggccgacgtcgacttgggcgcgccgcaatttgccatgtcaccactgatggccgcat

SEQ ID NO: 61608 - DNA, 282 bp, Heterodera glycines
  Genomic contig location: Contig_ID=SeqID_31233; Location=937..1218; Strand=+
  SCN-specific regions: Sequence locations=1-282
atggccgacgtggagcagtcctacatgaccgaggcggaccgccgggcgttggagcgctttcggcgcgctgaacggcgcctgttttccaccgagattgagctggacaaggtgctgttcaccttccaacagtacgacatgctcagacgccgctgggccatggagcaggcacggcaaatgccgcacggcagacggaaaaggcaacaagcggcggcggcagctgtggcggcgacaacggcacagtcaccaaacgtgaacagtgccagccatttggcgaagtcgtga

SEQ ID NO: 61609 - DNA, 147 bp, Heterodera glycines
  Genomic contig location: Contig_ID=SeqID_31235; Location=672..818; Strand=+
  SCN-specific regions: Sequence locations=1-96,118-147
atggctacgactgactggggccaattcgacgctaacggaactgactacgatgccatctacgacgacacagatgacgaagcgggcactacggacaacgggcagggcagcgggcagggcggcagcgtgctcaatcacctactgacgcag

SEQ ID NO: 61610 - DNA, 571 bp, Heterodera glycines
  Genomic contig location: Contig_ID=SeqID_31236; Location=116..686; Strand=+
  SCN-specific regions: Sequence locations=1-290
atgcgggattgcggactgggatcccgcaaaatcccgcgcgggatcccgtcccgcgccggtctctacctagcaccgtgtggcggcaatggtaaattttcaattgccaaaaaaaaaagaaaaaatttctcttaaaatttaaacccagcagaatttctatatttggaaattacttatgtttattatatttctcaaatagatgaagcaccaaaaatagaccaagcaaaattgggaacaaaaatggaactgagagagacggcatggaaaacaactgctggagagaaaagagaaacaaattttaaattaaaattgaaaatccttttttaaaaaaattaatccataaataatttattagcaaaaatataatgaatttattttattttgttttttattttacttatctataaataaaaaaaagtcatcagaatgtaaataatatgttgtgaaaatattaattaaaaataagtttttgttatatttaaatcaattttatagattttcagtaattattttattaaaaaaagaaattttattttataaaattattaaaaaatatacgtaaaatatttttaaa

SEQ ID NO: 61611 - DNA, 150 bp, Heterodera glycines
  Genomic contig location: Contig_ID=SeqID_31237; Location=198..347; Strand=-
  SCN-specific regions: Sequence locations=1-57,87-150
ttacagcttaactaggccctattaagcttatttccagaaaatctcgcatgaattctcatttttaaattttttatagatttttaaatgtttggattttttttggcttaccaaaacttcatcgaacctggttctttctattctctttcaaat

SEQ ID NO: 61612 - DNA, 1167 bp, Heterodera glycines
  Genomic contig location: Contig_ID=SeqID_31238; Location=109..1275; Strand=-
  SCN-specific regions: Sequence locations=1-3,25-499,521-723,746 -803,838-1167
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaaccacaggagaccgatgaaccccggaaaataattattcctaggaaaagacttgaagagcaaactcctgatcctgaatcagataatgatacaataaatgagttaactccggagccccaaacaacatccacattaaaacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcggggaagaaagatgaaacaccgcgcggtgcaaaatttctcaaagataggttactgaaggatccgacagtaaaagacatggttgataaatcaaaggtcatgtggggacgtggaaggaaaaaggcaataaaatctataaaaacacccggcatagtgcgagagaagaaacccttcaaaccactaatatgggccagactgtagagaaaattttatcaaaaatttattttaatttaaaatctccggcaagttttgctggaattcaaaaaattttaaatgatgccaaaaagattgacccggaaattacgaccgatgacgttaataaattcctagaaaagcagagaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaagcttttgatc

SEQ ID NO: 61613 - DNA, 1212 bp, Heterodera glycines
  Genomic contig location: Contig_ID=SeqID_31239; Location=228..1439; Strand=-
  SCN-specific regions: Sequence locations=1-194,216-308,330-521,549 -555,577-825,853-884,914-1212
atgcttgttttattcaatataataagttttttatttttcatcgccatatttttgacatatccgaaacagatttgtggtgggccgaaatcgtccaaatcatcagattctcttatggcgcccttattaaattcaaaacggattagtggagcgaaatcgtccaaatcatcagtttcgcctaaagtgcccttattactcaaatcatcactaaaatcatccacacccaaatcgacaccaaaccaatcaaagtcaacaaagaattccaattcggcaattaattgtgaaaaaatcaaccattcattggaaagtttcaagcactcaattattaaaagtccaaatgaatacaggtttaagcccagaaaccattataaacttcgtattttgtcaggcccaattggtaagaatttttgtaataatcataaaattcaatcttgagggtaaattctcggtcttgagtctcgggaattttcagtctcgagcatcgctaccattatttaaatccaagaataaacaatgcataaattttgagaatttatttaaaaacacaaatcctcaattcccaaaatagttttaattttcaaaaaaaagctcccattacttataaaatcacaaatgagggtaatgattttttgaattctgctggtaaaaaagtccaatagcccttctcaatttctgaaattaaagcttattggcttttttgatgcaattagtttgtcatttttcataattttcacgaaatctccgtacctttacttgtcccagaatcagattcctgacattttcgtgttcggaatttctaattccgcttccaaaaaattggggtctcggaatccaaatttttgaaaaattttggatctctaaatacctattttgctaattttgacatatcaattaaggtttttaaaaaatttattctcgtaacatcatccataaaatgtaccaaatttaggcaagccccaaaaacaatttcactttgtcaccgatgaaaagggcaaaataaaatggaatttcacaacggatgtgcgcgaaaataagttcacacctaaaggattcaaaaattgtaaatcaaaattgcctgtaacaattttggtggagacaaccaaagaaagtcgacttttggcaaaatacaaaaattatgcccaaatgaaaaagaaaatgcttgcaagaaaagggaaactttgtaaagaaaacattataaaattcaacgaacttgag

SEQ ID NO: 61614 - DNA, 2325 bp, Heterodera glycines
  Genomic contig location: Contig_ID=SeqID_6449; Location=111..2435; Strand=+
  SCN-specific regions: Sequence locations=1-680,702-803,825-1552,1574 -2252,2274-2286,2309-2325
  Gene Ontology: Mol. function=calcium ion binding; Cellular component =plasma membrane; Biological process=membrane fusion
atgtcgacaattgatacgaagtcaaaccatgctgatgaaatgaaaccgaacatgcaaaaagggaccaaacgagcggcaaccgatcgctcagacgagcctaaacgaccccgcttccttagtgagaagtgccgccatcctcgtttaattgccttcgaagaaagagaagcggcgtgccagtattttgaaaaaattttcaagcgtgacaaatttttgttcaaaaattctgatacttccgagtctgaatcggaataaattcctttaatttaattaaccaaagctacaaataatcaatcgcccattcatgtgcacccattattttttcttatttatatgctaatattattcgaaagctactaatattctaagctgtgaatatacacaattcgatacttgaaaaagcccttaatttgcaaaaaattaatcagaattagcgcaattcatgtgtaccctttacaacccacgtaaaaatatgatttatatgctcgcgcaaaattttttacgaatttatctttagctttcagcttataatcatagcttctaaccaaatagaactgctcgaaatgccatcacagttgactcctgaaatgatttttgataaaatttgcaacgatggatcgacaaaaatggacaaaaatacattgcaaagtctcctttcgaatggcacagatcgatctttcaatcaggacacctgtaggcttctcatcgacctgtttgactccaatcgcgatggcatgattgatcggaatgaattttggcctctttggaaggtgattattgttgcagtgttcatctttgacttgtcgtttagtttttgataacacattgttttaacggttcattttagtatgtggacgaatggaagatctcttttaagaatattgcagccgaaggtgagctgacaataggtgttgaccgacttgaaactgctttaagagaatatggtgagtgggcattttttgtctacaattccgctgtgagaaattggcagcgggcgctagcacaagctgtcgatttctcccagcgggcgctggcaccagctgccaatttctcccactattctaaatagtttctttataggatacagattttctgtcaacttttactgtacattattacgaaagtatgatcgcacaatgtcgggtaatataactgatttagttgttttcaatctgataattatttaagatcgcttacactttgatgattttatttatctttgtcttgtgctgcagcaattgactactccattccgcgatcgtgactttgatcagaaaggaaggattagagtttgtaagtaccatcttcaaaaattcatcccaaataattctttttaggtttcgaagactacatcgcgatgtttttatccacaatattataagattttcgcatttgctattaaattttgctctctatttggatttttattggtcattttacgttcaatgacgcatataattattaacttttggtttaaatgtcactataatcgtctttttgacttaatttccagcaaatcatctcggtattctctccccatcggtgtgtgaagatgaacaacaacaacaacaacaacctgaaacgattccaaattaagccaaaaggccccgaggaacaaccaactttgcgcacgaaaacgctcagcgaggtccaggagtttgatgcggctggctctttctttctgcgcgcaaagattgctagcgttctgttttccatctacaaggtgatggacaaaaaaaacgcttgctcctttgtcgcattatgcttacaatttaggcctgtccgatgcgtagcaacggtattccatgtcgtaagaaacttgacgaggaagacttctgtgtctcgtgcgcacatcgcgccaaaaagcccagccgcaatttgtaccttcgtgttgtactccgagattgcgatgatgaggaatgcgagcagcagacaaccgctttttcccatgtagccatcaaatttctgggcattgccagcgtagacgccttttacaacctatcagagaacgcgcccgataagttggaatcgatcttgcagtcgaaaatcgaccaaactgtgttcgtcaagctcaacatcaaggtgggtagtgtaaatggtcctcccgctattatctagtccagtgtcttctacgtaaaaattatgtcagataaacatgtatgttttaaggaaaagaatgagaccgcgacgctagactggattatttcctcaatatctgaggaaaaaccggtggcggtggtagtggatgttgaaagcagcgatgatgaggccgaggatgggtcatcatcttcaaatggttcacctaagaagcgcaccaaaaagaattga

SEQ ID NO: 61615 - DNA, 679 bp, Heterodera glycines
  Genomic contig location: Contig_ID=SeqID_6449; Location=2748..3426; Strand=+
  SCN-specific regions: Sequence locations=1-19,50-679
atgaaaaagggtgaagacgacactgctactgctgctgctgctgtcccacgaggcaaacggcccaactcaaactctgtatcagctgcccatttttctactgaatcagaggagatgaaaagttgtaagaaggaagagccgatggcgaccggatgtcgcaaaggtgcgaaacgacaatacccttattcgttgatgtcagctcgagcccaagatgtgtggtaagttttcagacccaaagtaaagcgtatgaaaataacccaggtcgctaaaacttgaccagttggaggagaaatattcaagaatggaagaggagctttcggaagacagcgatgatgcaattgatttctacgaagacggtattgatgatattgtggaaaagtgagttagcctcctttataccagctagaatgttatccattcatcctttttttttaaggataaatcgtttcgaagcaaaagtgaaaaaatggtcagtaaatcatggaaatacgccagtcgtcaaaaaaccacggttagttgttttcaagcagacagaacgcaccacatattatgacaacatactgaattttacagttataacacaaatgctgatgagaatagcaatgatgctgatgatgatgcgccaacatcgactgtgtacctgaatttgcacaatgacaagatgatcgagaaaacaaattaa

SEQ ID NO: 61616 - DNA, 1005 bp, Heterodera glycines
  Genomic contig location: Contig_ID=SeqID_6449; Location=3587..4591; Strand=+
  SCN-specific regions: Sequence locations=1-220,251-337,359-966,988 -1005
atgccatccgattctgatagaaaaagaaggacaacatcagaaaaaagctccaagcaaagccaaactcagcctaaacaaccgagatgggatttccgctcgatgtcctattttgagaagtatccgactgagccacaaatggaagaggagatgaggcaactacgactagcgacagcaaatgatcagataggcacaggcgatacccacacatcggcagattcagaacaacaacaacaacaacagaagcaacaaccgttgtataaagagatcaccaaccatgtacataagcttgagcgattctctgtgcagcgccatgtcactgaatttatgcttaacgctcagcatgatgagcccgatgaagcgctacgtcaagcgttcgatgagctcattgccagagctgtacaaaatgcggaaaagaaaagtgggcgcgcagtctcaaaattaggcattatggtgtcagggaaagtgttaaacgatccagtagtgatacctatgcgccctccaatccaaaacaacgtcgacgtggtgatggctgagcttgacaagttgggtcagagcgagggagacgatggaggtgctgacaaaaaaactttgctgctcagcgatcctgtggagatcatcgtcacctgtttgacccctccagtagggtcagccccacgtttacatccataccaaaattggggatacgatgaatcgcaaagaattgtcatacgcaacaaggatagctactgtttatttcatgcgcttgttgcaggccgtgcctatcatgaccgcgatattttctgccttactcataacccaatagatgagcagcagcctcaatttatggcaaacataatgaacagacacgatttttgcaaagactacgaggcattcaatcgtctggtatcaaacattggtcgaatgcaaactgcagttgaagagctgatgaatgcgtcgggcattcaaaaggaccagacttcttatggaattgaacatattcagcaggttcaacaatactgggtatga

SEQ ID NO: 61617 - DNA, 531 bp, Heterodera glycines
  Genomic contig location: Contig_ID=SeqID_31243; Location=10..540; Strand=-
  SCN-specific regions: Sequence locations=1-199,223-255,278-324,347 -398,431-506,529-531
atgcgcaaaaagtttttcgcttttacaatttttctgttcatcgttttgcaattaacggatgctgaaatgtcaaacggtaatgttgtttttaacaattaaatgaataagcattaataatctttttacgaaaatggctttaattaaaatgaaaatttttcaaatttttccgaattttataaccgttataatcggacattcacttgatccatttttcataaattttactgtatttccactggagttttttgattggaattataaaaacaaaattttatttgcttttcatggatttcaaaaaatttatgtcgtaatttggtatgttcaagattcaaaattaacattttgttcaattttcaaaatctcttccattttgaaagtatttgatatgtttagagaagaaatatatttttattaattaaaatttttatttcaatttcagaatacaaagaagcgtgcaatgacacatgtgctgctttaccaaagcagaattgcggtcgtggaaggcaaaaagtaacagtaactcacagataa

SEQ ID NO: 61618 - DNA, 71 bp, Heterodera glycines
  Genomic contig location: Contig_ID=SeqID_31244; Location=487..557; Strand=+
  SCN-specific regions: Sequence locations=1-71
gtggaatatgccgtgccatcggagtaccaatttgtggactatttgggcggtggtaactacggcaacgtgat

SEQ ID NO: 61619 - DNA, 819 bp, Heterodera glycines
  Genomic contig location: Contig_ID=SeqID_31245; Location=217..1035; Strand=+
  SCN-specific regions: Sequence locations=1-192,216-358,380-819
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaa

SEQ ID NO: 61620 - DNA, 357 bp, Heterodera glycines
  Genomic contig location: Contig_ID=SeqID_31246; Location=202..558; Strand=+
  SCN-specific regions: Sequence locations=1-1,23-27,49-130,152-157,219- 293,315-357
ctggaaaaagtggaaaaggaaatgaacgaacggactgaagaattggaagaaatgagagaaatgctgacgcactttcaacatgtaaaggaagttgatttaaaacaattggaacaacaaattgagcaaagacaaaagagaggggaagaaagaatggacaaaaaggaagaaaaacaaagggaggaaaaggaaaagcaaagggaggaaaaggaaacgaaaggcgacagagaggagaaacaagcgcaaaagagaggggacagcagcagaagaacagtgctaatggtggacaattcgagcgaatgggccgaacagctgcagaaagtgcgggaacgggccaaactctgtgtggacacttacaag

SEQ ID NO: 61621 - DNA, 860 bp, Heterodera glycines
  Genomic contig location: Contig_ID=SeqID_31247; Location=125..984; Strand=+
  SCN-specific regions: Sequence locations=1-414,436-767,795-807,830-860
attgtgcctccttcaatgctttcgaaaccgcagaaaattggatcattcaaagtgagccaatcgtttttttgccatcttccccccaatttgcctgtcatttccttgtttaagccacagccatcgccgatgggccttccgcatccgaaaaacggtgtccgcactggaattgtgagtttttgttttggggcgtttcaccggcccccccgtgaaaatttaaaaaagaaatttttactaacataaatttttaaagaaaaatcttataagttgttttcataagaaattctaaaaaaaattatttgagaaattttatagcgaattactaagattttcggaaaattttttcttagactttcctcatgaaaaaaaactaaaaaaatttaaaagatttcgtggggtaagcgtagtacaacacactttgtttggctgtgtgttggtttaatgttttttgacaatcgatgtttaaggctgttcccacttcgatatgggcccccaacgatgatgacatgtacaagccgaagcagtacgaccagcaggaacagccgaagcaagcggagcgaccagcagcagcgcacggcaagctggccgacgacgacatttacaacccgaagcaatacactgaacagaaggctggtggtggtggtcgaccgacgtatgaagccgcacttgccgacgatgacctgtacaatccaaaacaatacagtcagaaaccacaacaacaaaagggcgccgacgatgatgacctgtacaagccgccgcaacaatacaatcaacagcagcagcagcggaagatgggccgaccgaaatcgtatgaagatgagcttgacgaagatgatttgtacaagccaaagcaatacaattag

SEQ ID NO: 61622 - DNA, 892 bp, Heterodera glycines; identical to SEQ ID NO: 31248
  Genomic contig location: Contig_ID=SeqID_31248; Location=1..892; Strand=+
  SCN-specific regions: Sequence locations=1-39,73-413,435-769,791-892

SEQ ID NO: 61623 - DNA, 1028 bp, Heterodera glycines
  Genomic contig location: Contig_ID=SeqID_31249; Location=760..1787; Strand=-
  SCN-specific regions: Sequence locations=1-385,446-575,597-994,1018 -1028
  Gene Ontology: Mol. function=water channel activity; Cellular component=integral to plasma membrane; Biological process=transport
tgtgccaattcccccgtccaaaggtggccatttgacccggccgtgtctctcgcctttcgttagccttggcaaattgccatttgcgcactttttgctgtattccctcgtccaaactgtcggcgcctttttcggctccgccctttgcttccacgtctacagaggtgtgggttgacttgctatttttcgaaaattttgaaaattattatttttttgccagaatcattcgagaaattcgacgcgggcattcgaacggtgggagggcccagcggaacgggcgcaattttctgttcctttccggacgaacacatcggacattacacaggtaagcgaagcaaatgctaatgtaatggccacactcatctcattcatgcttttccttcaggattttctatttttttctccctttctcctttcctctcgctctcgcctctctctcctttgtctcacatttcccttttgcagcgtttgtggatgaaattgtcggcactgcgctgctcctctttttcgtcaatgcgctgatcgatccgcgaaaccaagtgccaaaatgggtgcatccgatcggctttgggctggccatctttctgatcacttcctcttttggcatggtacgtttgtctttggcataatcactccctccctcgtctattggtaatttctgcttgacagaatgtcggctctccgatcaatccggcacgtgactttggtcctcggctctttcttctgtttgccggctacggatgggaagcgattgcgtcagtttttgtcaacagttcaacagcaacgttcaatggcgcagaaacgttgcgcaacacaaccaccgtcagtggaggaagtggggacaagcgaaagtggaagcgagtcggcctcggactccagctattcgttttcttccagtggtgagtttgagtgcggggcagggttgttccgggtcgagaaaaatcatcgggtcgggtttcgggtcgagaaaaaggccgggtttcgggtcaattgacaaatttttaatttgtttaaaaatcaaatggcactgc

SEQ ID NO: 61624 - DNA, 235 bp, Heterodera glycines
  Genomic contig location: Contig_ID=SeqID_31251; Location=945..1179; Strand=-
  SCN-specific regions: Sequence locations=1-235
tgcgtttggcttttgcagcaacatttattaagggtcaaggtgccacttaccaaaaaattggaatagattggacgcgtcaaagtttttcacatggccaaacctatgtggctttgtcacgggttggatcgtggcaacaaataaaaattaaattatcaaatgaaaatattgatggaaaagttgataacattgtttggaaagaaattttatagtatttttggctaagttgttaaataaa

SEQ ID NO: 61625 - DNA, 809 bp, Heterodera glycines
  Genomic contig location: Contig_ID=SeqID_6450; Location=248..1056; Strand=+
  SCN-specific regions: Sequence locations=1-264,286-696,718-809
atgggctgtatggtccctgctgaaagtgcatcatttgtgccgatgacaaggattttttcacgagttggtcataacgatgatttggtgcagaatctatcgggatttgcagtcgaagtatgtccaagttgtttaattaaaatatgaattcattttgaatggatttgcgttgtttttcatatgtccgaaatggcggtaattttgcaaaatgcgaatgaaacttcactgataatcattgacgaattggccagaagtgcgttcatgaattataacaaaataatttaattacaatatgatttactttttgcctggcatttattttttataggcacttccaccgaagaaggcattggaatttgttatgcgatttgcgagaaattgctttccactggggtgtctaaatgaaaaatacttacagtattctaaagtgtttgttcaccctttaggcctttgtgttttttgctacgcatttcttggacatggcacaaatggcattgaattacccaaacattgtcaaaaagtaaccaaactgattttaattttataatgcatcaatttcagctatcatttcgcttctgtttcgacgattgaccaagcgacacgattggaaatcctcacgccatcgccacaactccacgaaggaccgtatgaagggcctttatacggtaagatcaacaaaaggcattttataatgctgttaaatccagtgaaattcaggattggaattggctgagttggcgactttacctcaaaaaatcacacaggaggcacgccaattagcagagaaaattaggaaggcgaaggaaaattag

SEQ ID NO: 61626 - DNA, 486 bp, Heterodera glycines
  Genomic contig location: Contig_ID=SeqID_31253; Location=36..521; Strand=+
  SCN-specific regions: Sequence locations=1-189,251-272,321-350,390-486
atgaccccccagccttttcgcgacataatgggtgaaacgacgattctcttagagccaaggtaattaaagaatcaacttgaattttaatccacagatatttaacaaaaacaatctttcgtccataattatatcattggatgtaattaaattttttctcaacttcaaatacagttcaaacttacattggagaattaattaaaataaaatcaaaaatttagctaaataatatataatgaaataataaataattcttcaggtatctaatagtcagcaattataattttttttatttaagatttttaaagaaaaatactaataaacatagcttaatgaaaaattatggtttagagataataaaatatcaaatataaataaatttcataaaaattcaacaaatacaatttaaattggttcaaaaatgatcaatttagagataatattattaattaatgtgaaaaactataaataatattcttcataagaaaa

SEQ ID NO: 61627 - DNA, 779 bp, Heterodera glycines
  Genomic contig location: Contig_ID=SeqID_31254; Location=989..1767; Strand=+
  SCN-specific regions: Sequence locations=1-233,263-539,561-600,622-779
atgcgtgtctggatgttcgtgcagcagcagctgccggtgtgtgcaagacttgtgagagacaatgatttcaaggagagactcttgctaccggtgcgtgcgattgatcagatttacaaattcgaatggagagactcttggcttccttacttgagctttgcccaaataagtactgacgcctcacaccagcgggaaggtggtctctttgcgcaaggcaaccctcacctgagccattgtttttttgataaatatatattttttttttgcttaaaaaggcaatggctcaggatcattgggcttctctgatcatcttcccccctcctccctcggcatctcttatcattttcgtcccctcctcccccggcatttcattagtccatcccccttcaaacttctctgatcatcttccccctcctccctccacatctcaaatcactcacgctaccgttactattgatccatagatccctcctccctattaatcaacacatagatgctccatactctatggtcattcgcgaaaataaattaccacaaattatcaaaatttttcaattttctgcctaatgtttctaaaaaaattattgaggcttctaatttcgtaaaataacaatttaaacatttctatgctttaggcagtcattcgacctgtacctgaagaagatcctcgagggcttcaaccccgacctgtacccggtcgccattcgagcaaaagcgatgaaatgcttggcccaaattgtggaagcagactaccaagtacagcaataatacataatccatga

SEQ ID NO: 61628 - DNA, 448 bp, Heterodera glycines
  Genomic contig location: Contig_ID=SeqID_31255; Location=23..470; Strand=-
  SCN-specific regions: Sequence locations=1-27,50-50,73-357,379 -400,422-448
atgaataaaatagttttgttcgtactttttggtttggtatttggccaaacaaatcctaattgttgttgcctatctaacgaagagaaacaacaattgaacgctgcgagaaaaaccattgaaaaagcatttcgggatacactcagattaaatactgaagcccgagatttcgcggctgtttctaatagggcaatttctgaggcagagaaaattaaagttcgtcatcctgaggcaccgggcatgaaaacatggttcggtaggctattggaatgggtgagaaaagtacaaggattctcagaaaaattaaacgaagaaaagcagaaaattggatttattagaaaagaaatggataagtgtttagacagaaaagatgtgttaatgtgtcgtgagttggcagatgaagctaaagggatttttgaaattgttaagcagtatagacaagatgtcggta

SEQ ID NO: 61629 - DNA, 553 bp, Heterodera glycines
  Genomic contig location: Contig_ID=SeqID_31256; Location=143..695; Strand=+
  SCN-specific regions: Sequence locations=1-71,93-293,315-553
atgtgttgctatgaactggacagtcacagccgtgaattggtgtgccatcgccgatcgatcaaaattgatgaggaaagaaggaaaaatgatgactaatcgaccatttgacctttctcattattttgttatttttcacatttggagtcatttttattttatggaaatttttacctctatttaagggataacgatttgtcatcagcattttgatgcttgaaatttcaaatatttcttgctttctgaccccgggagggatgatgctatgcatgcttatcatgatcataattgatgaatcgaatgttgggaccaaaatggggtgaaagagagcagaattcatcaattcacccaatcactaaaatataccacaattcgaaaagaagtgtttgacattgcagcggaaaatttgggctgtgaaaaaggagagcttgcgactgttgttcaaagaatttcaaaaaacaaatgcgctaacaaaattgatcaccgaaacactcaaccgtggtgcgacattgtggtatcgtctcgataacaattaaaagaaacataaatattatta

SEQ ID NO: 61630 - DNA, 792 bp, Heterodera glycines
  Genomic contig location: Contig_ID=SeqID_31258; Location=52..843; Strand=-
  SCN-specific regions: Sequence locations=1-441,463-666,688-792
atggcaaattccggcgacggaacggtcaatggcaccgaattggtggcacaaattgagcaaagtgccaaaaatgacactgaacggtaagtggtggtggcttggcatttcgtctgtcagtagtggagtttatgatgggaccgaaactcaatcgacggcaccggcattttgcctgattcatactgtctgatcaggtcgggtcacttagtgatttgatcaggtctctctgacctctgattggtctggtctctccatacgtctcattgtccgatcacactgatcggttggctttgtggtttgacccgacctctctttctctcccctccactcctttgacttggtttggtctgatcagtgcctttgatttggtcatttgatcagttggcatgaggttgaaaaaacattttgtgttgacttaccaaagttagtttcagagttgttgatacctttcttcacataattcatgaggcaagaaggcaaaatggcgaaaatggagggggacaaaatgtcgacaaatttattcgaactgtcaaaatttatcgacaaatttacgcaacattggaccaattcatggagaaaaacagtgcaaatgaagtgattgccaagaatgacacatttaaaagtgtttggaccaaactgcgaaattttatggccaaaagtgtagcccaattggatcatctggccaaacaaagggtcgaatttaagccaagcgatggaccaagtgaacagcagacggatgaagtgatcaggcaaaggttcagaagtgattttataaaaaaatattgcaaaatttaa

SEQ ID NO: 61631 - DNA, 78 bp, Heterodera glycines; identical to SEQ ID NO: 61197
  Genomic contig location: Contig_ID=SeqID_31260; Location=454..531; Strand=+
  SCN-specific regions: Sequence locations=1-78

SEQ ID NO: 61632 - DNA, 323 bp, Heterodera glycines
  Genomic contig location: Contig_ID=SeqID_31261; Location=535..857; Strand=+
  SCN-specific regions: Sequence locations=1-79,113-246,280-323
atttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaa

SEQ ID NO: 61633 - DNA, 344 bp, Heterodera glycines
  Genomic contig location: Contig_ID=SeqID_6452; Location=2509..2852; Strand=-
  SCN-specific regions: Sequence locations=1-344
atgaacacctatataaaagtatctcccttcatattagtatccaaaccagaaactttgttggtaaacgtgaaaataaaatactatccggtggtaagaacaaactattctcgtacctaagaaaatatatcaaatgtgaagaaaagattcccactttaaattatgataattcagttattttttctcctgatcaaaaagctgaaatttttgcaaaagttttttctgaacattatttacataattctaagtctttaccttatgatttatctagtcactctcctgtaattaatgatattgaatttaatgttgttgatgttggccgggtccttaaatctttaccaaataaa

SEQ ID NO: 61634 - DNA, 2019 bp, Heterodera glycines
  Genomic contig location: Contig_ID=SeqID_6452; Location=3231..5249; Strand=+
  SCN-specific regions: Sequence locations=1-208,235-380,414-966,988 -1024,1046-1127,1149-1338,1360-1360,1383-1523,1545-1667,1699 -1828,1851-1878,1900-1900,1922-2019
  Gene Ontology: Mol. function=transposase activity; Cellular component= nuclear chromosome
atgtctgaaatatggtctttttataaaaaatcgcaaacatcggaaacggcattatgtaacctttgtcgcaattctttttcgtgtaagaaatcgtcgactaagggattatgggatcatttaaagacgatgcataatgacgaatttgaacaatggcaaaaaaacaaaggaaacacaaataaagaagtactaaatttaaaaggttctgtgatttataaaattttttaggggcaagaaaacaaaattacgaaattttttcaacaatctgatgaccaaaagcaaaaggccgacgaattggttctgaaattaatgttgcggacaaattcatcttttttaatcaccgaatcgcctgaattgagagagctgtacagcaaagcatttcctggatttgaagttattttttctctttattattcctaaaaaaatcattttttgcagctacatagtagggaatatttccgtaaaattgttctaccaaaaatggcaaatgcaatcaaggagaaaatttgttcacaagtttcaaacgattatttcacaataacaacagatggttggagtcaaccgacttcaactccttcattattaaggttataaattctctttatgttatatttaagttaaaattttagcattactattcatcatattgacaatgaattcaaccgaaacgattttgttttggaagcagtacctatcgaatcacattctggcgacaacattgccgactcaatttatgatgcacttgatgaaaacggattaaaaattgagaaattaatttccattgtccgtgatgacgcaaaaaacatgcagcgaatggctagggtcttaggaaaatcaaggtaaaacattttataagaacgaaaattattcgaaaatttaagtcatcaatgtgtggctcattttttacatcttgtggcgcatgatgtactcaaattgggccaaatcaaggaacttacggacaaagtacacgaatgggtgaaattttgccgcacaaggaagggatttgaaattttgagacgccatcaagaaaaacaaaatactgagaaaataaaattagtccaggttaaaataattttctacaaatctatgattttaaattcagtcggttataacaaggtggaattccgtttacaaaatgcttgatgtttttcgtcgtcagaaaaaggcattgctttcaatggaagcagaacgcactgaatttcatttgcttggttcacaggcaaagcgttcacggctcgattttgtctctgatcatttaccgccgctaattcagagtgattttgtatttctgcgccaactttgtcctttgttggagctgtttaacagagaaactgaaagagtaaaaacaatttaatttataaaattttctgattttctcattttaagttttcacgtgaaaagtcaacttgttcttgcattttgccaactctaaaaaggctttttgattttttaaccaaagaagaacaccctcaacaaattatgataattgcgcaaagtcttgctgaatcaattggctctcgaatgcacaattacagagaaaatgaattattgcgaatttcaatgttgttggacccccgttttgcgtatgatctgaatttatttatgagtggtttctggaaatcaattgcagaggatttaattgattttgcaaaggaaagtaatttaaacaattttaaacagaagtttattttattttaagttaatcccgaaaatgaaaccaatgcgcaaaattttaccgaaacacaacaaatgatcaatcagaatctgctcattttacggattttagtgaaagtgatgagagcgctttaaaatgtaaacaagaatgaaaaactttaatttttatttaaaatttagtggacatttgaaacagtatataaaaggataaataaaatatttatttgctaagggaaaatgaataataatttagtggtctggttaaacgtggatttgttcccacggcttttcttcatcggattactgttgccaaatttgaggactttggcattggcaaaaacaatgtaa

SEQ ID NO: 61635 - DNA, 324 bp, Heterodera glycines
  Genomic contig location: Contig_ID=SeqID_31262; Location=1567..1890; Strand=+
  SCN-specific regions: Sequence locations=1-187,220-324
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgtaagtagagcactttctgaaaaaaatatttagaaacaaaaa

SEQ ID NO: 61636 - DNA, 1236 bp, Heterodera glycines
  Genomic contig location: Contig_ID=SeqID_31262; Location=466..1701; Strand=-
  SCN-specific regions: Sequence locations=1-197,220-239,262-296,326 -470,492-906,928-1236
  Gene Ontology: Mol. function=transcription co-repressor activity; Cellular component=nucleus; Biological process=chromatin modification
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggcgggggccgaaggctcccgcgggggggtgggggggtatatttttccaaaagaatattttgaaaatttttcaaatgctaatgctccttttccatcataccattccgcctttaattctcatttttcgttcacatttttagatactgaaggcgatttttcgtggcccgattatttgcggcagtgccaagcgattccggcgcccaatgcactttttgtaagcatattttttaaatttacacttacgctttgaatttctttcatctttttcattgccaggacccacttccttcggcggcaaaacttcagtattttaaggtacgctttttcatagtaaaataaatggggtattttgccaaatttgtctgtattttaacattttttgctatactaaattttcaggtcggtgccaaattggaggccaccgaccaatgcgagcccaacttggtctgtccggccaccatttgtgcgatccgcggtcgtctgctgcaagtgcactttgacggatgggagagcgaaatggaccagctgttcgactacaggtggccggggaacggatgatggggacacgaaaaaattcggaaattttttaggtctcgtgaactgttcccgattggctggtgtgagatgtacgggtacaagtgagttgtgctgtatttaacaaacctatgtttttcctctctacatttttacttactctctcccatagttggcgccggtaggcgggggaagccgacataaaagcaacgaatatttgtaacttttacgccacaatttttcaaaagtttttgcgtcactgtccccttcctgcccgattttccaatagttttacttgtatttttttttgatttcacaacggattctgtagccctaccctccctcaaaaaaagggtaaaaaagttccatttcccattttgttttttttcagacttgaagcgccaaaagggtacgatttatcgaagaaaaagatgaggacaatcggcgagtga

SEQ ID NO: 61637 - DNA, 1429 bp, Heterodera glycines
  Genomic contig location: Contig_ID=SeqID_31266; Location=191..1619; Strand=-
  SCN-specific regions: Sequence locations=1-190,212-287,326-662,684 -823,861-966,988-1193,1215-1316,1340-1396
gttgggccaaaggatgctttaactttggaaacagagcttttgcgaactgccgaaactaaagaaattgaaattaaaacggaaacaattcaaaatgaaaacaatggaaagccaaaaaattatggaaaaataaaaataaaaaaggaggaaaatgacgaagaaaatatttttataaaaaacgaagcacaaccaaatgaatttgataaaattaaatccgagcaaaatgatgaacattttggtaatgatgaacagaatttggatgaagaaagttcagacgaaaataaatcgggtaaaattttaatataattaaataaattcaataaaaaatgcacggatacagatgaagaatcatggaccgcaagttcagactatgaacaaactgacgaagaaagtgatgaaaagtcgtcaaaaaaaggaaaattggcaactaaatctgtgaaaaattccttcaaaagaacaattgcaaaacgtaaacattaaaaaattaaagtgtaacatggatctggccaaggcctggactttcctgggtacagatccaagtccatgtcggcaacctgggttcttctggacctagagttcctgcatttttgccagaaaagaacaggtccagtcaaatataaaatcaaggtctaggttaggcatgataatcctagctatcctggatgaaattttaaatttattatttaggtgactaatgtttacttcaagttatcaaaaaatggttaatcaggtccaggctttgacaatcccggattttcctggacctggatttgtgtccagaaaattcaggtccaggttcaagtctaagcatttcaaaatatcgaactttaataaaaacaaaataaaataagttttaatatttacaggaagtgaattatcagataatgaaaagataagaattgttaagcaatatataaagagaaaagggagtttgaaccaggtatgcactttttaattctttaaattttctaaaattacaatatcaatattggtaaatttgttcaaatcagttgcatgatactgattcaaaattcaatccttcagaaaaacaaaaagcgggaacaaattgcaagtgaattgggtgtgacgattcatcaaattaaaaattggacaaggaaatttggtttgggtaagacatatttttttcttaaaatttttcacgcacccacaaaaatagcagaattcagcattacgtttttaggcaatcaaaaatggttgacagatcgccaacgaaaaatgcttattaaaaaatttgacaaaatcaaagaaaagcgcactcaaaacggtttaccagctggtgaaattcgagaattggaagaaaaaatcgcagaagaaataggcataaacattcggacaatttacaaatggagaaagaaatttggcatctcaggaagttggcaaaaataaacaaaaaatattaaaaattaataaa

SEQ ID NO: 61638 - DNA, 439 bp, Heterodera glycines
  Genomic contig location: Contig_ID=SeqID_31269; Location=391..829; Strand=-
  SCN-specific regions: Sequence locations=1-439
  Gene Ontology: Biological process=DNA repair
ctgcgtcaggagacggcggaagaagcgaagcgacgctttgaaattgagtgcgaattcgtccaggcactcgctaacccgcattacctcaactgtgcgttaattttgcacgaatggcaaacagccaaatttaagtcgtgacattctgccacatcaacccgcacaatttgacactgacaattggtttttaataatttgtcagatttggcccagcgcggctacttcaaagaggactatttcgtcaattatttgaagtatttgctgtacttcaaacggcccgaatacgcgcgtacgctcaaattcccgcagtgtctgttctttttggaagcactccaaagcgcggactttcgcgaggccattgcctccgtggacaatgcccggtacattgaggaccaacaattgcttcaatggcacttttacatcagagtgcggcagcgccttt

SEQ ID NO: 61639 - DNA, 53 bp, Heterodera glycines
  Genomic contig location: Contig_ID=SeqID_31270; Location=93..145; Strand=-
  SCN-specific regions: Sequence locations=1-28,51-53
atgccgacaagctatcattcaagttataatattccaaaaatttattattttaa

SEQ ID NO: 61640 - DNA, 797 bp, Heterodera glycines
  Genomic contig location: Contig_ID=SeqID_31271; Location=568..1364; Strand=+
  SCN-specific regions: Sequence locations=1-118,154-456,499-542,564 -645,667-797
  Gene Ontology: Mol. function=ATP binding; Cellular component =extracellular space; Biological process=cell surface receptor linked signal transduction
gcctgcttttcttcatgggcaaagaccgtgatcagctgatggtggagcttgttggtggtcgaatcagtttgtcatttgaccttggctcagggcttggcaaattgttgaggtaaggggctataaaaaaatttttttttgaaaatttattaataactttttccagcaatggccaacggtacaacgatggaaaatggcatcttgtgcagatggatcggcaagaacgttcggccaaactaaaaattgacgacacggataaagtgaggaagaaataattttttgcatattttttgtttattattggaattttaggtctcaaaattttcttggaattggaaagataattgtgttttctatgattaaaaatttaaactttttactcaaattacttgatcaataaacttaggtatctattttaagtcatatttttcttgaacttatttgcgacttaccccttccaaaaaaaaaaagatctaaaaaatttttaaataattaatttaagcattttagttggtacttccccccccccccccctcctccctccgaaaatgtagcaattttttaaacaaatctagacaagagttcaaggaattttcccaagcttggtgtatttgtgcgcttattagatggtggtggtattttgtaaattttccctaaaattttcacaggttgagggcgagtcgcctggctcaatgttcgagatgagtgtttccgatgtgttcttcattggcggattgccgtcaaacattgacgcacggtttattgtccacccgttccatggctgcatgcgcaatttgaaa

SEQ ID NO: 61641 - DNA, 162 bp, Heterodera glycines
  Genomic contig location: Contig_ID=SeqID_6453; Location=717..878; Strand=+
  SCN-specific regions: Sequence locations=1-162
atgtgcaacaaactgatcatcgtcacccaaacgccgccttcgtccggcagaaaagggacggacgtgcggaaaatggaggacaaaatcaacaaggagatggagcacacgctgagaagatatgagcaggagctgtggtcgagcaaagcgcagcaacaggcgctg

SEQ ID NO: 61642 - DNA, 662 bp, Heterodera glycines
  Genomic contig location: Contig_ID=SeqID_31272; Location=527..1188; Strand=+
  SCN-specific regions: Sequence locations=1-230,268-662
atgccatttccgactaatggacggatttctgatcggaaaaagggcacccttttgatggacattgaaaaagtatccgaatttgcacgagaagaggttgaaagcagtcggtatagcgaaaaaatgtacataaatggacttccatggaaaatatatgcagaaaatgataaagatgaaagcactgacaataagttgtacatttttcttttgtgtgatgtcccagaggaaggtacaaattaaatattaattaataataattacaattaatttccattaagacaaacattggaattgcaaatgctcgggaaatgttcggattgtctcacaaaagaacggagtgttgggtttcaaaaaagtattcgttgaccttgtttttgataatgagaacagctgtcaatgtgtcaaatcgatttcatttgcagtgagtgacaattaaactttcccttaattgacccaattatggaaaattaaggaactgatggacctgaacaatggattttacaacagagaagacgacaaagtgacgttggccattgatgtcacagtgaaagatgaaaaaacagagaactttctttcggatcccaacaaatccaatgggacaatttcgatggaaattgaaaaagtgtcggaatttgtgcgagaagtcattgggagtgaatgcgaaa

SEQ ID NO: 61643 - DNA, 734 bp, Heterodera glycines
  Genomic contig location: Contig_ID=SeqID_31273; Location=50..783; Strand=+
  SCN-specific regions: Sequence locations=1-734
atggagctgtccattgataatgaccaactgatttgggatgttttcgcccgagaaatttggccaatttttgcgaccaacattcgcaatttgggctttaccagtgccaatggtttggacaatttttgtcgccgcacttcaccaacaattctcactgatctcaatcatctgaattcaatcaattccaattttctgttgcctgatgcaattgctgatgatgggccaaatgcttctgccggccaagtgttgtccaaatggttgcacacgccgagcaaaaatggacaaccgaagcgattgcattgcattgattattatgatagatcaaatcttgagtgggtcaacaatttgaaggaggtggccggccatattttgactgattgattgcctttgatttgcgttttctttttgtttaggcatttccccgtgccacttcttccgccagtttcattattcgaattgatcatgtgagaaaaatgccaaatgctgagccatttgaattggagaacgaacggaccaaagaaaagctgacattggagaaagtgtcacgttataatgttgttaatttgctgttggagcgatgtccaataattgttggggagacgacggcggcggttcaatgggaaaacgacgaaaattgggacgccaattatttgaactatgtcaaatttgagttgtggcgtggcattaattgcattgggtgagagcagcaaaacaacggaatttgattttgttgaaaa

SEQ ID NO: 61644 - DNA, 872 bp, Heterodera glycines
  Genomic contig location: Contig_ID=SeqID_31275; Location=90..961; Strand=+
  SCN-specific regions: Sequence locations=1-342,366-407,429-872
atgacaaagaatgactttgccattgtgggagaaaatattttcaccgcttttttggaggaacacgacaaattagaccctgaggcggtggaagaacttaaaaagcgccacaatgaaatttttggcacggattaagctcacaaatgatcaattgtttctagggtgaccaattcatttgattgtttcaattacatattttcattttcggaattttggccaatttttctccatcgatcactcattttaactgctggtcgatttctttaagtaaagaacgcagaatttcttcatattcggtatgcaaaatttgtgcaaaatttttggtagaaacccctcgtcatttcgtcccctaagccaaaatgagtcatttcgtccctcgcatgggcagaagcccaaataggaatcctattttggtggagttttaaaaatttcagatttttaattcttatttctagggtaggtcactacgggttattgaccggtacacccggttttcggtttcgtttatttcggtaatggaaaatttttttgatttcaatttttaagtgttggctctacattccttacattcctttagtcgatatatccccttgattcaattaattttgggataaattacacagattttgtctaaagaatgaccaaatttattgatttatgcaattttttaagaaaaaatcgtttttttttttggggggggggggagcggcggtgccgataggcactgccgggagaaatttttttatgaattttgttagaaattagccaaatttttcagaaatttcattcttttggatgaaaatacgccctaaaatcagaacatttcttagaaataagaacataaagaaaccctgcattaatcagataaaaatcaa

SEQ ID NO: 61645 - DNA, 438 bp, Heterodera glycines
  Genomic contig location: Contig_ID=SeqID_31276; Location=738..1175; Strand=-
  SCN-specific regions: Sequence locations=1-206,228-438
atgtccagtggcaattctggcagctcagccaataccttcttcaattcccctatcatctcgagccactccaatgagtatttacacaacgagaagtgagttttttatgaaagataagaaagagtagcataagtactttgggaaaatattccgaacaaatgcaattaattcgcaaaactcatcgcctcctacgaaaaacccttcgattcgcttttctttcccgaattttttaggaacacaaatgcggaaaagatgcaaaataagcgtgcaatctttgcctccattgaatgaaatcgtcaattgatccaaagagctgaggggggagggggaggatgtttagattgagatgcactcacccatatttgtccaaaatttcgtcaattgttgcgatggcattgaaaagcttgacagaaaattccttggtttgagtcgcgcaataaa

SEQ ID NO: 61646 - DNA, 539 bp, Heterodera glycines
  misc_feature (62)..(62): n is a, c, g, or t
  Genomic contig location: Contig_ID=SeqID_31279; Location=24..562; Strand=+
  SCN-specific regions: Sequence locations=1-517
atgtcattgttttatgtgagtatgatgagtgattaattgctctctaaattaaaagcttttcntttatctagcgcattttcagcagcttcaatgacatctccctcccggaattcctcgaaatgctcgacaaattgctggacatcggacacctacatagccaaattgtttatttagaaatattttctgattaatgtaatttgcattaatttgtattgtattaaaggaatcgcatcaccgtttggcttccgaattggtcaccggaatggtcagcggatcgaagctgtggcagtacgcaaaagtcaagaaggtgcaggagcggctggagcaacgattgaccgacacttttttgggccttacggaagaagtcgaaaagaattggggcacggcgttggccaccattgttcgtcatcattttgtcagtttaatcattagtaattatttcatcgtttagttcggtgcgtgtgagccgcgcgtcactaattggcttatccaaatccttttcggactcgcaaagcgacccacagaaataagcacacaaa

SEQ ID NO: 61647 - DNA, 316 bp, Heterodera glycines
  Genomic contig location: Contig_ID=SeqID_31279; Location=839..1154; Strand=+
  SCN-specific regions: Sequence locations=1-316
atgatcaatgaaatttgggataaatggtgggcccataaaaattaatttggcattccattgaccgaaaaatgtccgaaaatggacccttaagaaactgaccgcaaatttccgattttcagcaggccgcaaatttcatataacattttaatttcctttcttcagctgccttgccaccatttcatcgtccgatttcaagaaagcgcttgtcgaggcgaacggaggagaagcgaacaccgacgacgacagccaattgaaacatgtcaccgttgaggaagtgatctcgcgcataaatgccatggtaacgtttgttgattga

SEQ ID NO: 61648 - DNA, 803 bp, Heterodera glycines
  Genomic contig location: Contig_ID=SeqID_6455; Location=4678..5480; Strand=+
  SCN-specific regions: Sequence locations=1-803
ggttcgttagcgttggtcaccgtcgctccatccgcgttcgtcgttgtcgctggagtagtcgcagcgggcgcctcagtgttggtcgccgtagtcgcaccgggttcgttggcgttggtcaccgtcgctccgtccgcggtcgtcgttgtcggtggagtagtcgcaccgggttcgttggcgttggtcaccgtcgctccatccgcgttcgtcgttgtcgctggagtagtcgcagcgggcgcctcagtgttggtcgccgtagtcgcaccgggttcgttggcgttggtcaccgtcgctccgtccgcggtcgtcgttgtcggtggagtagtcgcagtggtcgccgcgtccgttgtcacagtcgccgctccggttgcgtcagtgttggtggctgcatccgcagtcgtcgtcgtctgctgctgggcagcgttcttcccccgtcgggcacggccttttttcacggtcctcggacgtccacggccacgcttttgtccagcagtgcgcggcgccgccctcgatttgcgcgatcccctcggccttccacggagcggtttgagcttgagcggacgacgcattgccgagccgcgcttcttcctcgtgctggtcccgtcgccgtcgttgttgttcccctgccgacgtgacgcgcggcgcaccgctgcactcacacgcgctcgggcgctgcttcgaccacgcactggcgctgtccgtctgttgttggttgaggcgccctgctgtcgtcgacgagctctctgaacaacggcggggagggcgtaaaatgagagacggaaatagttgcagcaaaaaagagggac

SEQ ID NO: 61649 - DNA, 1274 bp, Heterodera glycines
  Genomic contig location: Contig_ID=SeqID_6455; Location=2380..3653; Strand=+
  SCN-specific regions: Sequence locations=1-222,244-312,334-355,377 -761,783-1274
atggaggggaaagggatcaccgatcttgaagaagtcatctcgtcgatgagggacgaagaagctgtagacgaattggaattgtgttgtgatagcgcaacagagagagagggcaaaaaatgtgtaagcgctaaaattaattgcaaataattcaattaggagggataaagccgacttgaaaagagagtgaatgccaacaggggcaatcctaatttttgaatagaaaagagaattttgaaaatgttgcattttttctggggaaaagcttcgaattcattgaacaacaatttatgtatttttggtgcaaaataatgcttcaattattcctttaataaaaacaaaaatacgcattttccgtattttgaaaaaacatttcaactttttattcgaattcgggtccgagattcggaatttgggcaaatccgagttcagaatcgtaatcagcacccttgaaaacccacggaaaaattgcaattgtcacaaaaaggaacaaaacgtcgaaaaatggacagagcggaagagtgaatttgatgaattcaaacaaaaaaaaagtgcaaaaatcctaaaaatttctgcaatttatacttttttgaaaaatgactgacaaatttatgaaattttctgcgtatttaagcggtgaattccctaccaaaatcatccattcattcattgcattcacccattgtttctttccatcggtcgaatcgtcttcctatacaataaataattcccgtcagtttttttttgtttcattttttaaaatgaactgaattttgtgcccttttttcaggatggtcagagcaacaacggccaggacaagggcatcagcagcgcgagcacggagcatcaaaatcaatcgtcgaaatgccaagaaggcgcgtgccgcaattggacgagccggacatgtgagtgaagcggagggcaattaatacactaattaattcaaggacggcaatttttaaatgtgccaatttttcagacacgcaatgcgatcgcacgagagaagtgcatgatgtgtctgggcaaagtgagctccatgacgcgtgtgaccatgggctgtgtgcacgaatttcatcgcaggtggaggcggggctaattccgatcaatttcgaacccatggatccccgaattcgaacaagtctaaaagtcgagttttcctggccaaaatgccggaagttttgcttttgctgatcaccgaattcgaaatccgttccgatcaatttttaacccatgaccgtcgagttcgaacaagtctaaaagtcgttttctgtccatga

SEQ ID NO: 61650 - DNA, 981 bp, Heterodera glycines
  Genomic contig location: Contig_ID=SeqID_6455; Location=4515..5495; Strand=-
  SCN-specific regions: Sequence locations=1-670,848-981
  Gene Ontology: Mol. function=protein binding; Cellular component=cell wall (sensu Fungi)
ttggcacccgcttcagtccctcttttttgctgcaactatttccgtctctcattttacgccctccccgccgttgttcagagagctcgtcgacgacagcagggcgcctcaaccaacaacagacggacagcgccagtgcgtggtcgaagcagcgcccgagcgcgtgtgagtgcagcggtgcgccgcgcgtcacgtcggcaggggaacaacaacgacggcgacgggaccagcacgaggaagaagcgcggctcggcaatgcgtcgtccgctcaagctcaaaccgctccgtggaaggccgaggggatcgcgcaaatcgagggcggcgccgcgcactgctggacaaaagcgtggccgtggacgtccgaggaccgtgaaaaaaggccgtgcccgacgggggaagaacgctgcccagcagcagacgacgacgactgcggatgcagccaccaacactgacgcaaccggagcggcgactgtgacaacggacgcggcgaccactgcgactactccaccgacaacgacgaccgcggacggagcgacggtgaccaacgccaacgaacccggtgcgactacggcgaccaacactgaggcgcccgctgcgactactccagcgacaacgacgaacgcggatggagcgacggtgaccaacgccaacgaacccggtgcgactactccaccgacaacgacgaccgcggacggagcgacggtgaccaacgccaacgaacccggtgcgactacggcgaccaacactgaggcgcccgctgcgactactccagcgacaacgacgaacgcggatggagcgacggtgaccaacgctaacgaacccggtgcgactacgacgacaacgacggcgattgcggatggcgcggtggcgactaacactgacgcaaccggagcggcgactactccgacgacgaatgcggcgaccaatactgaggcgcccgctgcgactactccagcgacaaccgcggatgtggctttggattag

SEQ ID NO: 61651 - DNA, 259 bp, Heterodera glycines
  Genomic contig location: Contig_ID=SeqID_31283; Location=266..524; Strand=+
  SCN-specific regions: Sequence locations=1-27,55-259
gcagatttgtacgccgattatgaaggagatggtgatgatgataatgaggaggacgagcagtactacatgcatctgatcgcgcacaaagactcgttggaatttggctcaattatggtggtgccgccaaccgagccattaacaacagcagatggcaattgggtgcccaacgaaggcaatgttagccgtctcagcagtcaaatgagttttagcgccgatggcttaatgacaccgcttggcacgttggacacgcaagagaccg

SEQ ID NO: 61652 - DNA, 569 bp, Heterodera glycines
  Genomic contig location: Contig_ID=SeqID_31284; Location=925..1493; Strand=-
  SCN-specific regions: Sequence locations=1-542
atgattagaagaggtactatagtgataaaaagaggtacaacagagattaagaaaggtaaaacagtgattagaagagatacaacagtgattagaagaggtacaacagtgattagaagaggtacaacagagatcagaagaggtacaaatttgatgaagaggtataactgtgattagaagaggtacaatagtgattagaagaggtacaacagagatcagaagaggtacaacagtgattagaagaggtgcaacagtgattagaagagtgatcagaagaggtacaacagtgattagaagaggtgcaacttgattaagaaaggtaaaacagtgattagaagagatacaacagtgattagaagaggtacaacagagattaagaaaggtaaaacagtgattagaagagatacaacagtgattagaagaggtacaacagtgattagaagaggtacaacagagatcagaagaggtacaactgtgatcagaagaggtacaaaattgttagaagaggtacaaaagtgattagaagaggtacaaaaattgaatgcaatttattataaattttaaaaaataaa

SEQ ID NO: 61653 - DNA, 820 bp, Heterodera glycines
  Genomic contig location: Contig_ID=SeqID_31284; Location=1002..1821; Strand=+
  SCN-specific regions: Sequence locations=1-820
  Gene Ontology: Mol. function=cell adhesion receptor activity; Cellular component=cell wall (sensu Fungi); Biological process =agglutination during conjugation with cellular fusion
ttttgtacctcttctgatcacagttgtacctcttctgatctctgttgtacctcttctaatcactgttgtacctcttctaatcactgttgtatctcttctaatcactgttttacctttcttaatctctgttgtacctcttctaatcactgttgtatctcttctaatcactgttttacctttcttaatcaagttgcacctcttctaatcactgttgtacctcttctgatcactcttctaatcactgttgcacctcttctaatcactgttgtacctcttctgatctctgttgtacctcttctaatcactattgtacctcttctaatcacagttatacctcttcatcaaatttgtacctcttctgatctctgttgtacctcttctaatcactgttgtacctcttctaatcactgttgtatctcttctaatcactgttttacctttcttaatctctgttgtacctctttttatcactatagtacctcttctaatcattgttgtaccacttctaatcactgttgtacctcttccaatcacagttgtacctattctgatctctggtgtacctcttctaatcactgttgtacctcttctgatctctgttgtacctcttctaatcactattgtacctcttctaatcacagttatacctcttctatcactgttgtacctcttccaatcacagttgtacctattctgatctctggtgtacctcttctaatcactgttgtacctcttctgatctctgttgtacctcttctaatcactattgtacctcttctaatcacagttatacctcttctatcactgttgtacctcttct

SEQ ID NO: 61654 - DNA, 1112 bp, Heterodera glycines
  Genomic contig location: Contig_ID=SeqID_31285; Location=1..1112; Strand=-
  SCN-specific regions: Sequence locations=1-13,35-131,233-254,276 -392,423-494,516-652,674-1069
  Gene Ontology: Mol. function=DNA ligase activity; Cellular component =nucleus; Biological process=DNA replication
agtacgaatcaattgcaaaggtttgatacagaaaattcacattttttgatccccatggttttcatctccgttttactgtgattaagctgtaaatgttgccttaacttcttgggtatggtttctttatttgctattatttttaaaatttttctcttaaaaaatacattttctttcatattttgaaaatttaaatacaattaaaacaaacattttttattttattttattttttggtcatggtttttggcctataattttggcagcattttgcaaaggttccgaatttttttttcaaaatggtttgacgcctgtgataccatctgacccagttctttcttattgttagaatcttataatgaaatcaaaatttgatagtttggacgaaatctattaaaaactaacaaaattataaaattccaaaattacaatatataaattcgaagtatccccgtacgggatctccgcttcgcgaatccttctttccgcgggtcctcggttttcccgttccccggtttgagcggggatcctccggtcgcaaccaactctaatatttgttcagattggcactgggttcaaagacgaagacttgaaaagtcagtttaaagaattccaagagcttcggattgacaaggtctttgtttccctttccactctctttttccaattctgtttacacttttagccccgttcgtacttcgccttcgacccttcgttggcgcccgaccattggtttgaaccgtcggtggtgtgggaagtgaaggcggccgacatgtccatttcgccacgtcatttggctgcgcggggattggtcgacgctgagaagggtcattcttcgtcatttccagacacaaaaaactcgtttttaggcatttcacttcgctttccgcgtttcattcgaaaccgaggtaaaaaaaagaaggatggacgagggaaacgattaaaggagccacttacttttatattttggtaatttagcggacaaaaaacccgaaaatgcaacatcatcagaacaaattgcagagatgtaccgaaatcaggaccacattaagaaccaaaaggacggaaaagtggattttgatgaagaggaagagggggaggagaaaaaggaagaa

SEQ ID NO: 61655 - DNA, 330 bp, Heterodera glycines
  Genomic contig location: Contig_ID=SeqID_31289; Location=447..776; Strand=-
  SCN-specific regions: Sequence locations=1-309
atgcaaggcgaagcggaggaggggaaattggtggaaggtttggagaaattggggggcggaagggattctgtgggcatcatcatcaaatgatgatgatcatcatcccgagattgggtcgcaaaatgagacaatgttcgctgatgagatttgtttgtttgaagacacaaatgacagacgacgggggaaaaacagcggacacagccgaaagaaggcggtggaacaaatacagcaatgccaacgaggacgacaagcagttcagcggaagaaaacggagacgggaacgggaacaacaggacaaggatttgtacatttaattggacaattaataaa

SEQ ID NO: 61656 - DNA, 384 bp, Heterodera glycines
  Genomic contig location: Contig_ID=SeqID_31290; Location=26..409; Strand=-
  SCN-specific regions: Sequence locations=1-5,27-87,109-333,355-384
atgggatttcatttatttgttagagtgaggaaccaatcactttttcgtcaaccgttcggcccatttgcttattcggcattggcattggttggtgtgtttgtgcttttggattggcttttatataatagttgtcctttttttgttttaaaaattctttttcaaggatcttcaaactcaaaactctcattttccaacaaatttactgacggtacaaaaaacatgctgaattcacaaccatttgttgtcgccggatggggcatcacaaaaccatggtgttcaagtggaatacacagtgcaactgaccaactcatgtacggtacaatgcgtatgatttccatggaagaatgtgttggcgacaaatctgaatccggtagggtttactga

SEQ ID NO: 61657 - DNA, 312 bp, Heterodera glycines
  Genomic contig location: Contig_ID=SeqID_31291; Location=280..591; Strand=+
  SCN-specific regions: Sequence locations=1-115,244-312
atgttcaatcgcttttctccaatcgccgcccgaaagagaaattcgaatggaacgaacattcttcagggaaggcctggcaacaagcagaaaatagtcatggagaggagccgaattcggtgggggaaaagaggaaaaaagggaaaaagcatcggaggaaaaattggagggggaaaaggaggaattgaaaagggaggaaaaggaggaaaggggggaaaaggagtggaggaaacggacacggaggagcgaattgggcaacggaacggaagacaaattggcggacaattggatgacgaaaaacagacgaaagcctaa

SEQ ID NO: 61658 - DNA, 310 bp, Heterodera glycines
  Genomic contig location: Contig_ID=SeqID_6456; Location=45..354; Strand=-
  SCN-specific regions: Sequence locations=1-310
atgtcggtgatgccatttgtggcattgctgcttctagcggcggatttgcctcctgatccattcttgctaacactgggacgggccataggtgcgttcattggtggtccggacaatccgtcagtggtgcatccttcagtggtcaatccgtcagtggacaatccgtcagtgaaggacaatccgtcagtggacaatccgtcagtgaaggacaatccgtcagtaatggacaatccgtcagtggacaattcgtcagcaaatttttttttgagcaatgatcaaaaatcttgcgaaaatgattgttaaatgtaataaa

SEQ ID NO: 61659 - DNA, 1571 bp, Heterodera glycines
  Genomic contig location: Contig_ID=SeqID_6457; Location=1272..2842; Strand=+
  SCN-specific regions: Sequence locations=1-182,205-369,392-424,457 -658,680-683,706-831,873-1058,1080-1144,1187-1329,1402-1571
atgaatttgcccaaaaatttggcacaattggggccagtgagggtggcacgggttgcgcaaggttcatcatcggtggagcaaccgcgccagtcggcatcgcggcacctaacgacggcgcacaaagtgccgtcggcggtgagcacattggcattggcattggctgaacttagtgaggaaaattgaaaaaataattacatgaataaagtaatcagtaggaatgggaattttaggcgcaaaaattcgcaaaatagacattaaataggcacaaaaataggcaaataaattatttttcttagcactttttaggtagcaaaacatgtaaaaaaacataatcaaaaaatttaatctttgttatatcgcaattgtaactaaattataaaatattttaaaagattttctgtcgaataaggaaaatttagaaaacaaaaatttttattaagaaaaaaaatattttaagggattagtttttggaaatttttcaatttcttacgggctctatttttcgtttattgcatttttgttaaggatttattcgaaaatcctttaaacaggcacattaagcacaaaaaccccgaaaaggtaaaaatcggcattataaaagtcatcgtaaacccccaaatccaagcggaaaatgcgtttttcgtgcgaaggtcggaaatttgaaatttttgaaaaaattttcgaaattttaaaatattttaatatgctaaatttagataatataacttttgcaaatagataacaatttttcaaattatttattaccggaagtgacggcataactgctgccgggaggccaccaatcggtgtgccaaatgcgcctgcgggtcgaaattttatagaaattttaaataattttttttataatatttcaccctgaaaaccagcaaccggcatgttcagacagggcatgcccgggtaaatgcctcggcttaacaacaaaccgcacggtgcgggtgcaaacagaatgccaaatgcgaaattcaaatgccaaatgagaagcaataaatgggaaagtggcatttcgataattttatattgtttaattatggtctcgatttaattaaaacaccatttatctgcccattatatcatctaaattttgtacgaataataatttcttaattcatgtgttaaatttgtcaattttaattgaaaaaaataaattttattaattaataataatcaatttgtagtttattttgcgaataatttattgcccattatcaaaaaaaccgtagttttgaattaatttattccatttattttcagtgaattttttgatgcatttaattttattaaagattccatataattcaaattggaaggaaaattattattttttaaatttaaatatttttatcattattcttttttgtaaatataatttatatttttaaactcttaagcgagcaaatcatttgctaattttcattaattgatgctgttcaattagcggtgaatcattagacaataatgaagcgacgctaattggcgataatgatgcttcaggattcacatattcaaacaattttcaatgtccattcattttttcatttgaatacaaacaa

SEQ ID NO: 61660 - DNA, 660 bp, Heterodera glycines
  Genomic contig location: Contig_ID=SeqID_31293; Location=1102..1761; Strand=-
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 61661 - DNA, 1340 bp, Heterodera glycines
  Genomic contig location: Contig_ID=SeqID_31297; Location=118..1457; Strand=-
  SCN-specific regions: Sequence locations=1-541,563-1340
atgagagcaatgagagatgccaatatcggaattgaccctcaattgctgagaactgcgtatgaagtgattaaaaatgtgaatccttttgctgaagcctatatgatgatgaaagaagaagaagatgaagaagttgagagagctagaaatgagaacagagagccagccgagatcaagcttttgtttgagaccggaaggcaattggacagacgtttggagtacaatgtacctcgagcgaatgaagttgctgcagtttatgtacctggggctgacggtgaagtacctaatgccaagattgtggtgagagaacgtggaaaggaattgaagattttgaagggcacagattcaatggtaactccaatgacttacccgctgttttatccgcgtggtacgcttggttggcaccctgaaatgaagcatagaaatagtaacagaagagtaacgagattgcaatatgtgtgctacacattagcaattagagagagagagtttaatccgattttgttcggtggaaagctctttcaacagtattgtgttgatgaatatgtaaagattgaaggagatagaatgaattggataaagaacaaccaaaagaagattttggcagatgcatataagaatgttgataacatgttgatgaaacgagctcaagaaagaggtttgccgctgggaaggaaggtcattcttcctccaagtgtgacaaatagtccgagatatgtagagaagtattttcaggatgctatggccgttgttcgacggtttggtaagcctgacatgtttttgacaatgacatgtaacccgcaatgggcagagatttcagagaatttgtttcatgaacagacatcaattgatagacctgatttggttgtcagagtttttaacttaaaagttaaagctattatgaatgagattgctaagaaaaagatttttggtgaagtgattgcatggatgtatccggtagagaaccaaggaaggggactaccgcacattcatttgcttttgacattgacagaacaagataaaatgataaatggcgaagatgttgagaagaaaggaattagtgcgagaatacctgataaagaattagtgcctgatttgtttgaattggttaaaagatttatgatccatggtccatgtggtgatttgaacccaaattgtccatgcatggaagaatttgttgacaagaatggaatgagagggaggaaatgctccaagggatatcctaaagcatttcaagaagagacaattgttcttgaaaatggtttggcattgtacgcaagaccaaatgatggaagaactgttgaagtatttgcaaatggaagaagacatgcattagacaacag

SEQ ID NO: 61662 - DNA, 373 bp, Heterodera glycines
  Genomic contig location: Contig_ID=SeqID_31299; Location=561..933; Strand=+
  SCN-specific regions: Sequence locations=1-129,193-336,366-373
atgggaaacattcgaagaaggaatggaaagaatttgatgcaaaaattaaacaaatgtttggtgttaattattggacaattgaaagatgggtaaaaaaattaaaaatcaatcaaaatgtttcaaagggtgaaatttttaaacaaattgttatttattaattaaatttaaaaatttttattatttaatatattacagggcagaagcattatacatttgcgaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattga

SEQ ID NO: 61663 - DNA, 302 bp, Heterodera glycines
  Genomic contig location: Contig_ID=SeqID_31301; Location=793..1094; Strand=-
  SCN-specific regions: Sequence locations=1-219,241-302
atggatgaagaaataaagggacggaaaatttcgaaagaattggaaaattaccatgaacttttgttgcgtttatttaagatcaaattcaaacaattgataaatcaaaatgacaaatttgtggaggaaatgttgactaaagagtgggtcattgaattggtgggaaaatatttgcccaaattgacaatgtgaccatttgggtgagaatttcggactgctttttgttttgaatacataataccatttctcatttgcagctttgtcgtcaattcaaaaagagaagcattaagaaaaatgactgttag

SEQ ID NO: 61664 - DNA, 669 bp, Heterodera glycines
  Genomic contig location: Contig_ID=SeqID_6458; Location=149..817; Strand=+
  SCN-specific regions: Sequence locations=1-119,193-209,306-324,358 -375,398-435,458-542,566-669
atgaatggggcaattagcaaatgccattcaacaagtgcgcacatttaaatgaactggaaaaaagtaatggcgtaagaaaggaagctgcaaaagaaagagcaaattgttatttgaaaatgataattttttattattattcaattatttaaaaaacaaaaaatatttaattattcataaaaattattttattatcttatttcgactaaagttttcattttatttaactgttaaatttatttatgaaaatttattttttaaatttatatttaatttatttaataaataaaattattaattcaaattaaaaattagaaagaaatttccttaaataaaattatttagttataatataaaaatgcatatgatttttcagtctccattaaacaattttttaaattggattttatggcaaaatgctaatttcaggcgtccacctaaaaaatatatgtgtaaaaaatgcagcaaaaaaaaaaaaacaaaaaaatgctgtttgtgacagctgacttaattaagaatgtctgctaaattcagattattcgtgcttttataaatataaacatttttcaaaaatacgattaacaattttcgaaatttgaagaatttttattagaatgatttctgacgaggaaaaagctcgtcttaaatttatgcatgttaattgaaatgata

SEQ ID NO: 61665 - DNA, 294 bp, Heterodera glycines
  Genomic contig location: Contig_ID=SeqID_6459; Location=534..827; Strand=-
  SCN-specific regions: Sequence locations=1-294
atgcctaagagaaagttattaagcaaaattaatgcacgaaattcaacgcaaaagcgtgaacaaaaacgggaggagagacgcgagaagacggagagggcgagacaagcccgatgggccaagaaaagtgagtttttccattcatttttcataaaatcctaagtttccaaatttttagccgctccccagccgaacactgatgcagaaacgccacaaccatccgaagaagagccgtcacatcagaggcaccggcgcgggacaacgacggacgaccaccatcaactccaacaccgatga

SEQ ID NO: 61666 - DNA, 1212 bp, Heterodera glycines
  Genomic contig location: Contig_ID=SeqID_6460; Location=150..1361; Strand=-
  SCN-specific regions: Sequence locations=1-28,51-286,308-314,408 -425,564-659,692-700,750-761,783-860,883-916,938-941,964-1212
atgtttgagcaacgctttccgaacatgaccttggacattcccgtggattactccgttaaccatgcgccacgcgtgaacctgcaaatggtcacgccgggcggtgttgtgccggacattgtgtcgttgcaaacattgcaagaatttgcgcgatggaaacggctcggaaaattgttggcatacaaaccgcgcggatgggacaaagtgtaccgcgcattccgcgacccggatggctacttcaccggattatacgtatgtgtgctgtaaagttgtcctaaaaatcgttttgaaaaaataatttccttaattttcaaacgttaaaatttcattttaataaaaaattaaaaaaaagtaaaaatttattttgtgaaataacagtttttaaaaaagtcaaatattttattaaaaaacagcctgagaacatcacctttttaaaatatattctaaatttaaaattattttttctgaaaaatattgtaaaataaaatttttaaaaatattatttttaataatctaaaattttttgtaaaagccaattaaaactttttaaaaaaactattaattttgctttttttaacaaactttttgtgaaaaataattattagggttgtaaattaagatattatattttctgatttctaagtgctctgaataggtgtttgtgaatggttcttttatttacatatttttaaatatttcccactttttaacatattttttaaataaaaaattcaaaaaatatttttttaaatgtcaccttgttatcaaaaattaaattaaagtattaaaacattattctaggcctaataagttcatttttatggcattttggtcttattcattcttttcaaagattttttgtgaaaaaaatattataaaaaatttgtattttgagatttctttttcatacaattccagctttaataattataattaaaaaggaataattaattcaaattcatttgaaggtgatgacactaggcattagtatcaacaaaaatttggtctcaaattcgaccaatccgccgacctacggtgatttattgcagtcagcagaattcgctaatggcactgttggtactgctgacccaaaccatgatgacgcagttttgttcatttacaaacaggtaggaggagcatcggtcgttaaattcgcctattaacaaattaccctaaatggaaattaccctaaatggcttaaaaccctaaattaaa

SEQ ID NO: 61667 - DNA, 1228 bp, Heterodera glycines
  Genomic contig location: Contig_ID=SeqID_6461; Location=183..1410; Strand=-
  SCN-specific regions: Sequence locations=1-168,190-254,276-567,716 -886,908-1228
atgaaatcattttccatcgtctgctttttactgataacaacattattatgtggtcaatttgctgcggctcacctcggcttttttgacgatttttttgattccgacgaaaattttgattttgacgaattattcaaaagcaaattgcattatgccattggccaacgggacaagaagcagcaacagaagaagccgcataaacatggcaatgttgatgtggagaacagaagcttggaccaattgtacgcggcggcgttggccgagggtggcaaattggtggtgtacgccggcggtgaagcaccacgccaacaagtgatccaatggcgagaactttttccgagactcatgctgaaactgagtccgagattagtgacataattagggatgtcaattttatgtaaatacattttttttcctggcttctccatgttctaaattagggttgcgtccccgacgtcggggttggaaaattcggggttcggggttgtcggggttggaagcgtcggggtcggggttgccaaatcgttcggggttcggggtttttcaatttttatcttatgcctaatagtcaaaatttttttaatattttttcggaaataatatttattaatttccataataatatttgtattgtttttatatttttttatttcttttttatcagaaattttgtatagaattaattttttttttcttgaaattttaaaattttttattacttttttgttttccaaaacatcttttttcacgtcgctcttttctaaagacttaaggagaaagggtacggcgtccggcggtgccgataggcgccgccgggaaaattttgaaaatttggttagatctgttagcagattttgtccaaaatatgctaaatttttgcgattttgcgccaattttttaataaggtttatgactttttgggccctgtgatgccgataggcagcgctaaattttggaattaagctctattttctaagatttttcaccaaaaaaatttatgaatttcggaaatttttgtttttcttcgatatgtattttgtcaaaatatgccaagattggtcgatttctatgagtatttaatttaaaaaaaacaatttgtcacaaagaaaataattaaagaagaaaacgtcaaacggtatcgaactcacgacagaaagtaatgtcaatggcactaacctctacaccacattccaaatgtccgaaattgagcaaatcttctttatttaataaa

SEQ ID NO: 61668 - DNA, 304 bp, Heterodera glycines; identical to SEQ ID NO: 51570
  Genomic contig location: Contig_ID=SeqID_31303; Location=309..612; Strand=+
  SCN-specific regions: Sequence locations=1-304

SEQ ID NO: 61669 - DNA, 303 bp, Heterodera glycines
  misc_feature (211)..(211): n is a, c, g, or t
  Genomic contig location: Contig_ID=SeqID_31303; Location=815..1117; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagacatttttctgggatagagtctaaatataaaaatcctctgtgaaataaaatggcgattgtgcacagccctccgtctcatacgcaagcgcttttgtgaggtataaaatttctcnaaaaaagagatagacatttttctgggatagagtataatttaaaaattccctcaaaaataaaaggtctattgcgcaccgccctccctatcatg

SEQ ID NO: 61670 - DNA, 150 bp, Heterodera glycines
  Genomic contig location: Contig_ID=SeqID_31305; Location=318..467; Strand=-
  SCN-specific regions: Sequence locations=1-150
cttttggccaaattggacgaggaaaggcgcgaaaaagcgatggaaatggtgggcgaacagcagcatacagacgcggaatttgagcagaaattcgttgaatttgcgaagggattcaaaagggacgaacaaaaggtggacaaaaagaaataa

SEQ ID NO: 61671 - DNA, 59 bp, Heterodera glycines
  Genomic contig location: Contig_ID=SeqID_31308; Location=167..225; Strand=-
  SCN-specific regions: Sequence locations=1-59
aacattttccttctctagtctggctctaacaaacactcacacgatatttgaaatgctaa

SEQ ID NO: 61672 - DNA, 59 bp, Heterodera glycines; identical to SEQ ID NO: 52421
  Genomic contig location: Contig_ID=SeqID_31308; Location=297..355; Strand=-
  SCN-specific regions: Sequence locations=1-59

SEQ ID NO: 61673 - DNA, 59 bp, Heterodera glycines; identical to SEQ ID NO: 52422
  Genomic contig location: Contig_ID=SeqID_31308; Location=427..485; Strand=-
  SCN-specific regions: Sequence locations=1-59

SEQ ID NO: 61674 - DNA, 59 bp, Heterodera glycines; identical to SEQ ID NO: 52421
  Genomic contig location: Contig_ID=SeqID_31308; Location=557..615; Strand=-
  SCN-specific regions: Sequence locations=1-59

SEQ ID NO: 61675 - DNA, 59 bp, Heterodera glycines; identical to SEQ ID NO: 52421
  Genomic contig location: Contig_ID=SeqID_31308; Location=687..745; Strand=-
  SCN-specific regions: Sequence locations=1-59

SEQ ID NO: 61676 - DNA, 58 bp, Heterodera glycines
  Genomic contig location: Contig_ID=SeqID_31308; Location=945..1002; Strand=-
  SCN-specific regions: Sequence locations=1-58
aacattttccttctctagtctggctctaccaaacactcacacgatatttgaatgctaa

SEQ ID NO: 61677 - DNA, 172 bp, Heterodera glycines
  Genomic contig location: Contig_ID=SeqID_31309; Location=1097..1268; Strand=+
  SCN-specific regions: Sequence locations=1-172
atggggaagggccgaactaccggtaatagcggaggaggcaaaggcggaagcggtggaggcggagacgaaaaaagcggcggaagcggagcggggaaaggaacggtggctgccggaagcggaggtgtacgcggaaagggtgccggacagagcggaccagcagcagcagcagcag

SEQ ID NO: 61678 - DNA, 1216 bp, Heterodera glycines
  Genomic contig location: Contig_ID=SeqID_31310; Location=22..1237; Strand=-
  SCN-specific regions: Sequence locations=1-690,715-715,737-870,1021 -1060,1082-1216
ttattggcaaaacgattgaccgagttgaagatggacttgaaaactgtcgcggccattgcctccgttgatgaacacaaaaaacatctccaaaaactttcatccaatttgaagagagagaaaaacggactgaagcgtttccatcgggaattggccgacgaaattgaggccgaaattgcactgcgcacaaattacgcacaaacggcggaacatttggccaaattggacgccgaagtgcgctcagccgccgcggaagggcgcgtgccgcaaacggaggcgatgctgcggaggattgagctgcaaatggaaatgctgaagaagcagtgcagggccacccgaaagttcgtggagatgagcgtggacggtgccgcgtcgacgagcccaactcggagacggaggatcatcttcaaactgagcagcaccgtcaccacaatcattcaggcgggtcgaaacagaaattaccaagcattaggggagatgaagcatctgctgagctgttgttgcttttcaaaatgccaaggtttatttgagcaaatcctttcaggtcattgaaagtaaattgcgacaaggggaggaggaggcgaagaaagggggaagcggaagggaaaccatgtcggaatcggaggcggaagagcttaccaaactgcaccaaaagctaacggcactgaaacgggaaactgaggagacggaaatggaagaaaaggcggaggaaagggccaaaaaacaaatggaggaaaagcggacagaaacacacaccgaacttgagcatggaaaacagcaaagcgacgaaagaggcaattccaatttaagaggctttaatcagacagttgctatgacgaagaacgaaaaagtgaaagtgatcaaattaaaagcaaaaataattatttcaaaaattaaaagcaaaataattattgattattataaagtttaattaagttacgaatatttaaataatatttttttaaagtaaataaaacaattattttgtttttatttataaaattaattattttgatttaatttgatcgcttgcactttttcacattttgtctcagcacgaatctgacagactgcttgaattaaattcaaagacctgctctttatctagtttttttgccatgttcagaagagcaagaagatcagtccgactttttggtgcaagcggaacaaatggtcgaaaagtcggagatggtccgcctgaaaaaggaggaactgatcg

SEQ ID NO: 61679 - DNA, 929 bp, Heterodera glycines
  Genomic contig location: Contig_ID=SeqID_31311; Location=1..929; Strand=+
  SCN-specific regions: Sequence locations=1-110,132-203,225-663,700-929
attacgtccttgcgttgattttcggccattaaacaatatcacgattcccgacccatatccaataccgagaatggataagacaattttacgggtcgctggtcaaacattttattcaaccttggatttggcctccggattttggcagattccattggattccgaaagttcttataaatgtggcattgttaccccttggggactttatcaaatggtaaaattgccattcggactgagaaatgcgccaagcatttttcagaggaccatggacaaagctttggagggtattcggaatgtaaccgtatacattgatgacattttggtccatacaaatacggaagaggagcatttggagactttggaaaaagtattttgccgattgaatgaattcggattaaaattaaaaagagagaaatgcgaatttttgaaaaatgaatgcacatatttgggccatattttaaatgggaaaggctatcggccctcattgaataatcaggaagtgattgaaggattcccagagccggaaaatgccagggaagtaaaaagatttttgggtatgatgtcttttttccgtaaatttatccaaaattttgcggaaattgcaaatccgttacaacagttaacgaggggaaaaatccctgaatttgtatgggaaatcgcgaaaaagaggcatttgggaaattaaaaaataatttactgaatgccaatgcctaagggctccgaattacgaattgcctttttatcttttcaccaatgcgtctgctattgcctatgcgggagcgcttatgcagagccaaaatggcaatgatttatactctgtcggttattggtcccgaactttgtctacgacagaatcaaaacttcagcccacacacggggaattagcggcaatagtacatgccgtagaaaatttcagaccaattatttagtgg

SEQ ID NO: 61680 - DNA, 1008 bp, Heterodera glycines
  Genomic contig location: Contig_ID=SeqID_6462; Location=3668..4675; Strand=-
  SCN-specific regions: Sequence locations=1-505,546-667,689-798,824 -1008
gaaataaaaatcggtgattcgctggcactgtcgggaaaaaatttaatatttggaaaagaaatcgcacgagtcgcttcgcgaaatcgagactgcgtgcaattggcactttgcttcaggcaacactcgtcgatgcctccgttggaacgcctccgcctgttgcaggcgcagcaacagatgccgcacgagttggtgttggaccgctttccgccccaactcgtccaaagtgttcatcagctggcggacacggtagagcgtcggtacgaccgcagcgccaactcgcgcggcttcagtccgttcccggtgttcggcccgttcatcaccgacagcataagcggaggcagcggtgcgacgatggcaccgcagccgcggcagaaaagtgtgcctccacaggcgacgtacgacggcacaaagccctgggcaatggcaccgccgaaggaggaaatgtcagtgtccatgacgacgtcgcagcacagagtcagttcacaaggggaaagttggggaggactaattaaataatttattttcaattaataaaattttaattaccctaattacccctaatcttttcgcacatttcaaatatccttaattacccctatcttttttttcggcttttagatgcccatttttgacaaattgccaaaacaacaacaagaacagtccacccattttctgcccccaccaatgacatcaagcagtggagatgaatggcaatcggcgtatgaatgtttgccgcaatggacaaagcaaatgccaaagatgccgccagaaacggcaccaaagccacaacaagatttggtaaaaaatattgctgtttaaatttcaaaagtgatactttttagtcctcctctttcccatcgttttgtgccgcgccttttgccgagtccgtccaatgctccgtcaatctgtgcaaattccacgcatattcacgacaattggccgcaaaaagcatatggccaatgagtgattcacaagcggaaatgttccaaagtgttgtgagcgttgagg

SEQ ID NO: 61681 - DNA, 1021 bp, Heterodera glycines
  Genomic contig location: Contig_ID=SeqID_6462; Location=5835..6855; Strand=+
  SCN-specific regions: Sequence locations=1-245,268-349,372-487,549 -636,676-697,734-889,941-958,980-983,1006-1021
atgtattacatccaagtcacaacaattagtgatgcttcaaagtgtatgctgacatttgcgctgggggcatttgcgcctatgtccaaaatcggatttaaatttgagtttttttcaatccgagaggtaaagaaaatactaaagttaaaaaagatggtcttctagtttattaggagcattaattctgctgtttgaatttaattgataatgattttttcaaaaattgacatgaaaagaataattatataatttgcttaatatgtgtataattatattttcttgcaaaatatttcgtaaaaacaatactttcacactgctcgctaacctttcaaaatatgataattaaattagtaaacaaaaataacatttaaaaagttggaaccatctaattgttctcccaaaaacacatagcttaactttttgaagaaatattctcggttggctaatattctctaattaaaaaatcactctttttgcatttattattagctataattttttaattcttttaattcttttaattttacttaatttattaattttgtattttacatgtttcttttgcatgtcacatacaatttaagacgaagaagcgaaaatggccatttttgtgaaatgccaacaaaaattaaattggacaaatttaaactaattaatattattttaaaatgaatttatctgacaatctttcggcaagtcgaaaattaaattaaataataattttaaaaattaaattgtctgtttttagttctatgattctttcaaagatgctgatttccccgccagttttatcgcaatttgcgctgcccgagctctgatttcattttttggagtgattttgaatgggatattgcttttcgtcactcttcggagcaagtgaaactttgattggatatttaaatatttatttattatttttaaaagaaactttatttatttaaaaggacaaattaacttcttgttttaatattttataatttttgcaaaaaattactgatcatcaaattatcagacacaacactta

SEQ ID NO: 61682 - DNA, 571 bp, Heterodera glycines
  misc_feature (22)..(22): n is a, c, g, or t
  Genomic contig location: Contig_ID=SeqID_6463; Location=51..621; Strand=+
  SCN-specific regions: Sequence locations=1-215,237-251,273-452,474-571
atgtttttaaaacaatataatntagaccaaattgactacactaagcgcattttcaaggcattgctggtcaatgtgctttttgtgtccaccggttactttctgaacgccggctttttaattttactccgaaaactttcgctgagccaagtccaaattgtgtttggcacttacatcctcggcattttcacctgcatttcggcaattagcaacccattaacactttatctcttcaggtggtgggcaattcgaccttttaatttgcagaaacaattgaaattcagttcggattatcgaactgcgttcaacaaacatctttttggacgataagcattcattttatacgagagattctgatgcgatttgtggtggaaatgtcatggcgaaacgacaaattgaccagcgaaatggcagagttggaaatgttcggttggcatgaacaaaataagaaaaaacctcattttttaaaacattttcaaccatttttttgtgaatttgttaattcttgacagaagagattactgaaaaagcaaagaaaatgtgaaattctgaattcacaattattaccaaaaga

SEQ ID NO: 61683 - DNA, 671 bp, Heterodera glycines
  Genomic contig location: Contig_ID=SeqID_31313; Location=523..1193; Strand=+
  SCN-specific regions: Sequence locations=1-95,128-237,259-368,406-671
atgagtcgaaaaattagcaaaaaaattgctgaaaaaattggtacaaatatgcactcaatatgggattggaagaaaaaattccaattaaacaatcgtaatattttaataattaaatttatttttatatgaaattgcttttttaaggaaagaccaaaacttacacggatgctgagaaattggaatatgtgaaaaaatgtgaggaaatgatgaaaagaaacccaatgatgagtgagacgaaaattgctgaagaattggaaatccctaggcaaaacttaagacgatggaaaaagaaatttggaaccaatgaaataaattgaattatttttgtggatctaacaaaattggatattgagaattgggcactacagaatatattaaaaaaaaaagaattttcaaaaatattttcgtaggaatttcatcaaaaattagataactatcatcatttcgcattgataaagacgtatgtatcaacacattcattaatattttttagttcaattataacggcctttttttggaaaacttagcaaattaatttccgtaaaaaaatgttttaagcatttttttcgaattttaattccacttagctctcgtaaaatcagaaaaatggaaccaaaatgacaaaaataagcaaaaaatggaccttttcatgttacgtcattctaaaaaaa

SEQ ID NO: 61684 - DNA, 679 bp, Heterodera glycines
  Genomic contig location: Contig_ID=SeqID_31314; Location=727..1405; Strand=+
  SCN-specific regions: Sequence locations=1-370,392-495,517-679
  Gene Ontology: Mol. function=choline kinase activity; Cellular component=cytosol; Biological process=phosphatidylcholine biosynthesis
atgcccagtggttctcgtgatttcgatttgccggctgaaagtcacgaatgggctcctccgagcataaattgcgaagatttacagaaagaaattgagcacctgaggtgtatttcattgagctattccataattccctttttaaggagattgattgtaaagagtcggagtctggttactttctgtcataatgatcttcaagaagggaacattctcttgcccaaagcacattctggcaatatccgaatcggctccgaatcggacgaaattttatctggcattgacgggaatatgacgaacaattcactgaccgccttcaacccgatggatccccgtctcgtgctcattgacttcgaatacgcgagttacaattacaggtgagtgcttttgtcattcacccacgatcgtgtaaacaaaaacggaaaagaaaaatcagcttaaaaaggaagaatttgccttcttaagtaacagtattgtttattgtaggggattcgattttgccaaccattttgtggaatacagcatcaattatgacaacgatgagccacctttttacgaaatgctcccagagaagtttccttcggaaggacaaatgcttgagttcatgtacaattacgagaaggaacttcgccctaatgccagtgaggaacatttgtgggaaattgcacggtcgatggtcgaa

SEQ ID NO: 61685 - DNA, 102 bp, Heterodera glycines; identical to SEQ ID NO: 51993
  Genomic contig location: Contig_ID=SeqID_31315; Location=49..150; Strand=+
  SCN-specific regions: Sequence locations=1-102

SEQ ID NO: 61686 - DNA, 73 bp, Heterodera glycines; identical to SEQ ID NO: 56411
  Genomic contig location: Contig_ID=SeqID_31316; Location=1187..1259; Strand=+
  SCN-specific regions: Sequence locations=1-73

SEQ ID NO: 61687 - DNA, 592 bp, Heterodera glycines
  Genomic contig location: Contig_ID=SeqID_31317; Location=5..596; Strand=-
  SCN-specific regions: Sequence locations=1-314,346-534,578-592
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaataattaattcttaaatattttttcagaaagggttctga

SEQ ID NO: 61688 - DNA, 194 bp, Heterodera glycines
  Genomic contig location: Contig_ID=SeqID_31319; Location=380..573; Strand=-
  SCN-specific regions: Sequence locations=1-194
atgtccgcttcgttagcccgtcaattggtcgaacttcagacgaaccccaccgatggattcgctgtccgtggcctcgttgacgataatgtaggcactttcttttttaatcaaatttttgccttcattcaatctctccccctttttcagatcttcaaatggcaagtgatcatttttggtccgtccgaatcgccctt

SEQ ID NO: 61689 - DNA, 409 bp, Heterodera glycines
  Genomic contig location: Contig_ID=SeqID_31320; Location=404..812; Strand=+
  SCN-specific regions: Sequence locations=1-409
ctcccctcccccttcagatacctttgcattcgttaccccttaaactctcgccaaatctgttcaattcgtaatgtgcgcattgccactgtctgcatcacttgcatttccatcatttgtggccttcccaaatgtgttgactaccatttcgccgtttacgaaggccttttgtacgttgactcgggcgaatgggtccctctgaggtcagtcggtcccccccccccccccttaaaaggctccgtccccttttaagaagctgtctgtccggcttcactttcttcgtccaattggtcggccaaaatgcctttttcaatgcttacttttggactcgcgttgtcgccttcattctcctcccgtcccttctactcatttgccttaacgccctcctcatccaattggtcaattaaattac

SEQ ID NO: 61690 - DNA, 2306 bp, Heterodera glycines
  Genomic contig location: Contig_ID=SeqID_805; Location=1833..4138; Strand=-
  SCN-specific regions: Sequence locations=1-277,300-865,887-1370,1393 -1572,1594-2306
  Gene Ontology: Mol. function=ATP dependent DNA helicase activity; Cellular component=nuclear telomeric heterochromatin; Biological process=DNA replication
atgctgcttgcgcacgcccatccgtccaaccctcaggcgctgttcgacgagttcctcgacgagatgaacccgcctgttgccgccaaccacccaggagctgtgccgaagccagctgaagtccgcgcggctgaggtgatgctcaaccttgagtattacctcaactgcatggggacgaacaccaagtgagtaaagctggcataatattgtccatataatcattatttttaagagatgttgggctgcaaggactgccagtgggctacgactttcaacatcaggcgcagctcctggaggaggacaacatcttggacagcttctatggggaggatgctcggcaacgctgcaaaccaccgcagcaagttgccatcgagcagattggacgcctcaacccagatcaacgggccgcctttgatgagatatcaacatcaattcttggcgggtgcgaccagaagctcttcttcctcgaaggcgcgggcggatgcggtaataacggcttccttatttttcaaaagcataattaattgctaaagttaatttaggcaagacgtacttttacaacacgctgatcaagtggtgcatcgcaggcaagccctccttggatggaaacgccaacgcacagtgggtacgcaaccaagaactgcagcggaactcagttgttgccgccgccagcaccggcatcgcggctctgttgctgataggcggtggaacggcacacaggcacttctacgtgccaaacgacgtgtcgcaggagacgccgccgatgctgaacttcgagtcggcaaaagcggagcaactgcgccacgcacaactgatcatcattgatgtaaacaaaaatataagtttgcttttcgttcataataacaattttaggagatcagtatgttgtccaacaccgtgctcgactacatcgaccggctgttgcgagacgtttgtgcaaatgccacaccgttcggcaacaaagtggtggtgttgagcggcgactggcggcaactgactcccgtagtcgagcatggaactcgtgaggaccaagtgggtacgtcgatcaagatgggagcgctctttcgtctgttcaaaaaaatcaggtaatttgtcaactttgtttttacaaacatatttatgttattagcctaacgatcaacatgcggaccgcaccaggagaacaatcgttgcgcgattggctgcaagaaatcggcaatggaatgcaccgcgtgggtacggacagccaaggcttcaccaaccaactgcgcattccgcccgaacttctcgtggacgacctcgaccacaccattcacttctgcttcccagaagcactgtttgacgacccgctggccaacgcggacgcaattgcccacaatgccatcctctgtccgaccaacaacgacgtgcagcacatcaatgaggtggcgcttggcagaatgagcgggtgcggaagggaattcctgtccatcgacgaacctctggagcctaacgaagagatgcacaatttccgcaccgacttcaacatggaggcggtgcacaatgaaatgccatccggaatgccgccgcacaaattgaccatcaaagtgaactattttttgttttgatcatttttaaccaattaatccaggtgggtacgcccgtgatgctgatccgcaatttggacgtcacccagggactgtgcaacggaacacgacttcaagtgatgcgcacttcggagaacaacctgttctgccggattctcaccggaccacgagcgggtgcgcagaacatcatcgccattccacaaattcaattcgaatatggccgcgcacgacaccaccgtgggctacgcttccgccgtctgcagtttcccgtccgcctttgctttgctatgaccataaacaaggtgaaatacagattatttaaggattgaaatatataagcacaaaaaattaaaggcacaaggacagacgctgcagcggatggcgctcgtactcaacggccgtcaatgcttttcgcatggccaagtgtacgtcgccatgtccagggtcacgcagatggacggcatcagggtgtacgcgccgttctgccaaagtgggtacggaacgcacatcgagaacgtggtttaccacgaactgttggacttggagacgcagcagtcgaggataccgaatcgtggactgatggacgtggacaatgacccggacgcagcaataccggacgtgggcccaagagtaccggacgtggccaatgacccggacgtggaacgagataatggacacgcagcgggtgcgaaccatcaagaaccaaatgatcttgatagttcttttgatgatttttttgattga

SEQ ID NO: 61691 - DNA, 2134 bp, Heterodera glycines
  Genomic contig location: Contig_ID=SeqID_806; Location=2466..4599; Strand=-
  SCN-specific regions: Sequence locations=1-492,514-548,570-948,989 -1001,1030-1466,1488-1755,1798-2134
atgccttcaaaggatcgaagaagaaaagaagcagatcgtttacgctggcgagcggccattcagacacctgacgtggccaatgctcttgggggtccgaatacaagtggtcagcaaccttttggcatagatcagggtttttgttgcttttcatatgagaattaaaatctatttgtagaaccttcaacgtcgactggaattcgtgcccaaatcagacaacaacgaaatgatggacaagctattgtgggtacgtcggcactgcaactggacaccagcgttgtttcgactccgaccactgtcggattacgggctttgactattgctggaggtcttaatttaagctaataacaagctatatttattacacaagtaacaggttccgcaagtaaaagaacccgtcacaatggaaacgtgggtacgccaaacaatgcagccctaagttctgaacagcaccgatcggatacaagcgacgttgaaagcgttgcaggtattttgagttcatttttccataatttttcaacaaaaaatcacagatactcggcgtcggaagtcagcatccactcttcttgctgcgggtgcgaacactccacgttatacaagcgctaggcgcacaaaggttttggattcttttttttgtgttatttcctttttcagttaaatgagattcatgccaagcaaattgaagaaaaaatggagaaggtggtccgtgattacatggctcgtgattggcccaacccaatagctgcacaacgaccacgccggaggaatttaacaagtttgcctttttactgacatttgttagcctaattgaaatttttatttacagctgctaattatacacggtgtgggtacgcatgtgattgcccctcttatgcgcaatgccaacagaatgcatcgtcttttttgtcttcacaaaaatatttgaagcagtacgagcatggaatcaaaccagcacccgtatttaaacaaatatcagcaagaaataagggggtccgtcctacggaaagatgtcatcaaaatactgaatataaatgcgcggcacgctcgtcttcacacagagttggactgtctttttttaaacattaattaaaacaatttaggtggactattatgattgcggtcaatttggtgatgcattttgtggacattgcggtgctcgtctgctccttggcgaattcaacaacatcaagcgggcacgaaggcaaacaccttgctgtggaaatggcgccacacacactgaacaaatgatcaccgaattggatgaactcaaactgccacctcctgcctacgtgcatggcttggtcgatgctgttgacgagagggttcgagaggcatttctgaacaacataatggcgttcaacaacctgttcgccttcgcatctacacatggcgaaaaggccccacctgagcagatggggggtcgcctggacacgtgcaaatataatggttaagaattaaaatctgatttctataaaaaaataattattttaggacagttctccttcctgttcagcgatttaattgcaccgggggtccgtctcccatcatttgctcaagtgtacaccttgccgccggaagacgcattgaatgttcgtcaggaagcattggacaccgctgttgcgccacttattaaacaaacaatcatggagagacttgaggcgttgatgcggcaaaatccatttggccagacattccaaactgtgggtacgaagatcgatgctgctcgagcagctactggcgtagtcccgcatttcagagtaaaaaataaaaaaatatatgataataaattttgataataaagattgcgctgctgacggatcgagacttgaaaggcggtccgcttcacgggcgtactgatgtcaccgttattgaacgagcggatgcacccacagccaagcaagtggctgtgatttgggtgcaagaggatggccttccgccacaaatcagcggtaataaaaaacactataaaagcacaaatatcaaattttcagcattctggctgtccgacaaggccgggaagatgcgcgagctgaagagcggaatgccgcaaatcgacccgtgctgcttccctttgatccatccacgcggcacgcttggatggcggtggttcatgaagaaacgtgggttcgaggtataa

SEQ ID NO: 61692 - DNA, 949 bp, Heterodera glycines
  Genomic contig location: Contig_ID=SeqID_6466; Location=2202..3150; Strand=+
  SCN-specific regions: Sequence locations=1-159,181-223,245-521,543 -566,589-949
atgccgacttcatcttcaccaacaaatttgcatccattgctttacggttcgtatgagaggctcaaaaaacatgcctgcgacattgacaaacgattgctttattcacttcgccgtctcgacaattttacgcggctcaactttttggtggaagtcgaatggaaaggaaaaacaaaaatgcaggaagggaaagaagaggatgcatacatcctgtacagccgagccatgaccatttatcttatgataagtgagtcaattgacgacgaattcaaacaaagccgcggaggtcatcttttctatgaaacttcacagcgtttgtgtggattttgacaaagttgctgtgagtttacaacagcggttcaaggatgggaaaggcgagttgcctaaattttgtgatccgttgggactgcgttgggccgaaattgttgaagaaccgatttccgaaaatttggaatgtggtaaggactccaattcgtcggatgcccagaacaaaattctgtccattttgccggcaaatgaaacagtacctccagcaaccgaagaattttccatggtggataataaaaatcaaaaggaggaaaaagaggagggcagagacaaagagacgccggcggacgaagtgttcgagggcgagttgggtttcagtcggcaagtgggcggggtcgaagttgtgctgagtcgggccgagttggagaagctgcgccgattggaaaaaccgggaattgttgtgatcggcttcaaaccgttgcatttgctgaaggattcgcatcggatgggcgccaccgtttttgtatatcccatcaaatcggtaatctccggcagttggccattggtcaatgcggaccaagtggagacggccaagcagttcgtcaagaaattgaccaacaccaaattcttaccggatgattttgcaaattccatgctccaacagcattacaaagctgtcgaaatg

SEQ ID NO: 61693 - DNA, 282 bp, Heterodera glycines
  Genomic contig location: Contig_ID=SeqID_31326; Location=742..1023; Strand=+
  SCN-specific regions: Sequence locations=1-282
atgggattgacccgttactctttcgttaaatggattataaatttggaaaaatatgaaacgtatgcattcgcacactttagcggtgagaataaaaaaaataaaaaatgatgaaattcttttttagggcgttatgattcacactttgttttgagggacttgcgaatttgggatataagcagccggaattaacgatagcggatttaaaaatttatgagattaagtttagaagaggcgaaaaattcccgaaaattcattttcgggacagttggcttttaatgcaaa

SEQ ID NO: 61694 - DNA, 295 bp, Heterodera glycines
  Genomic contig location: Contig_ID=SeqID_31326; Location=1074..1368; Strand=+
  SCN-specific regions: Sequence locations=1-150,183-207,229-295
atgtactttcccaatcaatttaacaaagaggaaaattatggtaagaaagaatttccattaaaaaaatatacccaattttaggcataattttgacaaccctcccgccttttgaggattattttcctgatgaattaagtgaagaagaatatgacaaatttaaaaaatggtattatgcaaattataacagtggatttaatgtggttaagttaaaaaattttttatattgaactatttaataagacgtgctgagattgtcaacaacaatagcgtcttcatgtatgaagtagggaccaaa

SEQ ID NO: 61695 - DNA, 855 bp, Heterodera glycines
  Genomic contig location: Contig_ID=SeqID_31327; Location=214..1068; Strand=+
  SCN-specific regions: Sequence locations=1-81,104-115,221-655,677 -702,726-855
atgcctttggcggtgatcagcaacactgtggtccgatcagtgggcgtggagcagcacgaagacagcgaaagtgtggagaaatttgtgcgctatgtggccaagtgcaagtacaggtagagagagaaagaaattagagagaaaatgagtgagaaaaggagagaaaaatgacagagaaatagagagagggaaggagagagagtgggaaaagagaaaaagaaaggggagcgcgaagagatgttctaataatgtgagctattcgagaaacctttcgagaagatttgattccaagacccgagattaatatagagtcgaaaccgagactcttgattactctctcgacaattacctaattaatccaaaatcccaattgtcggaataagttcaaaaaatgaatatgaaaaaacagaagttctttaattacagtttggaaatcgattaccagcaatgttctgacttggacaatgagttggccaccagcgcagcagagaccgaagagccagcggaaccctcgcgccatttggccgcgtttgacccgaaagatgtgcagcaaagacacgaggggtaataaatgtttcagccaattgtttaagcatttgtcacgcttttattcctttatcagataccgtatcgaattgcccgacgaccgtacgaatttaacaaaaacgggagacgaaaatggagacgataaacgaaaacgaaggtcgagcagtagcagcagcagcaatgacgaggacggggggagaagggcatttccggtggtccaaattgacatgaaagggtacggctattgagaagagaagaagcgacggaatgaatgaaagggcaaacaaaaaatgcattaaccgaacaaatgca

SEQ ID NO: 61696 - DNA, 225 bp, Heterodera glycines
  Genomic contig location: Contig_ID=SeqID_31329; Location=494..718; Strand=-
  SCN-specific regions: Sequence locations=1-93,115-225
ttttaaaatttcgaaaattttgaaaatttttcgagctaagcctaaaaaacggttttcgggtttttgaattttaggattttttaacgatttttcccagagaaactgagaccacttccaaaacatagtttttcgagctctatcgactggtatttttttcggaaaaatttcgattttttcccggaaatagaaaaaatttttggcctgtgcgggacatttgagtcccgg

SEQ ID NO: 61697 - DNA, 61 bp, Heterodera glycines
  Genomic contig location: Contig_ID=SeqID_31329; Location=1103..1163; Strand=-
  SCN-specific regions: Sequence locations=1-61
ttatatatatgttatataggttttgagtttcgtttcaaaaaacaaaatctcccggccgaag

SEQ ID NO: 61698 - DNA, 318 bp, Heterodera glycines
  Genomic contig location: Contig_ID=SeqID_31329; Location=1377..1694; Strand=-
  SCN-specific regions: Sequence locations=1-318
ataggtcagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagcacaggctatagggaagctattcccgaaggaatcggtctccccataaatctgggcgcatcggttcggggggactgccccgaaaccaaaaataaatcgattttttcaagtgtccgtttggggtactcaaacaattatggggagcaaaaatccaacgcagaatt

SEQ ID NO: 61699 - DNA, 697 bp, Heterodera glycines
  Genomic contig location: Contig_ID=SeqID_31330; Location=214..910; Strand=-
  SCN-specific regions: Sequence locations=1-31,60-111,145-185,207 -213,235-276,330-361,390-441,475-515,537-543,565-606,660-697
attctgaacgcgaattaacaccatttttttcaataaaccacattttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattaccaaatgatttttttatctgagcattaatacatttcgatttatcatttatataactaaaatattttaaatgattaaaataatattaatttatttatagattctgaacgcgaattaacaccatttttttcaataaaccacattttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattaccaaatgatttttttatctgagcattaatacatttcgatttatcatttatataactaaaatattttaaatgattaaaataatattaatttatttatagattctgcacgcgaattaacaccatttttttcaataaa

SEQ ID NO: 61700 - DNA, 794 bp, Heterodera glycines
  Genomic contig location: Contig_ID=SeqID_6467; Location=878..1671; Strand=+
  SCN-specific regions: Sequence locations=1-29,65-70,94-143,165 -242,264-310,344-670,713-794
atgaaaagggggcaaggcaatgaacacattttgcaatggtttaatgattatgaaacccagcaaaagcaaagccaaagaaagggggaaaatgccaaagacgacgacggcaccacggaggaaaacccattcaaattcatcaaaatacacatcaatgaaatggcaaacagtttgacaattgacgcacatgtgacggaggagaagggggcagtggtcgaaatttgcttatgtgacgagaaatacgtaaaacaaaaactgttttaattggaaatttaataatttaagggaatttgtgacggtccgtttgaggcgacggaaaattttggtggaaaaattaacccaaaagcaacggaatgtgttaaatttgattataaaactattaacattttgaatcaaatcgtcaaaaaagagaacaaattgtcggtattagcacaatttcgcatgaattataagaaaggcggcaaaaacaaagcaaaaaatgcaatttttggtggtttgttcaaaaaggtaaacactcaaaacgaaaaggaaatggcacagaaaatgatcgatgttcgcaattggcacattggcaatttgttagcggcaaacgatgagcgcaattcgagaagattggaccgggaattcttcctcagaatttcatttgccaatgagagcaaatcaaacccaaaagtaaataaattaataattaatgtaaaataaatttttaaattttgaaggtcatccttggggagtgggcagtgcaaaaatccgtcaaatttgaaatgattccctcgccgaattggtccaaattgtga

SEQ ID NO: 61701 - DNA, 1536 bp, Heterodera glycines
  Genomic contig location: Contig_ID=SeqID_6468; Location=599..2134; Strand=+
  SCN-specific regions: Sequence locations=1-101,129-208,230-840,870 -928,973-1350,1372-1379,1401-1536
  Gene Ontology: Mol. function=lipid transporter activity; Cellular component=integral to membrane; Biological process=transport
atgccaaaagcgattcagccaatcactaccagcaataactctttgaacaatgccttcagaaatgatcgtcgatttttttgctggatgcctaggaggtaagcagaagagaaacagaaacagaaactgaccgaccggcggaagaataaaatagaaaaaatatttaatttgattttccgtttctccctttgaaggcgtcgccggtgttttggctggtcacccgcttgacaccgttaaggtgcgacttcaaacccaaaactcacattgtccaatctatcggaacacttttcactgtctgaaaaaaattgttcaaaccgaagggccatcagccctttataaaggtgaagaatttcttctccaaattttgttgataaatgaattaaaatatggtttaggcatgtcttccccattgaccagtttggcactaataaatgctgtaatattcggcgttcatggcaacattagcaagcagttcgacgacccaaatgctttgcatgtccaatttttcgcgggtgcggtggcgggtgccgcgcagggattcatttcctcgccaatggcgagcaaaagacattttcggtgtttagtcattgttttttaggaattgcttaaacttcgtgcacaaatttgtccagaaatttcggagaattcaaattcggcccaaaagcgatgttcttcttcgccctttacgatggcatgccaaatttggcgccaaaagggactcaggcatttcagccggtaaggaatcatagaaatcactccgtttaataagtaatcaaaagagaccggaaatcagtgacggaatttcgaggtcttaaaaaatagacaatcggaaaccgaaattctgatatatatttttaaaattcactttacctttttggcattttacaaaatttgagaaaagtttattgttttgacaattgtgattctgcactaaaataaaataaaatttatgtacaatactttattaaaaattttggtgacttggcccatgctgaggaaactcgacttgaaacgagaaacaaaaccgatcgaaatataaaagccaattttttcttgtcaaattcttaaacagcatgaaattatcaaatagatcaagttccaccaccaatatgtaatttcagcggccttctgatcactcagctgagggattgtcctgcgatgggcgtttattttgcttcctatgcttttttgaggcgttcaatggactccgaaaatgaacaatcgcaaggaatgtccaatttgcaattgctttttgctggaggagcagcgggaatgtgttcatggctgagcaattatccaactgatgtggtcaaaacccggttccaatcggacgatgcgtatgaaaattgtgagaaaaattggggaggatggaatgcgaaaagaaaaattttcaaaccaaatttcctgggcgcgtaaatttttttgagaaaaacttgaacaaatagtttttcagatcgagaagttgtcaaaaaagcttactcggaacacggctggcgaacattctttgctggacttggctcaactttgattaggtgctaa

SEQ ID NO: 61702 - DNA, 701 bp, Heterodera glycines
  Genomic contig location: Contig_ID=SeqID_6469; Location=400..1100; Strand=+
  SCN-specific regions: Sequence locations=1-167,203-461,483-573,595-701
cctttttctccgctgatcgctgtaaaatgagtcaacaaaatgaagaagcacttggcaaggatcaaaaggaacttcgagcagttcaacacgacatggaacgccttttcaaagcacgagacgcgaaaggactttccgagctgtacactgtcgacgccatcttcgcgagcaatttaaatttttaaattaaatttttacaataattgggtttaatgtttgttaaaatgatttgtttaggcccatccgccgatcaaaagtcgtgcagagattgaaaagctatggatcaaattccttgacacagactctgccgaattgcatgtgaatattattaatccatcaaaactttaaatcaaatacttttgctttaaggtaacttttgacgaagtttacttttgcggcgatttgggcgtcgaaaatggcacttataaatttacgaagtaaaagaattggaaaaatagatttagttttaaatgatatgatttttacagcaacgacggcacagtgacacagaacggacttttcatccaaacttttaagcgcggttcggacggaaaatggcttatccacaacgatttttacacatgttgaaaaagaatgaatcacaatgaaggcatcagaagaaaaagaaaaaacatttatgtgtgaaattaggcataattaggcactcattaaattaaggtgataataatgaccgaattaaacaa

SEQ ID NO: 61703 - DNA, 1429 bp, Heterodera glycines
  Genomic contig location: Contig_ID=SeqID_6469; Location=1399..2827; Strand=-
  SCN-specific regions: Sequence locations=1-345,371-493,516-569,592 -596,625-893,917-1103,1151-1368,1390-1429
atggaatatctgtcagtgttggagctacacttgaccggctccattctgctcgcttttgtgtttggccccaagctgtacgtgttgcttttctatgagccggtcgttgtccaattcgacaccgatggatgtgcccatggggacaaagctttggacctttttgaagcggctggtaatagtgatcaataaatcatttttattcttaaaaatacgatgctaataagtgaattggcacaacactttttgatcagattgggtgccgcattcgttgcgcgatcgaaacgcccattcgccgacattaagcacggggagcagcgacggaaacgaaggacggaacaccagcaacagcctgaacaaccacaacaacagcacatcgagactgaacagtgggaatagttcaatgagagggacacagcgaagggccaacgacgacggggaggaggaaaaggtggcaaaacgaaaacgacaaattggaattaatcaaactaagaaggttcaaaaaaggggggccaaagaacgacgaaaaggagcaaagaactgtgaagaaatttaccgatttaaactcccaaatttatatttttagcccaattttttgagaattttctataaaccaaaattataaacaaaattctcaattttctgtgttctttcttgagcttaattgtttccgaaaaaaatctttgagctggcggctaatattttttaagtgatttggaatacggtattcaaaccaaatgcccattttcaggtgacctccgccttccataccgtaatgcgcaagaaaatcagcaccggcagcaacgcggcacacaaattgcaccgcactgtttccgaatcggcacgaaactcggcaagagactcattttgcgcgggaacaacggcaagaaaatgacaacaataaaaaaaataataataaaaagcaaaagcagatgataacagggatgatatttttaggggttttgaatattttttcctgctgagctgccttatgtatttttagtgttgttaaataataaaaacgaaaaatacacccccaagaattgacccgaaaaaattccagaaaataacccctaagaaatgaaaaatttacttaaaaattcattcccaaaattatttatttatttttttgacaataatttagattttatattatgtatctgaatactgatttgacttaattttgttgggtttgaataaaatttagtcattttacaccataaatttgcaacttttaacaaccattttcttgtttttagcaacattttggattttttagaacctaaaaatatcattcctaatgataacattgttattattgaatatttatcgcattttatatttatgattcatccattggcaattgtgccatgaaaaaacagcaaacaatcaaatccctttgcattgtaattaccgaatttgtacagtaaataaa

SEQ ID NO: 61704 - DNA, 1069 bp, Heterodera glycines
  misc_feature (127)..(127): n is a, c, g, or t
  Genomic contig location: Contig_ID=SeqID_6470; Location=166..1234; Strand=-
  SCN-specific regions: Sequence locations=1-146,170-805,828-1069
atgtgcacgggcgaagaacgcttaaatgtgaagggaatgggccgactaagcaaagcgggcaatttggccaaaggggtggacagactgttgaaagccattgacaaggcacacaaaaagtaattaatgnaccaattaggaacggaatcatttttaattaattaaatttataggctttgtattcgggaaaaattatgcgacgaattcattgaaaacggacgcaaattaacgcgggaatatttgagaaaaagtgccaaagaagaaagtgccgaaatgttcgaagtgttcgaatttgtgccgattgatcatcatggtaaaataaaacaaaacatattggatttatcactgaggtgatttaggcaatttcgactattctctgatggccaatttgtctttgccccgaacttcgatcgattcgtccgccggcggggcattttcaccaaataataatccttcaatatcgaacatcgccatcaactttttggccgattaccgtccctttgcctacggtgtcccaattacgcgtgattcgccgtcggccaccgtgatttcacgatgcaaatcgccattctgtaaatgtccgctgatgatgaggtgattacagacgaattggcaattccaattaagtaattaagcgacgactttcacttcggtgccgatgtctccgcttggcttggccataattcggtctttcgtagagagccttcgaggcaaagaatggcagagataagcgaagacgatgaattcctgttgagggaaaacatggccgacgaaccagtataaaattttcttttgtgttcgtgtccctaatgaattgccattgcaggaaatccgcgaattgagtgccgatgccgtcgaccgcgaggtggcgtgggcaatccgtgccattctcttgtcactgtccgcgctgctcagtgccattgccgtcggcactttgctgtgcattctgttcaaaatatggcgtcgcacaatccgcggcagtcaatcgcttggcattttgcttctgctcggcatcatcacaatgcatctcagcgcctttctgttcaccaccgaaggcgcaaatgaacccttt

SEQ ID NO: 61705 - DNA, 181 bp, Heterodera glycines
  Genomic contig location: Contig_ID=SeqID_31332; Location=33..213; Strand=+
  SCN-specific regions: Sequence locations=1-181
atgtgccatacgaggtcaaaaatgatgttgacaagcgctggtaaaaagtcaagggttagtgcgaagcataatgtgacaacgacatagcaatttttcttaatatttcaaattaattgtaggtaattactaattagcataaaagagggtaatccgtacaaaaatgataattgatcaattatta

SEQ ID NO: 61706 - DNA, 871 bp, Heterodera glycines
  Genomic contig location: Contig_ID=SeqID_31332; Location=925..1795; Strand=-
  SCN-specific regions: Sequence locations=1-6,48-106,128-177,289 -503,526-674,696-707,771-871
atggtgaaaaaaaaagaatttaaataattaaaaaataaaaatttaaaggatggttgcgtcgatgtagttgagtatgaaaagcggaaggcggaagttgtcaaggaacggctccgggcaagcaaccgccaattggtggcattcaccgagagcccggagctgatgatccaaaaaattttggaagaggaagcaaaccgaaaagaaggagaggcggaagaagcacaaccgaaaaggggtttggaagaggaggaggaagaagaagcagaatcgggcgaggaggaagacgaggaaagcttttgtatggaggttggggaccaaattcaactgggggaagaggtgcaaatttcggggataaatttttttttactttgcataaaataggcacacggcattgacttggcaaaaacaaagcgccgaaaaaacaaaaagtgcggtggaaagaaattccgggaatgggcgaaacgagcactggcgaaggaagccgaagagaagcaaaatcctgggccgtccacgacggcgtccatcagctcacaatcggccttcgatgctgcaaataagtttgcagcatttcagtaccaaaagagaagaaaggcagcggaggagcgcagaaagggacgattaaattttgattaagggaattaatgagggaaatgggatgaaaatcaatttttttggaataaaactgttaataaatatttgtaatgacgattaaagaaaatctaaaaaagaaacaaacaaacacaatttaaaattaaaaaattaaaattttaattgcagtatgccaataatcggtactgaaaattacccatacgttttgactagaaaattttaaaaaacgccagaaaaaatgcgggaaaataatttattcaataaa

SEQ ID NO: 61707 - DNA, 191 bp, Heterodera glycines
  Genomic contig location: Contig_ID=SeqID_31333; Location=1062..1252; Strand=-
  SCN-specific regions: Sequence locations=1-81,103-191
atgtccgctccgccgccgtacaacccgaacatgcaacagtacccgcagcagccacagcccaactacggtcagccgggctacggtggtggcggcggtggatacggttacccatcgcaaccgtacccacaacagccgaactcatatggtggtggtggctatcctcagcaacaacaaccgcagccacaagtcgt

SEQ ID NO: 61708 - DNA, 404 bp, Heterodera glycines
  Genomic contig location: Contig_ID=SeqID_31335; Location=781..1184; Strand=-
  SCN-specific regions: Sequence locations=1-339,362-404
atgtttggatggacactttccctttttgaccgtcatcaactcggcctcaaattggcacttctttcgccacatttcgagcttttggtggacaaacatgttgatgacgagagcgaattgacaatttggagagcaatcgaaattcgtcgcaaggtcagtgtcagaacaacggcaccacaattatttgtgattatcggaattatttgtgattatcggcgctgtcaattctgtgccatttccattgcccgaccgtccgttgtccagcaaaattcgctctgaatttccgtttcgactcatttcgaaccccaaactcaaatttggtaaaaatcaaatttcgttttcaactaaatttacagtattgggcctaaactccacaagagccaaagaaacttttatatgggaataaa

SEQ ID NO: 61709 - DNA, 349 bp, Heterodera glycines
  Genomic contig location: Contig_ID=SeqID_31336; Location=180..528; Strand=-
  SCN-specific regions: Sequence locations=1-349
aaactttgggagacctatccaactgcatttgacacaaacaatgccgcaggattcatccccaaattgcattggtcgctcgcccatggtccagactttgccaagcgctggggatggttcgcatggatcagtgaacagggcatcgaacatttacaccacgttttgaacaagcaggttgaacaactttcgatttcatagttcaaaaaactatttttttgttttagtctgagcgcttcttccggtacaagggcgacgaactgctgctgaagatcggagaacatcagacattgctcaattccatttttgatagacatatggattcctttgatacatcaaaagccaaaaaacattg

SEQ ID NO: 61710 - DNA, 537 bp, Heterodera glycines
  Genomic contig location: Contig_ID=SeqID_31338; Location=835..1371; Strand=+
  SCN-specific regions: Sequence locations=1-97,180-209,252-298,320 -352,414-537
atgcatccggaaaaggaaagcagtgtttatagagtgcatgtccggaagaaaaaacggaacggacatgggacacacggatttgttgaagtgagtaatttaaaagtgaaaaaagaaaaaaaagtaaaaaagtaataataataaaaaatgaaaaatgaaatgccaaaagaaaaatgaaagtatttttttattattaattagggatgcgatttttaggcacaaaaataggcaaataaaattttttattaacgctttttaggtaacaaaccacgttaaaactttaaatatttcaattgtaaatgaaattattaaatgttttaaagttttttttcgaatatgaacaaaattttaaaccaaaaatttttattaagaaaaaaatatattaaatttagggataatttttttaaaaaattttacaattcttaggggtgtattttctgaaaatttttttgggtcatttcttaggggtgtattttttgtttttattgcatttttgttaaggattttttcaaaaaccctaaaataggcactttatgcaca

SEQ ID NO: 61711 - DNA, 897 bp, Heterodera glycines
  Genomic contig location: Contig_ID=SeqID_6471; Location=493..1389; Strand=+
  SCN-specific regions: Sequence locations=1-158,181-224,247-778,800 -839,861-897
atgacccgttgggctgttatgaacttcccggccaacgaaatgtgcctgtggccccaggcacttttatatggcactaacgatgacaacaacaacaataagtacaactatcggaaattgattcgaagacgcgaagtgctttcagaccgggtgagaaagacaataacagaaacaagaggggtcgcattgatgtgctaaagggaggggacccgctatggattttcctatttaaatttttcttaaaaatttatacctccgtgggagaggaggcgaggggggcgggggctacatcggtgcaccctatgacgtcactgcccaaaaagtcgccggacaattagttctttgagaaatttcaaaatattctcttcaatgcggccctatgttttgagtaaattatttttgtacaatttgtcgcgtggtttttcacgcgtttctctctctctttgggtcgggttgcaggggaggcgtacccttttttgtctgaataacagtgccaatgccttttgcttatgctactccatttcccaggtggtctattctctgttcaaccaacattccgcccacaaattcgttgtgaacatttactattcctccgagtcggatctgttcaagcaaatgcactgcttcaccatccgtcgtcatcgtccttcccgctgattttgagattgactttaatcggctgaaattgttcattcgctttttgttctttggtttcattcctatcaatgggtttaaaagtgcttttctcttttatttgcatggaaaacatctccataatttaattcattattttaaatgacaatttttgaaattaagctctgttggcgtttaccgatatttgtaatttcgaattctttcccattttctaaatgacaaattcatttatcataattttcaaca

SEQ ID NO: 61712 - DNA, 394 bp, Heterodera glycines
  Genomic contig location: Contig_ID=SeqID_6471; Location=1..394; Strand=+
  SCN-specific regions: Sequence locations=1-394
gtgggcgaacaaaaagcgcaggtaggaaaatcctcaaaattgatttaaatattcaaaattaagatgacaagtttaatggttaaaaacggacgattgtgcgaaaagcttggcgaacaccaaaagggactgaaagcagttcaaaatcggattgaattgctggagcagtgccatctgcgcgagttcgttgcgggtcttccgcccgttcatgaggacggctcattggttggtgccgaaatcaaacaaaatttgccacttcaatttcaggttttgtctcaatttgaaaatggcaattatttcgcagagatgaaaatactgttccagtcgggttctcgcttttgttcgggctttgccatcaaaagctcggcacactttcgcaattatccgtcgaatttat

SEQ ID NO: 61713 - DNA, 793 bp, Heterodera glycines
  Genomic contig location: Contig_ID=SeqID_6472; Location=1392..2184; Strand=+
  SCN-specific regions: Sequence locations=1-16,38-225,250-358,391 -503,526-793
atgtccaatttgtttgtggcttcttctgctgttgtttttctccttctccaattgcatttcgtcgtcactttcgcatcatcctttgaaggggcgccgccaaaagcaaatgaagaagcaatgccaacgacgggggaacaaaacggaggtgccgaatttggtggaagcaagcagaaaatggcacggaaaatgatgcgatacaatggcaacaattttgacaaggtcagaccaaaagaaacaaaagaaaagaagcagtgcaaccgcacacaatggcattttcaaaaatgaaattcgaaatgacacaaataattccggataataattcagagtaattaattaatacaagcggaatgactaaacgatttatattaattaaaatttaatttataaattgtttcatttttttcgttttttcgtcactgcggcgacaaagcaaccaaaaaaagttgatgctgattgtgagccccaggaagaaaataagggattttaatgagtcttaattccctattttgctggtttttaatgtttcgtccgtctgataatttgtcatttacccccccccccccccacataacacataattacctaattaacaccctcaaattagcaggtgtccgtcctcttcattcgacgtgaaatggcactgcgaaaacttcagctccaaatcaacgttttggagcagcaattggccaatgctttgtcgtccgctttcgccgccggctgtcccccctccggcgtttcttccgtttccgatggcatttcgcaccgacgccatttgccaatgccccgcgagtga

SEQ ID NO: 61714 - DNA, 1115 bp, Heterodera glycines
  Genomic contig location: Contig_ID=SeqID_6472; Location=2571..3685; Strand=-
  SCN-specific regions: Sequence locations=1-282,356-377,442-445,501 -537,565-678,700-709,740-897,925-1115
ttgttcgattggcctttggccgaactgttgccacagcaaagtgccgaggacggcactccgatcagtccgatcagttgctacacccaattggacgaatccttcgtggacgagtcgcgcctctatcgcctgaacaatacggaacagctgcgggagcgtgcctgccttctgcgcatcccaaccgggacgcggttcaccgtggaacggatgcacaccaaaaatcagggggttaatttgggcagggggggggggggggtaaatggcagaaatttaaaaatcgggagcaataatttattaaaaaacaaaattaaaaaacaaaaatatacaaaattttatccataaaatttaaaaaaataaacagtgagaaaataatttcatcatgataaattaacaaatatattaattaaataattaagcaattattaaattaaattaaactattaaactctaatattagtaatttgttaaatatttataacattatttacttttttatatttatagtccctggctaaattttcggtaataattctcttattcaaaatttaaaataataaaaattaatatggaaagcttacataagtgtttgaaggacaataaatttgtctttttccaaatgatttcattattttggtcaaattaccatggtatgattggccggcctcaaattgcataaaaccaattgaaaatttaaactttaactgattcgttgaaataaaaatatttaatctttttaatatatccaaaatattcatttaatttcagacttttgtcggcgttatggccggctcctcacaagcgtatttgcccatgtggaccggacgcattttcgaaggtaaaatcaaattgagcagcggttggttattttcaaattggtgcaatttcaaagtgtattaattgggtatgttttatttattttttaatttgcaggtcattccgatatgtacggcccatggcacgtgcaatgccaaaatgcgtatttggtgttcaattcggtggcttttccccacttggaatggttcgactttcgcttgacccgggaaacggaggaggacagaagcacttcaaatgccgaagattgcatcgcggaggaattggtcgaccggggccgattttga

SEQ ID NO: 61715 - DNA, 856 bp, Heterodera glycines
  misc_feature (11)..(11): n is a, c, g, or t
  Genomic contig location: Contig_ID=SeqID_31342; Location=15..870; Strand=+
  SCN-specific regions: Sequence locations=1-715,754-856
atgaactctanaattatcagagtgccgaaaatcgcatgtgatctaagcctagcaaaaaatggtgtaagtaaaaatcgtaattacgctcaaaaagcttctcaaacaattttagctcatccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttcacaaccaattttagcgcatccaattccttctacaatcgcctttatacatcccattatgaacgctaaaattatcagagtgccgaaaatcgcatgtgatctacgcctagcaaaaaatggtgtaagtaaaaatcgtaactacgctcaaaaagcttctcaaccaattttagcgcatccaattccttctacaatcgcctttatacatcccattatgaactctaaaattatcagagtgccgaaaatcgcatgtgatctaagcctagcaaaaaatggtgtaagtaaaaatcgtaactacgctcaaaaagcttctcaaccaattttagcgcatccaattccttctacaatcgcctttatacatcccattatgaacggggggattttacaccggattaatgggtcatatactacttacgttagtaaaaatttgttctcctgccttaaatgatcaacaaccggtaaaatctctcatatttaattaatataaaattacattgatttaattttagcgtattacttacatttttgttaatatcatttttgctagaagatattattgaacaaaaattttctcaataactagtttatagagttttataatttttttatta

SEQ ID NO: 61716 - DNA, 1112 bp, Heterodera glycines
  Genomic contig location: Contig_ID=SeqID_31343; Location=349..1460; Strand=-
  SCN-specific regions: Sequence locations=1-195,217-853,875-1112
atgattatgcgcgaacgcgagatggtcatggcgcagtacagccgcgtcgacgacctccccgcgtgggtccaattcccggacatcgaacgcatcgaatgggtcaacaaagtgcgccagtaccattacgatccgatcaactttgcatttagggctcaaatcccaacaaaagggatattctgggcaaaagggggggagggtatatttggcgatttatttttgattgaaataatgaaaaatttattaggcccctaaattgtttttccttatttttttttcatttttcactgatttgtctatttccattctcgcttgacagataattcaacaaatttggccccatatcggcgagtacaccaaagtgttcctgaaagagttcatcgaaccccaaatccgtgcccaacttccggcgccgttcaaatccttcaaatttgtcgctgtcgacatgggcgacattccgttcagagtggtcagtcagtcagcagaaagcggacattccattccgatcgttgctcgccattcgtccaaatttcaccctttcccagggcggtctcaaagtgtacacccaaaatgtgggccgtgaccgcgtgatcatggacatggacgtggtgtacgcgggggacgccgagttcgctgtgcaagcgtgcggcttccgtggcggactcaaccaaatggtgttctccggcaaactccgctgcaccctccagccgctgctctcccaaccgccaatgtgtgtgtttggtttgtgtacaattgttgttggcattttgttttgttttttcatcggtcggtcattttcagtctgtaggaatgggtacggtaacgaataagcgattaccggaaaaactttccttgtttttgtattaaaatgaaaagagtccgtctgtcagccaatgcttttcccatgtctaaaatttgccggtcttttatttcgagaattgttggccattctcgtcatttgttccgtgttttgcattccctcccattttagggtcggcggtgtgtcgagttcgttcatggagttgccgaagttcgacttcaatttgaccggcatgggcgagttcgtacagctgcccggactgatcgacgccattcggtcggtggtcaacactcag

SEQ ID NO: 61717 - DNA, 691 bp, Heterodera glycines
  Genomic contig location: Contig_ID=SeqID_31344; Location=353..1043; Strand=-
  SCN-specific regions: Sequence locations=1-40,116-164,186-288,314 -567,589-691
atgacgattcacataaaaaagagatacttcaaattgagggtaatatattaaatattttcaaataaaattaaaatgtaaaaagaataattttcaataaaatattttaaaaaaattagaagctttaacacctatttcatctgtccaagccgaagcaggagcaattgaaaagggtaaatttaattttctattaagtgagacgtagaaatcgtctggacctggactcatgcctaggcctttttttgacaatctagatttttcgtggattttgtccagcagaaaatccagatcaaatataaaaataatccgtttcaggttttgcacgaaaaacaaggacttattgagcaacattttagaatttattgtttcagattgaccaatgttttatttcagttatctgaaaaagattaaatagattaaaaacacattattattcaagtagataaaacaggtgttcctaacaattaatgattttttcaaacagttttatccaggtcctggcctgagaacaaggccatgacaagcctgggttttttctggacctaggttttgaccaggaaatccaggcttttttcaaaaataggactagtgaaaagaattgcaatttttattttgtagtgctcgaaactggtgtggttcaagggaaacgactttttggaagttttgtccgacactaatgggccaagtgaataaa

SEQ ID NO: 61718 - DNA, 376 bp, Heterodera glycines
  Genomic contig location: Contig_ID=SeqID_31346; Location=779..1154; Strand=-
  SCN-specific regions: Sequence locations=1-135,157-205,234-237,259 -292,326-376
cccccccctcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaaccatgtgcacccccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaat

SEQ ID NO: 61719 - DNA, 1290 bp, Heterodera glycines
  Genomic contig location: Contig_ID=SeqID_31350; Location=1..1290; Strand=-
  SCN-specific regions: Sequence locations=1-1290
ctgcatgtgttgccgtttcaaaactgaaagtcgtaatgtattggataatttggcgcggtgtttgaatgccttctgcaaagtcgacgatttaattggtttttgattttgcatatttttggattttaattgattaattattttaaggtcaaattgtcagtgaaggaggggtgaaacttttattgcatctcttcaagaaatgcagtgcagaagggaaactgagggcagcgcatggactggccaaaattgggattcgatcggacccaaacattgccttttctgggcaacggatgtacgaagtaactgtcatactaattaactattattataattcgctggtcaggaacgggatttctttatatttacgctctatttttaggtggttaagccatgcattgaactccttcatcccgaaggttggccaaaatgttgtaaaattatgcgttcgaaactgtttcagttgacggaaaagcaaattacgacgcccttctcaccctgacaaatttggcatcggtcggcgattcggtccgaaagcgaattctcaaggagaaatgtctacccaaagtggaggaattttggttcgaagtgaacaacgaacatttgcgagcagcggccgccgaattattgctgaatttgttgtattgcgaagagtattttaacactgttattaaggtgtttccccgtaatcaattcaaaattgacatgattttcattataaacaaaattttaggcggggacggatcgtgcgaaggtttggctcctttactgtgccgagggggacgaccgcctgagattggcaagcagtgccggctttgctcttctcaggtttgcgaggacatcttctgtttgaactttgtcattctcacacagtgagaatccaacgttctgtgaacgaattctgcaagaattgaacagttgggaagagcttttcacagaattggcaatgtccgaaaaccccgaggtccaacggcgttgtctgattggaattgccaatttggccgaattcggtggcgagcgggtggccagccaactctttgcggtgggaaatggtgtaacctttgggttggcactgaaaacacttgctcatttctttcgggcatttcatcgaactaattaatgagcatttgtttgttttagagccaagttttccatgttttggttgcgattactaaattggacgagaaagggcgtgaggggtccaaaaaagaggcgcggagagcgttggaagtggcggagagtcgcggattgattagggcaacggaaaggcaaataaaagagcaaatcgacagcaaa

SEQ ID NO: 61720 - DNA, 3762 bp, Heterodera glycines
  Genomic contig location: Contig_ID=SeqID_6473; Location=256..4017; Strand=-
  SCN-specific regions: Sequence locations=1-214,237-282,304-325,347 -825,847-947,970-1191,1213-2204,2228-2258,2280-2469,2492-2977,3001 -3032,3054-3243,3266-3762
atggattattttattccaatatttttattattcaatctttgtcttttttttgcctttacaattggaaatccatccgtaagtgtttctgattaaacattatttttaatgcttttatcaatcatttatcagatggaagatgacgcaatggttgagcttgcaaaaggacccgaatattttaacaaattttgcgcggataaaggattaattatcaatgagaaaaaccaatttgtgtctgataaatatgaagcccaccttggcgttttgtatgttatgcgaatgaaatggaatcatgtgacggaaacgcgagtaagcaaattctctgtatattaattaattaattaattaactcgacttgacaaatggttagcgataattgggcaatggaaccactgggcccacagtgaacagtttgggaaattgttgtaaaaaactaattttcaacaatttcgtgatttaccggaactcagaaatttttactgtactcctccacattcagtctgatcactgccccaaaattatccacggccacaatcaattgtccaaataataggcaaaaccatggccaattactaattataccggagacaaaatttaaaaaaaccataataaaaggcaacgtataagcttcaaaccaattggaaaatgtgtttttaatttttgattggatcttttttacgacattttttcaattgtatcgtaaataatacgatcgaaaaaattttagtttttcgtttttttggatctggtctttttccgatcctgtatcgaaataaaccgatcggacccttgttcggtctctaaattttaccatgttattttaagtacaatataaatgtctttaatgaattggacaactttcgccaatttgctttcattctctacgaatacttcttctggcaatatgttgctgaatatgtaaaaggtaacggatttcgaacccaaattttaaattgaaatttcaaattaaattaaatcccgtaaaattttctagcagtagacccaactttagctgaacaaatttccattacaaagaatcccattaaaccaaaattagaaagcaacgggagagaaataaagttttgtgatgcaatcctagattgggcattcgtttggaggaatcattggctgggcggaaattattctaaaacgacacgcttaattaataaagaaacgctaattgagaaatatggaataaatttaaacaattggtatgagcaagaatcattgtttgacatgccaaaaatgaaattgaaattaaatgccaattcaaaatttgacaattcatttccccgtcttcgcaaaatgttcgatttcaaaatggaaaaattgaagacgatggcactggagaaggtgtcccgatatgatttttttggagcggccctaattgaatgttcttcaataacaaacgaagcattgatttcgcacattaatcacaagccattttatggaatagacaaagcggtaaatgaactggaagtgtttttggcgctttcagtgatgcttgaggagagtctcgcctcgagacaagtcgtctcggctttttgagtctcggtctcggaaatttttggtctcaagcacacttgttctttgcaccagggatggcagggactcgactttcgatttccgtttttcgcttttcaatatttttatgatcggaattccgatgtccgaaaaactttttaagccccggaattctttttgaagaattttatttatatgcatcataatagtgccaaaaaaatctccatttaattttttgatttttttgtgtgaaatatttgttgaaaatttccaaaaactcaactcttaggtgggtgtgtgttttttcaattttaatgcccttttttacgaaattttgccaaaaaatttttttagatcgaagacaacatatttcttattgttctaaaagaaatgcgtgttgaaaagtttggtgccaaattggaaacggcgccattaagtgccaatgccaaatcattgatccattcacagaaattggaaatcaagctctatcttaaaatcatttatttgatgagactcaaatggcaatgtgcggaaattgagaattaccgaaaagaatgcacaaaattccgaaaatatttcaattttttgtatgaatatctcttccgaacatacaatgaaggtattgtgagaaaatgagagtaattctttcccccacctcaccatttggaaaagtcatcagattgaacaaatttaaaaattttaaagatttttcagttaattcaaaaaatctaagaatttttgcaatagaaaaacacagaaattttataatggtttttcgtggatttaaaccgatttttaggcgaaaaatgtaaatactaacatattaccaatttagaatgaggttcttttacaattttgaccttttctactgcaaaaacttaatgataaagaactttttttttgagtatttgtatgcatttttgcaatattttctaattttttatcgctcaaatttaataaattaaacatttagcggataattccgaagtgccacaacaatttgccgcggtgaggccaaattttacatttggaagtggaaacataattaagtctttgatttatgtggcaagtgaattatgcgggattgcggcattcttttttgacccaacttatgcaaaagaattcgattacaaattggacaaatatttcaaaaaatatgcggaaccaaaattactaaacgaatcggaagtgagtggtgaaaagacaattggccaaaaagtttttgaaagtgtggcaaaaataggaaaaagtccaaaaagggtggaagaaaaggctgctgcaatttcaccatcagaacaactcacatttgacttaagccgttcaaattttgacaatttgttgagagaaaactttgaaaaattacaaagagaaaatgattatgaaacggcaaacgtaatttataaatggctttatttgccgacaaataaaaaggcgggaaggaaaagtcttcagattgaacaaatttaaaaattttaaagatttttcagttaattcaaaaaaatctaagaatttttgcaatagaaaaacacagaaattttataatggtttttcgtggatttaaaccgatttttagacgaaaaatgtaaatactaacatattaccaatttagaatgaggttcttttacaattttgaccttttctactgcaaaaacttaatgataaagaactttttttttgagtatttgtatgcatttttgcaatattttctaattttttatcgctcaaatttaataaattaaacatttagcggataattccgaagtgccacaacaatttgccgcggtgaggccaaattttacatttggaagtggaaacataattaagtctttgatttatgtggcaagtgaattatgcgggattgcggcattcttttttgacccaacttatgcaaaagaattcgattacaaattggacaaatatttcaaaaaatatgcggaaccaaaattactaaacgaatcggaagtgagtggtgaaaagacaattggccaaaaagtttttgaaagtgtggcaaaaataggaaaaagtccaaaaagggtggaagaaaaggctgctgcaatttcaccatcagaacaactcacatttgacttaagccgttcaaattttgacaatttgttgagagaaaactttgaaaaattacaaagagaaaatgattatgaaacggcaaacgtaatttataaatggctttatttgccgacaaataaaaaggcgggaaggaaaagtcttcagattgaacaaatttaa

SEQ ID NO: 61721 - DNA, 636 bp, Heterodera glycines
  Genomic contig location: Contig_ID=SeqID_31353; Location=20..655; Strand=-
  SCN-specific regions: Sequence locations=1-9,52-526,548-636
acccacaggaaaatatcattttattattttaaaaaccaaaattttattttagaaaaccaaaaaatgggaagtgcccattttcttggcccaattttactggtcgcttttgcggcgcttatccttggccaacgttcgtctccaaatcactcttcgggatcgccttcacagcgtgacaaatcacatggactgtctcaacagggaaaaggccatggagcaaaagaggcaccggggcaacagatcaaaaacaaagacaattcgatgccaacaattaaaaaaggaacgtcgacgaaaagccaaaaaaagggaaaaggacggcacgcaaaaaacaacgacggaattggcactttgggaaaaagcaaacgacagaagcgattcctcacagaaatattcggcaattcattggacaaatcgaaaaataatgcggaagagagtgaacgaaaaagagaagggtttggcattgtgccagaaaaagtgaagggaaaagcggaaaaaacaaacgaaagagcgacagaaaaagcaggtgaaaagaatggaaacggaggccgccaaaagcgcttcgatgaaagaatcctcggcaacaactcatttgaactgcccgttctgaatcttggcccaaattggacaccccctcaataa

SEQ ID NO: 61722 - DNA, 744 bp, Heterodera glycines
  Genomic contig location: Contig_ID=SeqID_31354; Location=31..774; Strand=+
  SCN-specific regions: Sequence locations=1-306,377-380,403-465,487 -518,541-662,684-744
cagaaggcattccaagaagagcttgagaaaaaggtcacggaacgacttgtgacagttcagacggaagttgacaaaatggaaattgcacatcaacagcaaaagggtaagggaaatgagcaacgattactgtacctatcgtaatattacagagactaacaaataaggtcatttattgttttatttcaaattttgtttaatagaatctattccatttaagtgattattgatgaattggatggacaacaaaaacatcaaaagcagcaatgggaaaaggagacaaacggtgagttgttacttaaataatcgattaaaatattatttaaataaatttatccatttttgaataaatatgcatttattgtttatttatatataacgattttttcatgttttagcattggttagccaaatcagacaatttaaagacgaacagaagaaatatttggaaaaggtcaacgaattggaaaagcaacagaaacagcggcagaaggagagggacggtaagaaaccaaagcatttaaatttattctctcaattttaggacggattgacaaaatggagataaagcagcagcaaatgagtgattctcacaagacacttttggaaaaaattgaagcaaagcataaggaaaagcagaagatgtttaaaatggtgaataaatatttagggaaattgggaaatttatatgatatgcatttaatacggtcaccaaatgaacaaatttcaatacccaagcattattaa

SEQ ID NO: 61723 - DNA, 526 bp, Heterodera glycines
  Genomic contig location: Contig_ID=SeqID_31355; Location=1..526; Strand=-
  SCN-specific regions: Sequence locations=1-526
atctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctataggg

SEQ ID NO: 61724 - DNA, 626 bp, Heterodera glycines
  Genomic contig location: Contig_ID=SeqID_31357; Location=1..626; Strand=+
  SCN-specific regions: Sequence locations=1-431,455-626
ctgaaaatctgtttcgatttgccgtccggcgcctacgcctctgtggtgcgtttttgggggtcacgaatttttttggacaaaaacactaaagtttgtgattttgcatgttggaatacctccccccgccccttgaagatccctaactaaaatttaaaggataaattgattttttttttataacaaaaaaggaccttttcattgctttctgctgctcgaatgcccacttttatgagtccaatctccaaatcatatgtttgtattaattaacacatggaaaaagttgggaagttccggttccaaccaaatcttttcataatttaacagtaattttattttcccatttgcctaggctctgcgcgagttgatgcgcaccgactttggcaaaaaggcgcaaaagcaattggaggaagaaatgatgaggaagagaaggcggaggacggaggaagcagaaggcgaagagggaagaagcgaaaacgagcaaaagaaagacgacaaaacggaaatgtgccaaattaaaacttaaaacatttttttgttgttttgattgtttcctttttcaccacttttacttgttaattttatgttggtattcccgatatgtgtgattgaaagaataagaaaaaaaa

SEQ ID NO: 61725 - DNA, 656 bp, Heterodera glycines
  Genomic contig location: Contig_ID=SeqID_31359; Location=106..761; Strand=+
  SCN-specific regions: Sequence locations=1-56,93-131,154-161,185 -251,274-276,298-383,406-596,618-656
atgtcaactcaccctggtaatcacttcaagtgaatgataaacgtaaaaaagtggacaattttatatttcatgttataaaattaataatatttctggtcatgaaaataattttttatcaaaaaatgggggacaattttaattaataaattatttgttactcctaaaaatgaaataaatattttatattcaaaccgctttctaatttgtatttactgtgtatttgtgggttatacatatttcttatatatcgggcttttttaataaattttttccggtcccgtttttcccaaaattcacggtccccgtggaacaaaaaaagccggataagtgagactttgaaaaagtcggatgggataaatcaaagtgtaacagttttatatccaaattttaaaaatgccaattttactcagaccgattctgaaaaacgggtttcaggaatttacgaatatttgccactgtacaccaattttgagccgaacagaacatacgaactgattggaacttatgagcccatcagccaaaccgatccaccacagtttgaaatgaactttgtgattctgcacaaatctgagcaaacgcggcaaatgatgaaatggtaatttttattgtattttacaactttttattaattttgtaattgaacattcagattggta

SEQ ID NO: 61726 - DNA, 911 bp, Heterodera glycines
  Genomic contig location: Contig_ID=SeqID_31360; Location=479..1389; Strand=+
  SCN-specific regions: Sequence locations=1-517,549-911
atgcactacattatctgcaacaacatttcatttaattcaattaccatcctacttttcatgctgttatgcaacaggaagttaaatgtgaaaaacattataggtttgtttccaaatccattgatataaaaaaataacatttcctaattaaggaaagaagttttgccaaaaatttacgaacgagttcaggccaaaattaggagtgatttggaacattgcaaggtgttgtcgttcacaagtgactgttgggccggcacttccgataattttattagcattttggttttattatttcaattttaactatttttatttagcctgacagtgcatggcattgacaaaaattggatatacaaagagtgaattttggcagttacaaatttccctggggagcacaccggtttagcaattgcgatgaaactttgtagcgttttggaacaatggagcattgacggagcaaatgtgcattgttttgtcactgattcggcaaaaaatatgtgtcgggtataaattatcctacaaaaaattataatatttaaataaaaatttaagaaggattgtgtgccgacaatgatattgagaagctgtttgtaaaatgccgtaaaatagtgggccatttcaaaaagagcaacaaagcattgggaaagctgaacgaaattcaagaacttcttgctattcctgagcattccttgttgcaagtatatatattaataattcttaatgattgtacttttaaggaagtttcgacacgttggaattcagctttgatgatgatcgaacgactctacgagcagaaaaaggcaatcaacgaatacgcctaccaaaattgtgactttggtctcactttaacaagcgaagaatggtcaattttagatgaacttattgcgggtattgttttaaagaaaaattggtag

SEQ ID NO: 61727 - DNA, 363 bp, Heterodera glycines
  Genomic contig location: Contig_ID=SeqID_31360; Location=1..363; Strand=-
  SCN-specific regions: Sequence locations=1-334,356-363
tactcaaactattatgtatgagcaaaaatgcttcgcatgattaaagtacaggttatagggaatgtattccggaaagattcggactccccataaatctgggcgcatcggctcggagggactgccccgaaaacaaaaaaatcgattttttctagtgtccgtttggggtactcaaacaattatggggagcaaaaatccaacgcagaattaaagtacaggctataaggaagctattcccgaaggattcggtctccccataaatctgggcgcatcggttcggggggactgccccgaaaacaaaaaaatcgattttttcaagtgtccgtttggagtactcaaacatttatggggagcaaaaatccaacg

SEQ ID NO: 61728 - DNA, 1205 bp, Heterodera glycines
  Genomic contig location: Contig_ID=SeqID_6475; Location=447..1651; Strand=-
  SCN-specific regions: Sequence locations=1-471,493-522,544-678,700 -733,767-873,929-1205
atgatgcgttctgttattaaatttgtttttaatcctataaatgaagatcaaagacaagaactatgtgaaacgtggttttacagatttagtaagatttatttctgatcaaaagtaatagcaaatataggtgatgcaccgattgaatatccagtaccgtttgattttgtttcttctgagtacggactcggtgaagttatcagtatattaggagatggtaattgcggttggcgagctgtctctcttgctatgactggaacagaatcaaatcacaccgaaatccgaagagatgtcattgagtatttgcaagaaaccattaaccaaaattcttatacagaaaattcttggtggtgtaagtataatataaatcagtactgagtgaatatgctaattttagcgctatttggcagcaatatatatattagagaacatctagaaaaagcaatcacacccgcaactggggcacacgaaaccgaaaaatggatgaataatttagatttagcagcagtcatcaaaatgtttcgaataaatatatttgtgtgtgaatggctagtggaagaaatttaccgttggcaagtgtattcgccaaatttggaacaacgggttagaattgtttaattgtgcaaattcatatttgaaactttagctttcaaatctgagtcaaaaggagtcgactgcatcaatatttttatattatcgccacagccactttgaactcataaaacacccacaaaagataaattaattattatttttatttttttatattgtattcaaaattcccttttgtaagttgcaaagaaatattgtggcacttattgtggcacttctatatttgattcttgcatgatagcccctgtaatatggttttgcgactttaaaaaaagttataaatttaatagatttataaatgtattatttaaatattatagttaatcgttgctgttataaccatgatatatgctatataaacaaatatcaaaaacaatatgattgcgacaatagcttttgcaaatgtctgtatgaaagtactgattgttttctgacaaaagtctgtctttacagtatttaaagacttaatttatctttagaatttgttatgctggtcggttaaaatttttggtgaacactttaaagaacagtgaaacaattgtagttttgtattatgtagattaaaaaaataacacatccaacaatttttgaataaa

SEQ ID NO: 61729 - DNA, 1580 bp, Heterodera glycines
  Genomic contig location: Contig_ID=SeqID_6475; Location=2455..4034; Strand=-
  SCN-specific regions: Sequence locations=1-180,202-921,943-949,973 -1120,1277-1580
atgcccattgcggatttgccaatgccaaggaatgatggaacgcggacggtggcggcggcggtaacatcaaagcatttgataaaagccctgcagcgccattttgcgcagtgttcatttgtgacgttggcagaatggccgaagcatgtggtggcggcgaaccaaagggaggcggttgaaacgtgctgttcaaagaaaattacagagactattcataaacacatgtaagtcacgtaagtaaaaaatacaccaaaacatgacaataaaaacacacaaataatataaaaacataggacgcataaaaacgcgtgtgtaaaaacaattgaataacaagccaagttaaaataagtgaaaacacaatgttagagatataataaagctggcccgtaaaacacattggaacgcataaaaacaaacacacgtgaaaactacaggtaaaacacataaaatcttttgtgttaatataacataagtggacgtataaaacattgtaaatacatattttattgttaatagtaaaatgtaaaaaagaaaaactcgtgaaaataaaacaaacaaacacgtaaataaatgagaaaaacaaaaacataaaatattgttattgcatattcatgaaaatgtaggaaaattgaataaaataaatgagctaaaacacttaaacatatattagtgcaataaaaggacgtgtaaaacacaataatacacgtaaacataggcgagacaaatacctggaattaatatgacaaagcggacgtgtaaaacgaaaacacatcttattgttaatttaatagctaacacattggaatgcagaaaaacacgtgaaaaagacctaataaacacgaaaacacgaaaaaagaaatgagtaaaatatatctaaacatagacataaaaataattgttatgcatattcatgaaaactaagaaatataaataaacaaatgttagccaaacacgtaaaaacaaaaagcaaaacagtgaacatatatattagtattgtgtaaaaagtggacgtgtaaaacatatttgaacgcctgataaaatgcatgtattaaataaaaagcgaacgtgtaaacattataaatacacattttgttgttagtataatagtaaaatggtaacgaagaaaaaacaagtgaaattagaacaaacaaataaacacgtaaaagaagtcaaaaaagatataggtataaacattgacatgtaaaacacgtgaaaatggaacaaaaaatacatgtaaacatagagatatgaataattgttattaaatataaatgaaaatgttggaagattgaataaaataatgagtgaaatacgtaaaaacacaaaacacgtgaacatatattcgggtgtgtaaaacacgaaaaaacatcttattgttaattaattgtaaaacacattggaatacagaaaaacacgtaaaattgcaggaaaaaacacgttaacaaatacgtaaaataaaagagaaaaattaatcatagacatataaaataagtgagcgaaacacgtaaaaaaacatagaacatatattagtgcaacaaagcggacgtgtgtaaaacatgaagtaatattgttaaactaataaa

SEQ ID NO: 61730 - DNA, 525 bp, Heterodera glycines
  Genomic contig location: Contig_ID=SeqID_6476; Location=342..866; Strand=+
  SCN-specific regions: Sequence locations=1-154,176-203,225-261,286 -323,350-444,467-525
gtgacggtccgactgagcaaagatggcactgagcacaccgcgcttggtccaacattgactacagccaagcaaaaagctgccactttggcactggcacatcttcgtcccgagttggagcagctgaaactcttgttaaaggaggcggagggcacagaggaagaaaaacaaattgtgccaaaattggtgaccaaaattgatggcacagatcaacagcagcaacaaaggcaacatttgttgggttgtgatgccgcatcaaaattccatcatttatcttcatcatcaccgactgatgaaatggatcaacagcaacagtatgatggactcaacgatgatgatgatgaagaagcagtagcagcagaattggtcgaaccggtgccgctggaagaagcggaaagttgccgagaagagcggcggcagagtgccaacaaaaatggcaagtgctgccaaattttgatcaagttttggtatcattcggtgcagaataacaagttgttgaaaaaagctaattttaactcgaataattaa

SEQ ID NO: 61731 - DNA, 254 bp, Heterodera glycines
  Genomic contig location: Contig_ID=SeqID_31366; Location=391..644; Strand=+
  SCN-specific regions: Sequence locations=1-142,221-254
atgtatcttcatgttatattaccaacaaatatacataaacaaatcataaattccgagcagagatggatcataattataaggaagtggacaagttatgtgaaatgaataattaaagaataaagcaattatttagttggaaaacaaatatttatcaataaaatacaaaatattctattcaaataaaatgataacaatgaaacaaataatttatttatttttagcaaatgattgttaattatcgttgattaaaagca

SEQ ID NO: 61732 - DNA, 78 bp, Heterodera glycines
  Genomic contig location: Contig_ID=SeqID_31366; Location=1220..1297; Strand=+
  SCN-specific regions: Sequence locations=1-78
atgcaacgaccttttttgtcaatttttaaagcacttttttcgggagcgcttttttcaaataattttgggcaacaaagg

SEQ ID NO: 61733 - DNA, 720 bp, Heterodera glycines
  Genomic contig location: Contig_ID=SeqID_31369; Location=586..1305; Strand=+
  SCN-specific regions: Sequence locations=1-372,420-476,533-720
atgattttaattggcttaattattattgcctttgtgactttttgtcttctgttgagtttcattgggtttaggggtattttttggttatgctgtcacaaatgataatgattccttttttaagctcgttcgcactctgcctctgtgtatgagcgcttccgtcgtgtttctcaaactggcactcgcgcacatgttattgactttgatgaaccaaatacaagtgccggagcaaaccctgttcgtggtggcggtggcgggcgttttccaattgacgatgcaacgtggttgtccatgtttcgccgcttggtgggtttaatttaatttaattcttacttaaagtttatgtcttattttgacaaaaaaattttgaaaacgaatttttaaaaaaataaattctattttaagctttttttttaaattaacttaactatttttccaaattaatcaatgctaagaaaatttggccacgattttgagacattaaatttaattgaataaaaaaaattatatattttttcttatattgttaattattcgccctcttcatttttcagaataatctgacgcgaactgttgaagccatcaaaatttgccttcagtccgttctcacgaatcaacaactgaacaactgggacttgaacaactgcaacgagggcatttacctttacgattatttattattggccgagcatttgtcgaaaaacaactgtaataattgaataa

SEQ ID NO: 61734 - DNA, 728 bp, Heterodera glycines
  Genomic contig location: Contig_ID=SeqID_31371; Location=811..1538; Strand=-
  SCN-specific regions: Sequence locations=1-150,173-301,330-651,673-705
atgtcttccgccatttccaactgttcaattctgctgcttttcaccacaatggtatttatttccactgcaaaatcactgcccctggtcacatataatttcaatcagccaatccaactgcttcgacttctcaaaatggacccgagggtaagcaaaatttaatataaaaaaaattgctacagaaatgactaaaataaaaatgggtttttttaatataaaactggagtttacccataaaacttagcaattgtgaatttgcgtacttgaatcacactaaactttcccatcatgtacttagttaacctaaatatataaataatcattttaatttagcgacagatggctttgatccgcttgtccgattctgcgtttaaacaccgctatgtgccggctgagcgccaaacttattcagagcaacaaccgtatgaagaacgcacgagtgccaatggggacgaaacgatttcaaccgagaaaaaatgggacacaaaagcgatgaattggccgaaaatgttgcttgatgaagaagggaagagatgaatgaatgaatattgggaaaatcaaacaatttcatgatgaatttatgcgcttatgatggatgcccttgattatgccatttaaaaaagaattttacatttttcgctttaaaaataattgcaaaaaagggaattataaataaccacatttggacaactgcatccgccaatggataaaaaagaatagaaaagaataaa

SEQ ID NO: 61735 - DNA, 315 bp, Heterodera glycines
  Genomic contig location: Contig_ID=SeqID_6477; Location=1046..1360; Strand=-
  SCN-specific regions: Sequence locations=1-3,25-39,174-232,264-293
ttcgatttgtccccaattttttcgctatttttgaattaattttattccattcttttgttgaatgttttcgtcctttttgctttattttttcttttattttataaaattttgcaattatttctctttttttgagttcatttcttttttcttcttctttttcttcccatttttctccaaatatttcgccaaatgacttttgttgtaactttttcttttctgattcaattttgacaattattaaaaatataattaaaaataataaagggaataatttcatttttgtcgtcttaaaatgattttattttttcttcaatt

SEQ ID NO: 61736 - DNA, 2018 bp, Heterodera glycines
  Genomic contig location: Contig_ID=SeqID_6478; Location=860..2877; Strand=-
  SCN-specific regions: Sequence locations=1-322,344-1194,1216 -1411,1442-1524,1548-1670,1697-1739,1781-1915,1938-1981,2003-2018
atgaaaaataattcgggtaaattggaatcattatttgaaaatataacagccacaatcagtgtaaagaataaggaaccaaaacaattttggaatttagaaactatgggagtatgggataacccggaagagaaggatgatgagattgccttgaaaatgtttaaagaaacggttcaacgaaaaaatgggagatacatggtaagttggtcatggaaaagccctaaagaagaattaccaacaaattttgccatagcataccggcgtttaatgagtatgttagaaaaaatgagagtaaccccaagtcagcttaaagcgttggaagagtcatttaaagaaaatttaaaagagcaaattgtcgaagaatcttcaataaaatggtttggcgaacattttctccctcatcattgtgtcttcgcaccgggaaataaagccatggattgtttatgatggctcagcaaaaaaaggagtggtaaatgcctaaatgacatgctttttcgtggcccaatcgaaatgccacagctcccagggcttttaatgcgttcacgaataccaaaaattgctttatggactgatattcaacgagcattttggacattgtagttaaaagaggaagacagagaatttgtaaaatttttgggtaagagatataagaaaaccaattacacaagaaaatcttttggttctacgttttaaaagagtaccatttggagtgatttcctcaccatttttactgggtgcgacggttcggtatcattcgatttggcccatccctgatatacagtatgatgcatgtgtttataatcaaagtgttttttgtcgtaactttgtctaatatcggtcaatcttaacgattttggtaaaatctcagttgacaggattcagcattatttggaaactaatgttaaaccggtctaaaagctgtattaaaaagtatgtcatttttcaagtcaaagccgaaaatatttgggaatttttttgataccttaagatttgatttggcattattaccgtatccattagttgcatggcaatggccatttaaaaatcaatgcgtcctttcgtttttatataaaaaccagaataaatgattttttaaattagcgtcggcattttatttaattttggagtccagcggtgccgataagtgccgcctgggaaaaatttgttatgttaatattagcattaaagttgctattgacgaattttccattaaagcattttctattgacgtattgtcactgatgtatttttcattgacatatttttcatataagttttttctactatattatttttcactgagttttttcacttacttatttatttattcaataaagaaaaggtccacaaaagggaaaatccgcttactttgtggacaacatatgtataaattaattgtccaaaagtaattcggataaaataaaaaatgaataaaatattaaaagagagatcacaagtcacacaattaaaataaagataagtcaaagcggctcaaatttatcaaaattatcgaatcgcttatgtaactatttattaaaaaaaatttttttcagtcctgcttttaattactctaaagaatttttgatttttgttttaaattgttttaatgaatttatttttgcaagttctttatctaattgattccacagtttggttgccctcacgtaaatggaatatattttttgttatattttgtgttaagtctataagagggggagttaaagcgaccagatggcttaaaaattttgtataaaataatccaaatttttgaagattttgattttattattctaaacaaggatcgtatatgtgaatatgcattctttgttatttgtaaaatgtgatcagaaaacagtaatttattatcgatatttacccctaagtctctaattgtatccacagcatttattgtattcccatcaaatttatatgtttcttttgggtttttgaaacccaaatataatataaaagttttttgaactgaaacttttatttgccatttatttgcccattcaaataaa

SEQ ID NO: 61737 - DNA, 460 bp, Heterodera glycines
  Genomic contig location: Contig_ID=SeqID_6478; Location=4465..4924; Strand=+
  SCN-specific regions: Sequence locations=1-23,47-111,223-293,315 -359,382-460
atgaaattattccctctattattttgtttaattttaattttcattgccctaattaatcaaattaaatcagcaaagaaaaagttacaacaaaagtcatttggcgaaatatttggagaaaaatgggaagaaaaagaagaagaaaaacgaaatgaactcaaaaaaagagaaataattggaaaattttataaaataaaagagaaaataaagcaaaaaggaagaaaatattcaacaaaagaatggggaaaaattaactcaaaaatagcgaagaaattggggacaaaacgccaatatattcaaaaatggatcaaagaattggggcttaaccaaaataaatgttataaatcaacaactgatgaagaaaagttagaaattgtacaaaaattcattgaaatgacaaatgaatttaaacaaaaaggaaaatattctttaaaagaatggaacaaaaattatgccgaaattt

SEQ ID NO: 61738 - DNA, 542 bp, Heterodera glycines
  Genomic contig location: Contig_ID=SeqID_6479; Location=388..929; Strand=+
  SCN-specific regions: Sequence locations=1-132,172-307,330-492,514-542
atgatttttgctttgaattgcggcttaatggcaatgttttgtgctgcttttgatcgactttttgccgtcatttcgccttttaagtatgttaatgtatttttattgaataaataatttatagaactgtcatacaaatataatataaaatttttcttttctttttttttaattccagtcataatgccattttcaccaaatacaaatcactgtatttgcttggtcatctgtttatttgcacaatttactcatcatttattcagtattgtgtgattgtatatgcatatgaaaatgcgggaaagtatggcacaattaaaatattattaataattgagtttcaacccgtaatcaaggcctgggtttttcctggacctggattttcatatatttttgtccaagataggtccaggcccaggtcaaataactaaaaaaaaatctatgttcagttcaaggttaggcacgaaaagtctgggtttcctggatacttttgagcatttgtcatttcaaaaacaattttgatttcaatttttcaaaaaatgattaaa

SEQ ID NO: 61739 - DNA, 1120 bp, Heterodera glycines
  Genomic contig location: Contig_ID=SeqID_31372; Location=362..1481; Strand=+
  SCN-specific regions: Sequence locations=1-1120
atggcctgcaaaattcggagatgggccgatgttggcctttacgagcgtgatggcgaaacaggactaggcccacgctctggcccaagattcattgaaacgtgctggaatgatctaacacagtttctaaatgatgcctttgttgccgaatatttggcatacttggcaagtatatcacaacgaaaagtagtcgttgttgatcccatggtgtggcaagagggcatgcaccgtgtcacgtcatacaaaaatatgacattcggatacgacccaaatgttcaggcagaagtcatacttttgcccgtacattttcccgcacattggactcttattgtccatgatgttcagtgtggtactcattttgctgattcattgcctgttcccaatggcagactggattggcaacggacggacaaaattaaaaatatcatttctgatattttgccgtcatcagtgttcactggtatttttaatgccgaagtaacgtgccaaaatgatggaaatagctgcgggtactttgtgtgcctgtatgctgaatcctggcttataaacaaccgcacgtttgttctgcctgatttgtccatcaattatgaaaagcggcgcatattatggcacattaacgagctgtatggctctgataatgtgccatatcatccgagggaaggggtgccaactccttgcccaattctctaccgacatgcggatgaagcgcagtcgacatccaaggccgttgggccgatggaagttgatgacagcgatgagataacaatcatcgaacctctgacgaatggaatgaatgccattctcagccaagtccaagtggaaggtgaaaaccaagctgacatgtttggtttggtgtcggattcttgtgtcccacaagagcctattgcgcaggttgacgatgcaatcttcgtcaggccgaaaacgcctcctaggcgatcattgcgcattggcagaaggcaatctgcttcgattagccgttctccctcgcctgcaccaaagcggcgcacatcggcaaatgctgttgatcaaattagggcatttacgcggcgttgctaccttgtccacaagggttggtgctgtgctgccgcagcagcaaagcattatccggaatattcggattctg

SEQ ID NO: 61740 - DNA, 1311 bp, Heterodera glycines
  Genomic contig location: Contig_ID=SeqID_31373; Location=80..1390; Strand=+
  SCN-specific regions: Sequence locations=1-338,361-722,745-1106,1129 -1311
gttatttttctgcagcattttttctcatattcgcaagttccataatcttatagggagtccatgtaagggccaatctaaacattgaaagccctttttggacaaacaaagccaatgcaacagagccaatgattagctatgaagaattatttctaacacgataattggtgtggtggggactaagcagatcctgaagaaactccaccaatgaaaacaacgaaataaagctgaccttttcgtggaatcagacgtaaaaggaactataaatctctagaaattacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacacgataattggtgtggtggggactaagcagatcctgaagaaactccaccaatgaaaacaacgaaataaagctgaccttttcgtggaatcagacgtaaaaggaactataaatctctagaaattacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacacgataattggtgtggtggggactaagcagatcctgaagaagctccaccaatgaaaacaacgaaataaagctgaccttttcgtggaatcagacgtaaaaggaactataaatctctagaaatgacctaaaatggtctacaaaaaagccaatatcaaaattgtaaatatgtcttcaaaacctatcattttttgattttacatatttaataatgttctcctaaattttcaggttatttttctgcagcatttttttctcatattaccaagttccataatcttatagggagtccatgtaagggcaatctaaacattgaaaggcctttttgtgacaaacaaaccaatgaaaccgagccaatgattagctatgaagaattatttctaacccgataa

SEQ ID NO: 61741 - DNA, 852 bp, Heterodera glycines
  Genomic contig location: Contig_ID=SeqID_31377; Location=317..1168; Strand=+
  SCN-specific regions: Sequence locations=1-378,407-618,641-661,683 -706,728-824,847-852
aataaaatgtacggacgacaaagcaataatcattattttccccaacaaaatgtcatgggcatagaagaaagcgcaacaacgagcagtcggaacagcgccggagggggagagcaccgagtgatccgatcggaagtgtggagtcgcttcagactggagggactgaacgcggtttgcttggtgtgcaatgagaagctgaaagtgggccccacgcgacagacgtaagcccagcgcaatgggctgatcaacagccgatcactaattcacgcattgaaggtccagcctatggcgccatctgaagcggcacaaccgcgtggcggcggcccaaaaccaacgcattccctcgggctttctccaaatccatccgcagagccaactgtacatccagcaacagcagcagcaaatgatgcgcaacagaagcaacaacggttttgcggcattgaacggtggcgactgcacaattcaacagcaacaaaagggcgttgtccattcgcatgcctcgcgggcactttctctgcaccaattccgcctccagcagcagcagaaaatggcggcacttcgggcagcacccgcgacggcactgcttcacaacaacaatttccaacaccaaaaccaccacactcaacagcaacagcagcagaattttcgccatctgctgcacccgtcctccgcctcctcctccacgtcaccgttcatccagcaacaatcggcttctcctcccccatcctccgccgtcgaaattccgctcacgcatccgccgctggtgaccgtggattgcaagccggtgcagaaccgggaattggaccaactgctgggcatttgtcgagaggagggggaggaacagcaggaatatga

SEQ ID NO: 61742 - DNA, 885 bp, Heterodera glycines
  Genomic contig location: Contig_ID=SeqID_31379; Location=1..885; Strand=-
  SCN-specific regions: Sequence locations=1-699,728-885
  Gene Ontology: Mol. function=subtilase activity; Cellular component =Golgi apparatus; Biological process=cell-cell signaling
cacccgaacactctcctttgtcaggaccattcccaacggcaatcggctgcatttgcaagtgtacacggacggatgtgccgatcggcgggagcagcaggtcaaatacttggagcatgtgcaagcaattgtcacactgagcgcgccaagacggggcgacattcaaatttatttgacatcgccgaggggtgagtcaaaaattcaaaaaaaattgtttttttcaaaaatttgcaaattttcaggcactcgctctacgcttttggcaaaacggcaacgggacaccagcagaacggggttcaaagagtgggcatttatgaccacgcacaattggggcgaaagcgcgtacggcacttggtccctggagattgacaacgatggcaacgatggtcagtggcaattggcattttgattgctttggttgggttcaacaatttttggcattatttcatgatggaaaatcatgtttatcgagccaaaaaagggctaatttccatgaaatttatcacatttaattcagcatattttttcccaattttttttgctattataaatgccgagagcgaaaattcgcatttttttccatggcattttgttgtgccgcttttatttacggatggacaaattgaaagaaaaaaattccatttattattggacattcgaatgaggatacagttcgtacattttttaaatcgtatcaaaaacaaaaaatttaaaaaaaaattttttttttgtatgaaaattcagccacaaaaaaaattctgccctcactcgcacagatgccgaattgctcaagtgggagctggtgttgcatggcactgacgtgtacgttgggcccaccggctttgagccaaccgcagcggtagctgaacgctctgtgcaacaacaacg

SEQ ID NO: 61743 - DNA, 564 bp, Heterodera glycines
  Genomic contig location: Contig_ID=SeqID_31380; Location=69..632; Strand=-
  SCN-specific regions: Sequence locations=1-564
atgctgaaggcaatgcggcatgtcttcccgtcatgcgagcgctccggctgcaacttccacatggcgcaggcattgttcagaaaagcgaggagcatgggcatttttcatttatttgccgaaaacaatgccgaagcactgggtcaaagaaaatcggttcacaaaacattcaggtaagttttttcattagcaagtctttttttttaattttttcaaaatcagatcagtcctctctttggcactcaagcggaggcatttgaacccaatgcagatgtaggacgcttatttcttcgacgcactcgaagcacaactcgtaaatgcaactattttgtcatgaaaattatgaaaatttttatcaattttagcgttcagtgtgtcccaggcgtccataatgacaggcagtggaccaatacaattcggactgcattcgccataacatcaactccgacgattccattgtccgaagagagcagcttgcacgggctcgtgatgcaaggctttgcggagggatttcacgtccgtggaaattcagagagtggtgaagaaactgaggccgatcaaaattga

SEQ ID NO: 61744 - DNA, 67 bp, Heterodera glycines
  Genomic contig location: Contig_ID=SeqID_6481; Location=607..673; Strand=+
  SCN-specific regions: Sequence locations=1-67
tggttggtttgaaatctattttttataatggggggagggcgatcagcagaccttttttgggttacac

SEQ ID NO: 61745 - DNA, 2906 bp, Heterodera glycines
  Genomic contig location: Contig_ID=SeqID_6481; Location=2606..5511; Strand=-
  SCN-specific regions: Sequence locations=1-40,63-276,317-539,561 -611,633-825,852-946,980-1142,1166-1287,1311-1504,1548-1615,1664 -1984,2006-2192,2229-2625,2648-2906
  Gene Ontology: Mol. function=chloride channel activity; Cellular component=integral to membrane; Biological process=transport
aggcaagcagcgaccagtttgctacctttattccattttggtcaaaatttagcctttattttctctaaatttttaacgattcgaaaacaaataattgattgagatttttcaaaaaaaaatcgcttaaaattctttgaaaatttttttcctaagaactttctcataaaacctttctaattgtaagatattttttttcttggagattttctaagctaataatttttttttatttctcggaggggaaacgatccgggatggatcgagctgctcccattgtttcccctttttgtttcttttccttataatcccttggaataattaaattgctggcggacaatccgtacggaggaattttcaaaatgcaatttctgtttcagttgtttgaccgatgtggtcccgaggactacaccatggatttgtgcgattacaaccgaaacctgacgtacggagttgttgtggacaaagtggacgacaattaccacaccggtgatctcggcaacggattgcatgtaaatgacgagtaacaaaaaccattcgtatttggtttcattttttatttagaccgcttttcttcaattgatcatggcactttttgccaaactgttgttcaccattttcacttttggtgtcaaagtgccgtcgggtctttttgtgcccagcttggctatggtataattttttaaatatatctcaaaatttaaaacatcagcatacggaagcacaaaagaaagagcgtgtcgatattttagaaagaatgatcaattttagcccaaaattgaggcaattttcaatattttaagggataggcacaaaacgggaaagtatataaatttattttgaatttttcagttataaagttaaagaatcccgttttattaacaaaaaaaacttattgtaaaatgacatttttaattgggttttcaattttcagggtgccattgctggtcgtctgctcggcatcaaagtggaagggctcacctacgcgttgcagcagtcctacccgaacagtgagctgtggacttgtcagattggccgtgattgtgccatgcccgggctgtacgcaatggtcggcgctgccgcagtgttaggcggtgtcacacggtgggtattgggaaacaagccattcaccccgtcatcccatcaaaaaaaaatatatatatttattgttttaggaacttgtgaaagttttgactttttttctgggaattttaagtacattttagaattgtaaaaaaaattggattgtatctcttaatttatgaattcagaatgactgtttcgctggttgtcattatgtttgagctgaccggaagtctcgagtgagtgaaaatggcgaaatttaaaaagattaaaaaatacaattaatgcgctaatttataatttttatatggtataataaacaatgctattagttgctttcaggttcattgtgccaacaatggctgcggtgatgtttgccaaatgggtaggcgacgccatctacagaatggtgggaaattaatgggaatttatttgctttatattgttgttattattattattacagtttgaattctgtatttttttatttttgattatcaaaaaagcatatattcattccattagtttgttactctaaaaatactaaaaaaaattatcatttgaatatttttttattaaaaatggacccttatatattattaacttttcagggtatttacgacgcacacattgagctgaacggctacccattcctggacaacaaaggcgagtatccctactcaaccgttgcgggccaagtgatgcggccgagcgcggaaatgcgactgattgaacagcacaaaatgacagtcggcgagttggagacgttgctccgggacacaaactgcaacggatttccggtggtgaacgaccagcgtgaaatgctcgtcgttggcttctgcacacggtaatcattttgcattggttttatgtaattatttttttgaaaattttgcaaaatttcttaacatattttattaaaattgtcaatctcggcggctcctagtggcaccaccggacgaccggaccccaccatatttttgaaaatttttaccctaaaatgacaaaaatttgccattttggcgtaaaaccgccacaaattcctattttttcgctttggcgctgaaatttgaaaaataacactggcatggacctgctcccatcctttttagtttttttttcattttatttgtttaatattaatataagtgattaacacacatctccttcccgtttgttcagaatggatctcagcttggtgttgaggaatgcacgcaaaatgcagccaaatgtgaccaccaattccacggtgcacttctccacagaagcgggcctcgccagccaatcgctccctccgcaatttttggtggccgacgacggcactgtcctcaacggtggcggcgctacagttctcccaccgtctccgtccttcgtccccgacgacattggcacggctgcgtcgacgtatgccgctggcgtatctgcgcccctgcaacttggccacattatggacgtggtgagtgagtgtgggcccgaaatgaaaacattaaaatttcaaaaaaaaaaattcaggaggctttaacggctcctccataccccattttaccattattttttggaaatttgactccatttcgacataagttgtaacttttacgttataaaaacacttcgggtcttctcaaaaaattgtcaagaaaattcgaagtaaatcgctgctcatttaggcaccaatgacagtagccgaccaaacacccatggagacagtgatcgacatgttcaggaagttgagtcttcgaacaacgatggtcacttccaacggccgattactgggaataatcacaaaaaaagacattttgacttttatgcgtgaatgtgatcattga

SEQ ID NO: 61746 - DNA, 419 bp, Heterodera glycines
  Genomic contig location: Contig_ID=SeqID_31383; Location=109..527; Strand=+
  SCN-specific regions: Sequence locations=1-382,405-419
catttcaatcactgggactcaattctccagcatttcaaccgccaacacttaaccctccagcttttcaatcaacgggactcaatccaccagcattccaatcaacgggactcaatccaccagaatttcaatcactgggactcaatccaccaacattccaatcaacgggactcaaccctccagcatttcaatcactgggactcaatccaccaacattccaatcaacgggactcaatccaccacattcaagtcactgggactcaattctcccgaattcaaatcactggactcaatctcatcaatccttcatcaatacaattaccgggactcagttctccgacatttcaatcaccggaactcaacctcagcaacggaatacagaactatttaaaaggaatccagaaattgaaatataacccata

SEQ ID NO: 61747 - DNA, 151 bp, Heterodera glycines
  Genomic contig location: Contig_ID=SeqID_31385; Location=299..449; Strand=-
  SCN-specific regions: Sequence locations=1-57,91-151
ttacagcttatcaaggcccaattaagcttatttccagaaaatctcgcatgaattctcatttttaaattttttatagatttttaaatatttggatatttttttggcttaccaaaacttcatcgaacctggctctttatattctcattcaaat

SEQ ID NO: 61748 - DNA, 561 bp, Heterodera glycines
  Genomic contig location: Contig_ID=SeqID_31386; Location=645..1205; Strand=-
  SCN-specific regions: Sequence locations=1-77,164-286,310-356,383 -513,535-561
atgctcagtttcatttacgcggacgatttaagcgaatttgacggagacaacgcaatggcagtgctttacgcgggtcgaaaaattttttaatttttatgggaatttttttaaaaataaaacttaatattataaataaataattatattttaattataaattaatcaaaaacacattttcctaaaaaaagaattacatcttaccgatcctttgcgtttttcattagataattgttagagaaggaagtaattattgattaagtgtatgaccccacgccacttcgccatcttccccctcccattcccttcatccagttggtaattgtgccccaccaatttggacctcccaatttattctcttcatttttattattttattttcttcggcaaataaacttatttaatttgttatcttcggacataacaacaataatatttatttttttgttttcagctaaaaagtattgcatcgatggattggttaatgaatgtttgcaaattccaattcctcagctgtccaatgttttcttggcctttacccaggctcgactttttgactttgag

SEQ ID NO: 61749 - DNA, 663 bp, Heterodera glycines
  Genomic contig location: Contig_ID=SeqID_31389; Location=694..1356; Strand=+
  SCN-specific regions: Sequence locations=1-479,501-516,556-663
atgctttttttgtcactaccgccgatgatcagcacaacaaccgtagtgatggcggagattgatgctgtggttacggtaccgctttcgctcacgctcacattaaattcgacaaaaatggccgccagattggctgaggttgtgcgttgatgttcatcgggggtggtggtcgtctcgccaaccgccggtggatcaacgataggacctttaccagggaggaaattttaagaattcccgggcatcgcctttcggcacgcgcgtctgacccctaaaaaaattgtgtctcgacgaaataaaaaattttggtttttttaattattggatgaggcttcagcgaaaaatttccaaaattttgcaaaatcgcgacgaaaaaataagagaataaatagcaaaaaaatgatctcatcgtttaactagctcttggtgatctgttgatgaataaaagaggctttccttactatgaattttattcagctctttgaactccttgttgcagggataaaaactgccaaccaattggatctgatcaacacaatctttgcaatttgggctgcctcccgcttccctgcaaaagtcttcgaatttccgatcacatttgttgccatcataacatgcgctgatcacaaaaatatcattcccgttgcctggatgataaaagcttggtaa

SEQ ID NO: 61750 - DNA, 216 bp, Heterodera glycines
  Genomic contig location: Contig_ID=SeqID_6482; Location=1443..1658; Strand=+
  SCN-specific regions: Sequence locations=1-4,26-216
atgcttttgtctcctccactgctcttcgtgctcagtctgtgttcattgtgcgtctttggccataaaacgccgaatgcgtcggatggcccggcaatgccggaactgccgaaagcgctgcaaaagctgagcgacgcggagaggaactgtttgttcaccatttacacaatgtccaaactgttcgagaacaaaaaggtgcagaaaacgctggccaaacag

SEQ ID NO: 61751 - DNA, 2363 bp, Heterodera glycines
  Genomic contig location: Contig_ID=SeqID_6483; Location=22..2384; Strand=+
  SCN-specific regions: Sequence locations=1-156,178-518,540-631,660 -685,716-748,770-793,819-1003,1031-1262,1284-1346,1391-1502,1526 -1557,1579-1614,1636-2363
atgccaatgctacccttcctttcatgcgacagcaaagacacttctgagccggacatttcccaagagtcgggagaagagcaacggatggtgtgaggtgaacttggaaaggatcgacaggtgaagcggaaaaagagcagcacttaattagctgtaattaaaagacaaacaaatgcatttttcaaaataataacagcgaatatggccccgtaattatgcacgcccatggctcaatcgcctctatcaacggcgcccgtctatttgtgaagtcgacctcggggggcatttggatagcgatttatcagccggaatgcctaaaagagaaggatgagtcgaaaaaatcggaggaaggtaaaaaaacaatggaaatggacagccaagcgaaccgaattttggtccgggtttttggtctttctccttttttggtcattttttctcggataattaattggtcaattaatttatttgtttgatttgtcaggtgttgtgagcaacactttggaccgagtccgacgttgggttttgttaaaatgagaagaaaaggaagtgaaagccgacggaccaacaattataaattaacagacaactgctaatgatcaatgattgattttaagtgtaaatttgtttcaattggttttttaaataaaaattattttatttttcttcaaaaatgtttttccatttgttcaaaagtcttgtttgtttgttttccttttatcctttcattttactgaacatgcttttccattaattgattattttttcccaatttcccctcattttcagttaactcttttaaattcaaaagtgtaattagtttataattaattgcatattctgctaatgatggtaattgctcccttatcaatgccatccaatcaatcacttattattctgtgtttatttatgggaatgcagcaccatcctacgcactttgattctttttatcatttttaatttaccttcacttatctttccatctttgcctttttttaattttttcaccattttaaaattattttaaattaaatttgttctttttaattgcccaataatggcattattcgctaattttgctctctccgcttccctcgcttttctcgctttcgctgtttggtttaattcgagcgatttcaaaccaaaagaatttcagtaaataataattaatatccttttaattttcaatttggttcccatttttaaattcgtttcccttttttagtttgccccctccgcccgctttggtcggtcctttggctccaaataaaccaaaaattttggaaaaattattggaaggtcaaatttcgggccccgaatcaattgttatcgagaaaagtaaagaatgaattaaaaaatgaatcaaattaaataattcattcatttttagatgttttatacacttgcacaaccgacggaaaatgtgtgaaaattgtggacggaaaaattcagaaaactgtcccaatgacgggacataaaaattgtgacggtaataattgaagaaatactaattaattaaaaaaatatattacaaaatacatattcgaggcaagcgacaaaccttgccatattgtggccgtccgctgggaatccgtcgttacaatgccaatttattcgtcgttgccgatgccattttgggaatattcgttgtcgatttcgaaaagggtgaaaggaagttcgaattcaaattccaattcgaatttccttttctaggctcggccgagttgttggtctccagttccaagcttgtggatggcaaaaggctgctcttccccgacgacttggactttgtggacaacgacaccattctgttcagcgacgcgtccactcgctttggcatttccgattttctgctcgcttttatggaacacgcggaggatggccggtgaaactttccgatttttttaaagacttgtaataatgttcttttgaccccaaatttcagactaattgaatataaaatttcgaccggacaattgcgcgttgtcgctgatggcttaagttttgcgaacggagttcaaattcacccggacagacaggtgaaactgaggaaaagcccctaattggcgaaaatgaatttaattattcagtcggtccttttctgtgaaagtgccaactcgcgaatccaacggtcacttttttaccattttgaatttgattttgtgcttttcagcttttattatgcgggcccaaaaaagggacgtcaagagattttcgtagacaatttgccgggctttcccgacaacattcgcctttccgccgcccgtcgctccttttacgtggctttgtttggccaccgcagcaaagaccttccggacgcgttagattggcttgggccacggccgtgggcccgtaaatttttgggagag

SEQ ID NO: 61752 - DNA, 807 bp, Heterodera glycines
  Genomic contig location: Contig_ID=SeqID_6483; Location=3987..4793; Strand=+
  SCN-specific regions: Sequence locations=1-44,67-666,689-807
  Gene Ontology: Mol. function=myo-inositol transporter activity; Cellular component=membrane; Biological process=myo-inositol transport
tcgtcttccgctcgtccgtccctcgtcccgtccctttccgccgatgtccccaactttttcctccgatcggtcagttggatttgctcaatcggcggctttttgttcggatattcggcttctgtcatcaacggatcggtgttttattattgcatttattttctgattttgatgtatttttccttttagcttatgtttatggaaagagaattgggcctcaattcgttcaccaagggggtggtgacaagttcgatcattgtcggcgctgccattggcgcgccgatcggcggacatttggccgatcactttggccgaaaaagggtgatgatcagtcttgacttgctgttcattgctggggtttttgccaccacgtttgcgcctaagttttgggtattttggtgttagaaacttttgtaatggtcttttcatctttttcaagtgcctcattcctttccgtgccattcttggctttgccgccggagggcattgttcggtgggccccgtttttctggctgaaatttccacgcccgaaaatcgttcacaaaatgtgactttgaattcgctgttcatcgttttgggtgaattggtcgcttttgctgtttgtgcttctctcggcaacattttcctacaatatgtgtggttctaacacaaaattaaaaagtcatttccattaaatattttatatttttaagcgatttaatttggcgatggatgaatttggtcgttgtgttgcctgccgtcattttgctgttttgtcgctgccttttggtgagggagagtcctccgttggcttgtcggagctaatcgcat

SEQ ID NO: 61753 - DNA, 757 bp, Heterodera glycines
  Genomic contig location: Contig_ID=SeqID_6484; Location=714..1470; Strand=+
  SCN-specific regions: Sequence locations=1-222,246-280,335-472,496 -705,729-757
atggcattggatcagctcggctaccccggcacttttctgctgttggctctgctcggactgtttgccttggcatttgtgtggcgttttatgccggagacgagacgaaaatcactggaagaattggagaaagaattccaacacggcgattggcaagcactgaaaaagccgggtgaaaagcggagaaatctgcgacggaaagtggagaggacattaagcaaaattgaggaggaggagaggggggaaaggtactgaattagcagggcggaggagaaacgacgatttgattaattaattggttgatcagcatctgatcaattgattaattgatcattgaaattttatttcacgatttgaccaatcattttttggtagtatctgatcactgagtaattgctcaatgaaattttttatttttggaacgatttgccaattgattatttgctactgttaatacaatttggtgccttctgttaccgtatctttggtaccgtactctctctgtctttgcgtgcctttcattctcttattttttttctttttctttttctcaacaaatgcattttacgacaaattccattttggtttctttcgtttgcccccacaaaaacaatgccttttttggaggccttcgctaactccgccgatcgctcggtattttgcggtgattaatgattaatggacagtgagtgatcagccgaagaaatcaacgaacacagcggcaaaggaaaggcattgctgtagggaataattcgtggaa

SEQ ID NO: 61754 - DNA, 541 bp, Heterodera glycines
  Genomic contig location: Contig_ID=SeqID_31394; Location=131..671; Strand=-
  SCN-specific regions: Sequence locations=1-208,230-251,273-297,319-541
atgggagttgagtcggattgggtgggggacttgtcacaaaacaggaccatccatgcacagtttttgtttgttttcggagttgcgactttttcattgcttatcataaatagctgtgcaatggggggacggggggaaaggtcgtgtcatcgaactcggcactgccgtaacccaaactattgtcatcaacaaattgaactttaaatagcaaaaagttggccaattttttagacaaaagctgttaacaaaccgcgttaaattataaaaattttttacagcgccgccgcaccccaccactggtctcccaaaattaattttttgaaaaagtgcgccacaaaaaaatcttggctgggcaatcaaaattgaacgaaatcccaagaaatctgccctcggcatcactctttaaacaaaaaaaaacatgggctttagacaaaaaaattcaatgttattgttgtttaggcttccgaccgaccgcagcagcacgaacagatcaaccacaacgacctcctcactttgttcatggaccaattcctcggtccgatca

SEQ ID NO: 61755 - DNA, 785 bp, Heterodera glycines
  Genomic contig location: Contig_ID=SeqID_31396; Location=374..1158; Strand=+
  SCN-specific regions: Sequence locations=1-361,383-495,531-785
atggagccggtgctcagcgatcagtcgcgctgcattgcggcgctgactgatgcgattgacgagttgtcactcaagggaaccgagcaatcggtaaacccatccacggatggaggtccagctgagttggccaaagaagcaccgatgaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttatggaggaccgcgcggtgggggacgcggaggctacaatgcgtatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcttctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccctttttttctactcattttgactcattcccattttacttacctttctcacttttgctaa

SEQ ID NO: 61756 - DNA, 491 bp, Heterodera glycines
  Genomic contig location: Contig_ID=SeqID_31401; Location=840..1330; Strand=+
  SCN-specific regions: Sequence locations=1-491
atggaatacgaaagagaggaacaacacccgtttaagaaagcgatgtgtgggaaaggaatccgcgaatgggccttttggtttatcgtcacttttttggcatgtctcactattaaagatgtggtgaatttggtaaaagattatggcaaaataaagcattgttttcaagaaaattttagatcagagaatacggagaaaacccaaaaaaatcggatatgaatggtaaggacaaaagttgccaacccagaaaactcaatttcccgaataattggctacagaaattaatggaattagtgaatcagttgctactagagtgccacgggaccgggacctggtagcggacaactgagtaccaaggtcccggttttttcccggttttcccagccaaaaattcccgggttttcaacccgaaaaggtcccggtcccgggtttgcccaaaattcccggtcccgtggcactctagttgctactctccattaaaatggtaaaaagaa

SEQ ID NO: 61757 - DNA, 129 bp, Heterodera glycines
  Genomic contig location: Contig_ID=SeqID_31401; Location=1..129; Strand=-
  SCN-specific regions: Sequence locations=1-129
cagcttcgcccaaaatttggcctctgttctctctgacaccaaacggtcaaaggccgaagtcgcggctttctttactcgccattgaggcgagcaattcgtgccacagaaaaccctttgctcggcaccgac

SEQ ID NO: 61758 - DNA, 758 bp, Heterodera glycines
  Genomic contig location: Contig_ID=SeqID_6486; Location=135..892; Strand=-
  SCN-specific regions: Sequence locations=1-83,112-426,469-526,588 -688,710-758
atggagaaaaatggcaagcaatcaaaagattctgttctttgtgagaatggccaagacgtttgtcgtgcgttcttctgcgtagcgagtaattaaaaataatttttgtgccataagttttttttgaaatttgtcaaaatttaatgaaaccgatccatgcaatctggccgattgtaattaaattactaattataattatcacagaccattcccttttattcatccaatgggattgtgcgacattcagcaaaaaggacaaatgcccacaaaaagatggccccaacacggcaaatagcgtaagagtggaccatgggcttcctcagtcggatgattggcattgcgtgtgcgaatttggccaagttggggaggaaatgggcaacgaacacatttacaagatggacccgacggaaccaacgccaatggccggtgaatttttaaattcaaaaaatactttcaattatttattaataacagattcggatgttcgcgcttctgtcagtctactttttgtcctttcctttctctattgtaatttatttttattaattattataatattatttggcaaaaaattaaaaacaaataatttaggggtcattttgccattgtcaactgctctttatcgtcagttgctttctctgacctgggctgattagcaggtggccaatagtacaacgttgtgatatgagagaagagtgccaatgaacaaaggatggatgtgaagagaaataagaaaagaatttcaaatttcaattaataaa

SEQ ID NO: 61759 - DNA, 877 bp, Heterodera glycines
  Genomic contig location: Contig_ID=SeqID_6487; Location=1197..2073; Strand=-
  SCN-specific regions: Sequence locations=1-132,165-493,516-524,557-877
atggatgaaaaaagatttttaaaagtacctaaagaaaaaagacagctgagaaacaaaaaaaattatttttcgaaaacaaataatataccagacggaagttattacacagaaatttcaaatacgataaaagagaatagaaaatttggaataaaggaaaatattgtgagatttatatttaaaaatacagaaaaaaactcaaaaaagaatttcaaaaagataatcgaatatttaacaaaaaatgcaatggaaaaaatgaaaaaggatgggaaataaaaaaaatttcttacgacctttattgtgaggcgttaactgacccattaatcattccccctagggatttggtccagaacaatgaggatgtggtaatggaatcgttttaccacattcaacaaagctttagcgaaattgatttattgaatgaacaaatctcaataataataaccacatacgcaatcccgagtggctcaagtaattaaaaaaataattaaacttcagttatttattttttagggaatcaattaaattcaacaaattattttaaaataaaagaaaatggcagaattttggttgcaaatgacgataattattgtcttttttacgggataattctaagcagattttatcaaataattggagccaacgagtcattcggcatttcatacgatcagtttcggagaatttacagaaataaaaaacgacaaaaaattcatgttttgcaattaatccaagagactaaaattgattcgaatagaacaaattacggcatagatgatcttttgactgtccaagagttttacgacaaagaatttccaggaaaatttcttattgttgcattttcaaaggttaaaaaagaaaaatcttaacatttaaaaataaa

SEQ ID NO: 61760 - DNA, 746 bp, Heterodera glycines
  Genomic contig location: Contig_ID=SeqID_31402; Location=1..746; Strand=-
  SCN-specific regions: Sequence locations=1-10,51-424,447-471,493-746
  Gene Ontology: Cellular component=mitochondrion
actacatagggccttaggaaaagcattggctataataaaaccagactctaatgacttttgaatcaaaaattaattttttttcattttaaggtatcgtaaaattgttgatcactggcgcaagcgaatcaatcacagatgaagcggcaaaattggccagcaaagagccgggctttctctattacactgccggtcctaaaaaaattttaattgcaaaaaaaatttttccgcttttcataaaggtgttcatccgcatgacgcaaaagatttcgatgacggacgaacgttggatttccttcgctcccatttgaccgtaaattcgcaatgtgtcgcggtcggcgaatgcgggttggacttcaacagaaatttctcgccacgggaccaacaacttcgggttttcgagacccaggttttttttttggcgtttttaaatgcaatttcatacacacaaattccagcgttttccattcttttaaattctttatattcaaaaatcgtgaaaatgtttttccgcggggctttgacattcattttatccaattcctaactgatttcaaaacaaacatcgaaaaattatttttcctttttgttagtgctatttttgtttgcgttggcttttccaggtccaattggcatgcgatcttggcaaaccgttgtttgtccatgaaagtgaagcgcaccaagaaatggtggccattttaagtcttgagaggaaatcgttgccgcccaccgtcatccattgcttcact

SEQ ID NO: 61761 - DNA, 813 bp, Heterodera glycines
  Genomic contig location: Contig_ID=SeqID_31404; Location=71..883; Strand=+
  SCN-specific regions: Sequence locations=1-751,773-813
atgtttactcatggcttcattaagtactttgatcgccgagtttgggttgtcgaaatggatccatttgcatatcgaaatgcgttgtcgcgcgcaaatcaatacgctgatcgacgagtccgtcacgcatggcactcaaattttgtcagtgcattagatttttggcgaaatgttggacaacggatgccaatgtttgccgcagttattggcactgaattgttggcacaactgcaggatgagcaagtatttggcaaatttgcagttcgttttaatcttattacgtaaaaaaaaatttctttttttgaaaattgatttttgaaatccaccaaaagttaagaaaacacattaagaaattcttgttttgccgacttaaaataaacactaagataaaatccatttttgagaagaaaaaaaagtttagaaaactactaatctcgattttgtcgagatcccgatcccttccttatttcacaataaaaccgggattggcgggcgggatacggtaatcctggcgagaacttgatcccttccactgaaacattttcaggaaatcctgtaaaaaaaccaaccccaaaccccacataagccctagtctatgcttaaaaaatttatttagttaagatttcgggggattaacaaaagatttaacgataattattttttgtcaagatataattgttctataaaaattttttccctatttgaagcaaatgcttgaaaatggagcacagtttgccaccgtggaagtgctgggcactaaccaaactcaaagcatcgacgacaaaaagctcaaagccactttggtatgaatattta

SEQ ID NO: 61762 - DNA, 979 bp, Heterodera glycines
  Genomic contig location: Contig_ID=SeqID_31409; Location=531..1509; Strand=-
  SCN-specific regions: Sequence locations=1-403,425-470,517-529,553 -704,726-737,761-979
atgacgcattgctacatcattgtaattttgatcacttttgtgttctgcttctgcttccgcgatgatcaaaaagtgttggcaggtggttgtatgtcatgctcaaaagcggacgacggatctggcattaataatccaagtaatggacgaagacttgtttcaattattgacctgccaactccaactatgcatggtaaaatatacactaatttgaccaaaaattcgggagatttctatggacaacaatgaattagaaatttttaatcgaattcaactatttaatgataattctaacttattttaaatattcgtatttttcatattttcgaacctcctttttacggtttttttctcaaatgctgaaaagatatcttttgggggttttcgtgtaacgctaaaaatgctcacttgaaaaaacaacaaaatgcttaaacagatcaaattaacgacaataagccaatcaaattcgtatgaaaattactattattatttgttttgataatattttaaaatttttttggcatgcatttgttttatttacatgaaaaatattttgtctgttatgtcaggctcgtcgtcaggtagtaaatctggtcgaaaagctgcgaggaaggtggaaaaattggagccaagacttgtttcagttgggcaaggcccaaccatgcgtggtaatgctgcatttaaacaatatacttactttttgttaattttaaattgtttcataattaattcagaatatattaatgctggaaaagaagaagcaaggaaaagcagcttctcaacacctagccatgaacttcaacagtttcgagcagcagcagcagcagctggagatggacaacgacgggggaaaaagacggacagaaaaaataagtaaaaaaaattagagaaaaaatagacagatcagttaagaaaaaactaagagaaatgattagtgtattttttgatgttaaaagtgatcagaatttgttgatttaataaa

SEQ ID NO: 61763 - DNA, 310 bp, Heterodera glycines
  Genomic contig location: Contig_ID=SeqID_31410; Location=480..789; Strand=-
  SCN-specific regions: Sequence locations=1-167,235-310
atgcgaacggacaatttgtgccaatggctccaaattcgacggattggaagaagaagcattgccaatgtctttgattttcaatacgagataatcgcttatcgtaaattcactaaaatatgtaagtgattaatttatatagaaaaaagtatgttggcttaattatatgctattaaaatttttttgctttttaaatattcttttaaaatatttttaaattaaaaaaatcaaaatttacagatgacaatttgtagtcgtcaccgttttgtggtactgttaattgactgatcacttgttcgtaaacaataataaa

SEQ ID NO: 61764 - DNA, 422 bp, Heterodera glycines
  Genomic contig location: Contig_ID=SeqID_31411; Location=410..831; Strand=-
  SCN-specific regions: Sequence locations=1-422
atgggcttgtatgtgtgccgtttgttgaccgtgatcggcctgttgatgctgctcggcggtgcgatggcaattattgtcggctattgttggccacggcaacaaaacattgagggttggttggcatttgtttaaaatgggaaaaattggtacaatgtcggagtctcattcatcatccttaacctattttcaaggacatgataaagcgaacaattttcaagggcagaacagacatttttttttgttgttgccattttggggtcaaattttcaaaaataatggtacaattttttaaaggtgagctgatgaaaattgcaattgaccaggatgaggaaggtaacttctatgtgttgccggagcggcttactgaaatccttgccgacccaatgcattcctggaaaattactggtaattaaaaaaataaa

SEQ ID NO: 61765 - DNA, 1106 bp, Heterodera glycines
  Genomic contig location: Contig_ID=SeqID_6489; Location=1644..2749; Strand=-
  SCN-specific regions: Sequence locations=1-77,99-211,233-474,529 -558,580-1106
atgcttacgactctggaagagctcaaagccacaccatgtggcactcagcttgcgtaagtgcttgaattagtaatttgttttaagtaaaattgttaaggtctttttgtgggcagattgtaagcattttaccgtctgagaagaagttgacggctttgttggcgtgtgcttctggggagaatgttgttctcacagaatttaagagcgtgtcgtccaaattttcaaaaatttgttcccttggaattgtaagtttgctgtttctttttacagtgcttaccttactaaatacaggtcgtcaaattttacatgctgaaagctcaacgctttcaagagcgtttcgatggaaagacaatttacgttacgccactggattatgaatttgtggtgatgactttcacaagaatggaggtgattcaatgtgccattgcgactgcggattcatttgagaaattgacttcgggttgcatttattgtgagttttaattttttttattaatttataatatattacttggtttgtaaaagtgtttataaagcaataatatactcttcgtgcttttgataaacattagtgtttgttctgtgactttcgtgtgagacactaatgtgtgtcatgcttttgataaagcattagtggtttgttctgtgactttcgtgtaagtcactaatgtgtgtcatgcttttgataaagcattagtggtttgttctgtgactttcgtgtaagtcactaatgtgtgtcatgctcttgataaaacattagtggtttgttctgtgactttcgtgtgagacactaatgtgtgtcatgcttttgataaaacattagtgtttgttgtgtgactttcgtgtgacacaataatgtgcgtcatgtttttgataaaacattagtgtttgttgtgtgactttcgtgtgagacactaatgtgtgtcatgcttttgataaaacattagtgtttgttgtgtgactttcgtgtgacacaataatgtgggtcatgtttttgataaaacattagtgtttgttgtgtgactttcgtgtgacacaataatgtgggtcatgtttttgataaaacattagtggtttgttctgtgacttttgtgtgagagataaataaa

SEQ ID NO: 61766 - DNA, 753 bp, Heterodera glycines
  Genomic contig location: Contig_ID=SeqID_31414; Location=236..988; Strand=-
  SCN-specific regions: Sequence locations=1-93,153-179,202-322,346 -411,442-638,696-713,736-753
gattctgcctcttttccctgatgatcatgctcaaaaatagcggcaaagagctgcatctcaagtacatgcccggttttgttgcctacaacaaagtaaaaaatagaaaaaataaattaaatttttattaatataaaattaattgaatttaaatagattatacagatagtgaaaatattcggtaattttatttcttcaaatgcaaaatcattttttgtaatatttttgagtcataaaattttttgggattttatccatttttagacaaatttcattttattttccagaaatttctagctttttagcgcactgccggaccaccaaattcttaacaattttcaaaatttgactcacaaaattggtcatttttgctgcacaatttgatgttggcttcgaaattttcttattttacacaaataaatttatttttttatatttttatttgaagaatgtaagcgacagcttacgcgacttcgacatctcaaaaaccgccgatgcagatgctattcgtgccaaacacattgacaatgagtacgcgttgttccaaaagaatcaaagttcgacgatggcattgcgcggcagtttggttggcgaggatgggcaagccgtctatttcagcatttggagcaagtaaagtgtactattattttatttatttattttataattatgcattaataagtttatatattaataatgtgcttgactcctttccgagaatgggagaaacgtttcttggctcgagaaaaaattaaa

SEQ ID NO: 61767 - DNA, 1288 bp, Heterodera glycines
  Genomic contig location: Contig_ID=SeqID_31415; Location=211..1498; Strand=+
  SCN-specific regions: Sequence locations=1-263,305-340,368-564,625 -1036,1058-1288
  Gene Ontology: Mol. function=metallopeptidase activity; Cellular component=basement membrane; Biological process=development
caatttgtgtgttcagttccgttcggtgacgtgtcgaagtgccaaggagggcgaggagggcaaaatgttgccggccgaagcatgcaccggccaaatgccacctgaggagcgcgattgcaacttgggcccatgcaaaggcctccgttttcacaccaccgaatgggaattggtcagtttgtgtttattcgtatcagggattatagcctgatcaattgattatcaataatgattgtttaatttaaatccccggggattatagcctgataaattaattgattaaaaataattattgattaatttaaatccccccgacggattaaagcctgatcaattgattgatcaaagataatgatcgattaatttaaacccccgaatttttggcatagtgccaaaagtgcaacgacacggaggaaacacgagaagtgagctgtgtagacaaaaatggaagagagtatccgctggagaagtgcttggatgggaagaaggtcaccaaaattccggaggacacgaggccatgcgcaagccaagcggtcagtcacaaattttcccaattctgaccaattaaaaaataattctgatcagttcttaaaagcattttcaaacaaaagtattcaaatttgaaaatttttttgttttattgttggcattctgtttagccttgcgtttatgaatggcacacatcgcaatggtcaaagtgcagcacggaatgtggacatgggcacaaacaacgaaaggtccaaccaaccacagacatggctaattgaaaacattcgaaaatttattttgctatttcgaaataaatttactgtgaaaaagaaggtaccttgttttaaaattgtggtttggttctcgagtgctgggaatttttctatctcgggcagtgttttttgagattcccttgactataaaaatttttcaatatttttagttttttctttggggagggggtggcacaacattaagggattgggacggtgccgggatcgttactcaaaaaccatcaaaaaattacaacattttttttggaaggcagcacaaatttagggagggcggggtgcagggacactgttgtaagcgatacagtaaccttggtaaaatccattttcgaaacgattatggtaccaaacgccccccgcatttggcttccttcacaggtgttctgtgccatcaacgagctgggccaaaccaagcgtgtggatgaagcgctgtgtggccaaagcctggaggaaaagccggtggctcgggaggagtgcgtcaacgaggagaaatgcactgtaaacatgtataa

SEQ ID NO: 61768 - DNA, 765 bp, Heterodera glycines
  Genomic contig location: Contig_ID=SeqID_31416; Location=450..1214; Strand=+
  SCN-specific regions: Sequence locations=1-765
atgcgacgacgtttggttggacacattggcatggatcaatcgtgtagaagtcggcatgaagttcgcgctggtcaatgttcggttaaacgctttggcggacaaacatttcaagcagaggaagtggtgcttcggcgagtttcatatctgtgagcggatgacggaagaatcgggcgcagaaatcatgacatcgatcgacggctccgacttcagcacgttgccactgcccaccactccgttgccggacagtgtcgtcggcttccgatcaatttccatttggtcgtcatttgctttccaaattcatttttctaactgccttctttctgcaggtacatcaatgaagaggtcgtcaattttctgcgcacaattcgccgtctcctcaccgaagacattgcgctggaattctccactttcttcacggaatatcgcagttggaaagtgatggcacaacacatttggccactgttgaaagatgggatcagcaccttgtgcctgaagaagtgtgacttggccatgctccgtaaacacgtgtcgcccaccgtgctgttcgactgtgccggcctgcaccgaatccacacgcaaatgctgcccgagtgtccgtctgctgacggtgctgtcgatgaagagaatgttgttgttgacacgacatgccgtgaattgtacacgtgggttcactcacctcgtgaagaagggcacggaccggtgtcactgaagctgaacaaatggaaggagggcaaatgggacaactttgtgaacaacttgaacaag

SEQ ID NO: 61769 - DNA, 535 bp, Heterodera glycines
  Genomic contig location: Contig_ID=SeqID_31418; Location=567..1101; Strand=+
  SCN-specific regions: Sequence locations=1-535
cccatcgccgaattcggtccggtggcgatcagacaaccgccggaagtgattgagggtatgaccgactggtgcaaggagaccttttcgaagaacggactgattgaacggatcaaagccagcgacaaaggcgaacgcgagactgaaaaaatggtgaccgatcgaggaggggaggggacgctcaagcaaaaccaatgcattgatcgattaaggtcttggactttctgcgtgagcatacgccccccggggagtgtctgttggctggcagcagtgtgcaccaggaccaggtgttcttgcgcaagtacatgcccgagttgtgcacccatctgcacccgtatcgcatcatcgacgtgaccacagtgaaagaggtgccgaggaagaccagggattcttcacttcaaaatcaatgtgaatttctcacagttggccaagcgttggtatgagcacaccgagggatggaagaagttgccgccgaagaaagagatccatttggcactggacgacattcgcgagagcatcaacattttgaagtattgcc

SEQ ID NO: 61770 - DNA, 104 bp, Heterodera glycines
  Genomic contig location: Contig_ID=SeqID_31418; Location=53..156; Strand=-
  SCN-specific regions: Sequence locations=1-104
gacaaacggacccgtttttctccaatcgactttcactgcccaataaaatgcatctttttcctcttttgctagtgacattcgcagttgctggcttcctctcattg

SEQ ID NO: 61771 - DNA, 472 bp, Heterodera glycines
  misc_feature (192)..(192): n is a, c, g, or t
  Genomic contig location: Contig_ID=SeqID_807; Location=345..816; Strand=+
  SCN-specific regions: Sequence locations=1-31,53-73,112-351,373 -401,423-472
atgaaaactcttcgcagtcaagcgggccgccaatcaatgccaatggtggtgaattttggccgggtaaaaactcaaattttttttttcatattttaaattttaaaattatttcagactggggacgggcaaatgtttggacaagtcgggggccgccaatcgtcgatgtcaccacctgttgtgccggtgaatttngggcggcgtgccgccgtaccaggtacaacaaaaacaaataccttcgcttccatcgcttccatttcttacagccattttttttttgaaaagggcctgcaaacgcaacagcgcgaggtgatttacgatgtgccgacggatggtggtggacatgaacacgcggaagatgatgaggacgacgacagtttttgaacgatgagccgatacaacaatgagctttaattcctcataaatttttataaaatttgggaattttcatttcacatttaacaaaatttggcta

SEQ ID NO: 61772 - DNA, 360 bp, Heterodera glycines
  Genomic contig location: Contig_ID=SeqID_807; Location=1284..1643; Strand=+
  SCN-specific regions: Sequence locations=1-200,223-360
atgtccgacagtccaacgcccgaaaccgaaataagcattgcatgggacatcctcgaaaatgataaagatgtagtaaatttttttctttaatttgaattcaaatcttatttatcatttttgcagtggtacaactggttcactccaacgaccgccaaacaagcgtgcgtcgaggcattggcattcgcgcgagaagggggactaaagcacgagaacattctgaaaataatgaagacgcttgaggagagagaaaagcgtgacaagaaatgaaatgtcgatcgatgaccgatttgttgatagtgatgtggatatatgatcatttttttttgggacatttaaaaaattggtgatgaattttgtcaa

SEQ ID NO: 61773 - DNA, 781 bp, Heterodera glycines
  Genomic contig location: Contig_ID=SeqID_807; Location=1842..2622; Strand=+
  SCN-specific regions: Sequence locations=1-19,41-372,396-583,648-781
atggccattaatatttcggacaccaaatcgcttttcaatcaaatcctcgcccagtccgatatcaccataaccacaagcggcataactgtcagtggtccacgcctatcgaccccccgttttttaccgtttgacgattgtggacgctgccgcgtttgcaaagcaaccgaggccgaggtggacacaatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccgggacgtgtgccaaaagcaaaccgactgaccaccaacaacaacaacaacaacaacaggacttgaagcgcaaggcaaaggtagcacttgacttggtggaggctggactaatggccgatgctatgcaggacggcgcacggtggaagaaggccaaaaccgctatcaatgtgcttggcaatctcctattggctgaatcgttggacaatacttccgctcctccgctgaaaaatgatgccgtggacatcaaaaaagaagaagaagaagcaaatgtggcggaagaacacaaagaagatgaccaacaaaaagaagacctcggagacattgacaaaactcttgacgacttctttaaaagccttaatgcttcaacctcaaatgtgcctatttaagtgaataatttaacacacatcattttctcaaaaatgttaaacacacaagcattcacca

SEQ ID NO: 61774 - DNA, 6054 bp, Heterodera glycines
  misc_feature (103)..(104): n is a, c, g, or t
  misc_feature (6035)..(6035): n is a, c, g, or t
  Genomic contig location: Contig_ID=SeqID_808; Location=136..6189; Strand=+
  SCN-specific regions: Sequence locations=1-31,53-113,135-1354,1376 -1800,1822-1989,2014-2035,2057-2251,2273-2393,2415-2700,2722 -3209,3231-3696,3718-4769,4791-5931,5961-6054
  Gene Ontology: Mol. function=structural constituent of muscle; Cellular component=sarcomere; Biological process=cell proliferation
cacctccacggctcccttccccacctcgagcgaaaccaaaaccaccaccacgccatccgaccacaaagagagagcaacacaagccaaaaaagttggaattaannccaccaaaaatagagccaaaatttgaacccgattcacgaccatcgacatcaaaagtcgcgcctcggtcgaaaaaagagcctgaattcccgcttgaccctcgaccatccacatccaggcaagccggatacattcctcctccggcacccaaaattgtaccaaaacatgagccgacaaagagacccgtgccataccgtatcccgaaaagagaacccaaaattgttgaagaaacgccacagaggcaacagcaaccacttcctgctgctgtcgtcgaagaaatgcctcctgttcctccgcctaggagggggaccaaacgccgccaccccgtaaatggtgagaatgatggtgaggtgcgcataagaaaacgcgtgaggcaagcgaggagggtgcgagtacagtactcacccgagccgggtccatcaacatctgcacaaagtgatgaacaacaacaacatcgagaactgtttaccatcccgtcaaatcagctgaccatgaatcagcgggttgaacgactgtacatcaaatgcaaccgttatgcggatcgtatgggtgtccgtggcaatacaattaacaccgcaaacggcaaaccgttggcgcatagcaatttgcgaatggccatcaggtatataattgacaggagagcgggccgccctaccattaagccacctggagcggccatatttgaagagaggcttaggcaagatccaattttgtattcatggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgttcgcaggtgttacagcgctgtggaaagaggcgcgaaaaaagttgaaaaatttacggaagagggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgaggagatgttggaggcattcagacaactcatcgaccaaatgccaatggtcccacatcgcatcttctccgacaaaggcaccgaattcaagaacagattgttgaaggaattctttgatgagcaggaaattgagaagcatgagccagtgcattcatcagtcaaggcgtcggttgctgagcgggccatccggaatgtgaagcagcgactgtaccggtattttgctgaaaaggagacgttgaattgggtggatgcagtacagaaaattgtggacggaattaacagcgctccaactcgtgttcacgggatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagggatatttaccaaattatggagacgaaatcctggagattgatgatgtgttgaaagcggtgcgcccaattcggtacaaactgcgggatgagcacggtgagaaattcaagggcagcttttatgagcaggagctggcgcgcgtaagaaaagatgcaaacacaagctaccgcatcgagaaggtgtacagaaagaggaaaagagcggatggatccacagagatgcttgtcaaatttataggatatcccaatcgggaatggattaatgagtctcagcttgtataaaagcatgtgcatttttcatttttgttgtgataataaacaagcatgtcaaacagtttctttgtgtttttgcccagcaatgtaacggattacccggacaatcagcccaacaaatttcgtgtccgactcccaaagcctttgcattttaacggctcgtgggtgtgtggactgcacagtatcagttacccctattcgtggtccaccatcggtacattggatgagcagtggattgacattcatttcacagaccgaagcactatcgatgaggaccgacagcgggtaatccgagtgccagtgcccaaggcatcggttaacagggttgaccagctcagagactttttggcagtcacattgcggaaccgtagcggagcaaagctgttgccactcccacgtgaggtggaagaggatcgaaatcgtactaaaccccttcactctccgccaccactaaagagaaacaaaagggatgcgtcaccgataccaccaccaccaccagacgagagtgaaaaaatcgaagactctcccccattgtacgatggaaatgatgaggacctgattgaggactctcccccattgtacgatggaaatgatgaaggggttattgaggagtcaccgccccattatgaagaaacaccaaaagaaactgtgaaaacgacgccaaaagtgtcgacaccaccgcctgtctcaagccctgctaaaccaacaactgtaaaaccgtcagctcctcctccatctgtcacaacaccagcgcctcccacaattgcaaagccaccagtaaccacccctcctacaaccacaaaaccaacaacaccgatccctccaccagccgtacaaacaacaacaccggtccctccaccagtcgtacaaccaacaaacatccctaaacctgcaaagccacaagcaaccgtcactgccctgaccgtaaagcccacaacaccggtccctccaccggtcgtacaatcaacaaccacccctcaaccgacaaagacaccagtaaccgtccctcccccggtcacaacaccggtgcctccaccaccaaagacaacaactacgccaacaataagtaaggttccgagcccatctgttacaattccggcaccgccagcgcaactaaagagttcggcactgtctccgaaagcacccatttctactgttaaaccgccacctccagtttcgctttctgctaaatctaaatcgccgccatctcctccggaagaatctccaccacactatgatgaagaaaaagacataaccgtaaagccaacatcgcctgtaaaaccaacaattactgcgcctccagcacagttaaaaagtccggcagcaactcaagtcatcaaacctcctcaacagccaactaaaccgttggctccgcctccaggcgctccacctcgttttccagctgctgcggtgtcaccacccccgccgacgtcagcagctcaaattgacccgtcgcgtttgattcacacactcgatccaccaaaaatttatttcaaaactcctccggccaacgttgaccccctgacatatgtgccacattcggtgtttattttatatgaaaacaacatggaacgattcaaggtggtgttcaatgaggagatcatcagccatttatccttctcacctcagctgggctatgtgcttggctttgaaaacccgcaacatgtggtgtcaaatgaagttgccaaatacgggtatgacttgcgcggcggcatctcaagttttgcagtttactcaaaaggattaactgagaacatgataattggcaattcactgagttccttgctccgagttgtgtccattagcggtgccacccccggcgactacactgagaagatttatgactcgccaatatttgcgagagtgttgccacgggagataaacgagattgagattgagctgcgcacaatggacaagggccgcctcgtgccgttcgcctatgggacaacgatgatcgtattgatatttaagaaagtgataaatttttgatttcatcattcattttgtttttgatttaacatttttataaatggttcatattgtgtttgacccaagcattgccgggtatgatgagtacgtgcagtacggtagtggcttagaaaaggaggaattcgactacttccgcgggtccagcccctttcaacgggggtacggcattcaacgcggggcgggcgttggggatgtgtttcgtggactttggcgctttttcctgcccattcttcgtcgtgttggaactacggtaggctcagaggcactgagcactggccaacgggtgttggaacgagtcgggcacgagggggtgccgctcaaggaggcgctggtcagtgagggaaagcgtggaattgatactgtgctggagaaaggcggcctgcccaaacagtttggaagcggaagaacgggtataaaaagaaagagaacacatgtgcctggtcatcaaaccataattggacgaacagtatcaaagccagcaaggaagcgcattcgctcggacgcatttggactttattaatcaatggcatttcacaaaattgacactgactccgtgaactcaatcaccaatgctttggactttttccgcattcccccgaccaatgtgagcgtctcttcgtccaaagtgtttgagctgctgcctagcaaccctctgaccgacacaccataccacttcaaactgcactcaagccaaaactacattgatctttccaaatgctatttgctcaccgagtttcgaatccataaggaaaatgctaatggacaacttgttaacctaaccattgatgatataaacattgcaccaatccaaatgattggccaaactttcatccgtaacataaaaatgagcatcaatgggcgcgaaatatttaatgccaatgcactgatggcctacaaaacatatttttcacatgagctttcctattcaacaacggcaaaggactcccatctgaatgcatctgggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaatttttgtgagctggacattgaaatattgcccaatgacaacgagtttgtgttaatcgcgccgaccggtggtcggtaccgtttcgaggttgtgggactgaaattatatgtgaaaaaggtgtctctgatggacgggttggcattggacattgcacgaaagttagaggtgaagcctgcccgttatgcagtgaggaagacaatgatgaagtctgtgttcatcagtccgggtcggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttgtactacccgaacggaaagtatgttcgtccattcaatgatatgaacgaagcggtgggattcgcaaattcatctgagagcaatggcataacttttgcccaatacggcaaaacccattgcatttacgtgttcaatttgaccaacagcggggatgatcaagcggcactgtttgatttgataaagaatgggaccacagcggtgagcattaaatttaaccatccagtgcccgagggaggaataatgttggtggtgatgggcgaatgtgactctcttgtgatgttggacaaaaatcgatcgataagcaccgataccactatttaaacgcgcatcacattgtgccatttcatttgcataaaatgtattcaaaaaaattgggtatcattttgttcttgctccgcgtttctattcctgttgtttcaacattccatgaacaaccgcaaaagccaccgccagagaatacatattctgcttatttaaaaaatttgactttgtctcggcaacaacagcacccagaatattcctacactgaatatctgagaagctttaagggtgtcaaangattactacgacaacaaca

SEQ ID NO: 61775 - DNA, 432 bp, Heterodera glycines
  Genomic contig location: Contig_ID=SeqID_31422; Location=66..497; Strand=+
  SCN-specific regions: Sequence locations=1-392,414-432
atgctcatttgtgtgaattatgcgtcctctttttcgcacagtctcgactcggccgactctgagcttcaacctcatggaaagaagcgagcaaagcattacgacgacttgcccgagcagtcgtacgggcccgggtcagctgactactcgcaaacgccggctgaactgcttgaaattgccgaaatggaccctgacgatttgtcattcaagtcagtggaataatgggatgaaattaaccaaaatttcatgaatcaaacaattaaatcagcattttactggttcaggccaaagcagacgggacagccgcagaaaagtgccaaagggaaagcgattggattcagaaagccgggcacaagccatgcaacgaaatcattcagaaaggcaaacaaaactgaattttgaccacaatttcaatggttaagattttgctgcgga

SEQ ID NO: 61776 - DNA, 1833 bp, Heterodera glycines
  Genomic contig location: Contig_ID=SeqID_31425; Location=67..1899; Strand=-
  SCN-specific regions: Sequence locations=1-52,74-162,185-513,535 -1609,1632-1833
atgatactgatcattgcattgcgggacgaattcaccgatctgaggcaaaaatgccttcagcgcttggaagaaagtcgaacgagcggacggtcaacctcactgcaagagcttggagaggagtgccgaaaatatcaaatcctaaaggaaagcgcgctctccctcggctcaaatccctgcagcaccagtgccatccgagccaaaccgcagcaaatcagggacaagcagaagcccaaaacgaagccgcagcaaagccacaaaggccaaaatttcctgccgaaaaattcaacggcacctaaaggaaaagtggaccaacgtgatcagccctgctattcatgtggaggcaaaagtcactggcaaaaagactgctggttcaaaaactcgacgtgtgaaaaatgcggacggaacggtcacattgcgaaagcatgcaaaagcggcacagagatccgacgtgttcgtgcagtggttactgattctgtgaaggacacgcacattcacaccgtctcaattaagccaaaatgtatggctattgaaggaagcagcaacaaatggtgggaagtgatcatccaaatcaatgggatggatcacccaatgaatgtcgacaccgctgcccaaatcacggtgatcaaaacagactcatggcaaaagcttggcaaaccaaagctaggcaaaacggccatcaccgtcaggaattgcaatgaaaaagcattcccaatcgaaggcaaattcaaatgccaagtttcgtacaaaggacgaacggcaagcctaattgcttacgtcagcgacgaaattcaccaggatttgcttggcatgccttggattgaagaattggaaatcatcccgaaggaattgatgtttccaaattcgtcacaaatcgtcaattcaatgccaacgaagccaatttcatcacaaatcagtgatgaaaagtcactcatttcggcacttcaaaccaattacgccaacacttttggacctgaacttggccattgcaccaaattcagagctcatctgatcctgaaaaaggaggcgaagccggtctactgcaaggctcggcctgttcctcatggagcattggatgaagtcaatgccgaaattgatcgtctttcaaaaattggcgcaattaaaccaatcgagttcagccagtgggcggctccgattttggcagtgaagaaaaagagcggaaaaacgcgcgtctgcatcgatttttcgaccggcctaaacgatgccatcgaactgcatcgccacccactgccaagaccagagaacatctacaacgcagtcgccggagctaaatttttctcacggcttgacctgcgtgatgcctatctacagttggaactgtcggaatcatcgaaaaatctttgcgtactgaacacgcaccgtggcctatttcagtgccagcgtttgccgtttggagtcaaatcggcgcccgcgatttttcaaggattgatggacaaaatcatagccggaattccaggcgcattcgtctatttggatgattttgtgatcgccaataaatcactgatcgatcacacctcaacaattttcgcggttttcgacaaaatcagtgaatatggccttcgaattcaattggaaaaatgcagtttcctgcaaaaggaaacgcttttcctgggccacattatctctgaaaatggcattcgacctgacccatcaagggcagaagccattgagaaaatgccggctccgaccgacaaatcaacgctccgatcattactcggcgcactcacttattacggcaaattcatcaaaccgatgcgagagctcagaggcccgctggatgaattgcttaagaaggaggccaaatgggaatggaaa

SEQ ID NO: 61777 - DNA, 776 bp, Heterodera glycines
  Genomic contig location: Contig_ID=SeqID_31430; Location=90..865; Strand=+
  SCN-specific regions: Sequence locations=1-372,394-660,683-776
tgccattctgtccaacaaagtgatttgggtggtgtggctgaacgcatttgccgacattgtgactgctgttttcctgatcacctatttgccaacttatgtgtccaaagttcttggctacggcgtgcgcgaaacgggcatttggagtgcggtgccggcactgttacacatccccgtcaaaattggggccggttggatggcggacacattgacgtgaatagcaaaattaaaatttaaaaaaaccattatttaataagaaatccctcaccaagggtgaaaatttgttcataattattttttcgaggcgctaagcattcgttttcgaagccgagcagaggaggataggagaaattttacttaaaaaccgcattttaactaagtttttccggcttattttgtgacaaaaattttcctgacaaatcggtcaaaaaaatttcaatagggcgcctttctgcgccgacggggctccttcaaatttttgaaaaaaactagctaaaaacatgcacaaaaatgactgtttttacagggccgggtttaatgaaaaaaaattttgtttttatcattcttaaaattccatgttctttcagttgcatgaacgagttgaaccgaatgcgcgcgttcaattcggttgcgctggtcggctctggcgttttgttcgcattgaccggctttgtgccaaaagaaatgccatttttggctgttattctgatgacattgaattttgctgtcgtctcgacaaattgtggtggtttttataagtgtgccacattgatcagtcg

SEQ ID NO: 61778 - DNA, 154 bp, Heterodera glycines
  Genomic contig location: Contig_ID=SeqID_31433; Location=769..922; Strand=-
  SCN-specific regions: Sequence locations=1-154
atgggcaaaactacatcagaaaccaggttttcagtcatttttagccataacttttttgaaccttaacaaaaattttcgaaattttcaggctaatagaggatacaaagtgctatcgaatgataccaacaatgttgggcaaatctatgtaaataaa

SEQ ID NO: 61779 - DNA, 559 bp, Heterodera glycines
  Genomic contig location: Contig_ID=SeqID_31434; Location=530..1088; Strand=-
  SCN-specific regions: Sequence locations=1-179,201-347,369-477,512-559
atgcaacgcctggacttggacataaaaaatgcagaaaaacgagagcaaaggttttttcattttgctaaagtaacacaggcgtacaacttttgttgtttcgtataacctaataatttaaaaactaattctcattatgccaaaatagttttactattgcattttataaacccaaattttgattgccattttctttttcagtttgaaagaggaggcgcgcgtggcactcggacgaaaggataaaaagggggcgttgaacattatgcggaaggttgcccgagtgcgcaaggacatccaggacaaagacgtgcaataccaaagactgttggcaatgctcgagcagttggcggcctccaaacagaccaaggaaatcatcgacgtgtacaagcagggctctaacgcattccgagagaccatggctagacagggactgacaccggacaaagtcagacatttgatcgaattgttgggcaacaaaatgaaatttttgcccttttttaaatggtttcaaaattctaacggatggtgtatactattgagattttttgattgctcactgtaa

SEQ ID NO: 61780 - DNA, 1131 bp, Heterodera glycines; identical to SEQ ID NO: 31436
  misc_feature (1102)..(1102): n is a, c, g, or t
  Genomic contig location: Contig_ID=SeqID_31436; Location=1..1131; Strand=+
  SCN-specific regions: Sequence locations=1-163,186-196,218-263,285 -620,642-1131
  Gene Ontology: Mol. function=histone-lysine N-methyltransferase activity; Cellular component=nucleosome; Biological process=histone methylation

SEQ ID NO: 61781 - DNA, 756 bp, Heterodera glycines
  Genomic contig location: Contig_ID=SeqID_31437; Location=423..1178; Strand=-
  SCN-specific regions: Sequence locations=1-193,268-756
atgatgctccgcaatcgcgatttgaacgtgcagccggctgcaggtgcgggtgctccactgcccaagcgccagtcagctcatttggtaaaggtggttggtggcgccagcggccgtgcttcatctcagtcttccgccgggtcggaccgggactccaagtacgagccgaggccaaagcgtgcatgcagccagaaggacaaggaaaacagccactacaacaacaacaatcacaacaaaagcagtcataacaagtccaaaaagaacaccagcgggggcaccgtcgttccggtcacggtatgtgctccctgtccagttgtagtgtcaaaatgtgtcaatcaagcggattttcagccaaaatggattcacgccgccggggaagatttttggcctttttaatgaatcagttaagaaaattttcaaaatttgcccctcccccccccccccccctcgctgcgaatccgctccccctgcctcttacattacaccggccccccttcgctgcgagccccctttgcgagcgaggggaggtccgacccccttaaaaaatgcttaaattgtggggattaaccattccttttcaaggctttttcacggtcgctgctcatcgattcggccaagaaggacgtgaccgttgtgtcaacggctgtcgatgccggcggcggtggggtgcttgccgcaccgattgttggccgtaagagatcgtctgcgttgctttccacgcgtgattcaaatgttggcgaacacatgtcttcaacgcag

SEQ ID NO: 61782 - DNA, 589 bp, Heterodera glycines
  Genomic contig location: Contig_ID=SeqID_31439; Location=60..648; Strand=-
  SCN-specific regions: Sequence locations=1-157,180-589
atgaagaacagaataacggcaacacttcactgctgtactcaattggcgctgacgccacaatggtgggtgtggtcctcacgaccgtcaacgaagaaaattgtgccgttggttgatcccgagtctcaaactcgtgaacttccggtgggtaaaatggcggatataaaaatttttttaaaattgtgatacattaattttggcacatttcttgtttaggtgtaccattgaaaacccaaagtgggggatgggactctttggatgctcaaaaaaattacaaatcaaatgcccccccccccatagtttttcaccttattgacatacaatttcgactaaaatattgaaattattagaatcggagaccgacgaatatgtctcaaaaattaaaattgtaccattacaagtttttttttgttggtaatactgccgttgataccacgctgtatttatgattttcagagtgtttccgtgtatttaaaccatttaggcgaaaaattgaggtatcgactttttgttcgaattcgtgtctgagaatcggaaatggtcaaaatgaatgtcatattcgtgatcagcaaagccgaaaaccttgaataaa

SEQ ID NO: 61783 - DNA, 1149 bp, Heterodera glycines
  misc_feature (69)..(69): n is a, c, g, or t
  Genomic contig location: Contig_ID=SeqID_31440; Location=1..1149; Strand=+
  SCN-specific regions: Sequence locations=1-615,637-694,716-777,815 -1100,1122-1149
  Gene Ontology: Mol. function=electron transporter activity; Cellular component=extracellular space; Biological process=anti-apoptosis
gatcaattatcggctctgtctcgagtccgggaatttcgacttaatttaagccactaatcccgattatcnccgcaactccgtttcagctaagtgcggacagtgctcattgttcccaagcgttgtgctaccatttggcgtaccggtctattgacggagtgtgcaacaatttggcacgaccgacgctcggcgcttctttccgggcatatatgaggtagattttgaaagctttggcaccaattgttgatcactctcgtcagtttggagagctaatattaaggactacgagccaaggatgtcggaataggaaaaactgatattccgatgatttaaactatttcggatcggcaatttgtttgttaaagcgttaaacaaatattattcaagcattgtcaaaaaaatactcatttgattagatatttgccagccgaatattcggacggattctcagagccggctggtaataaatgccattgtacagtccatctcccaaatttgacctgtcaggttcgggccgaagaccaacggcacgcgaggcttctcgtcttgtgctggccaaaggtgctccatcgatccatgatcagatcaactccatgtttatgcagttgggacagttcatggcacaagaaatggcaaaaacggcatgtatttcaaccagtttaaattgccaccttttacgcggcatttgtccgatcggttgcttcaattaaaaccaatccctggccgatcaaaatcattctaggacatctgctgtcagtccagttagcgcatccatttggctttattttttaatttattttttaataattcttaattagccagccaatttaggctcatcaacccgttgacccatgcttatcttgtgccccgttggtcggcaaatgtatgccagtgccaatttcggagcaggacaacaacccaatgttttcaatatcatattactgatcaagaaatgcagacaaattactttgttagattgatcgcaaaaaataaattgttaaaagatttcgccagaagggatgtctgaaggtgtccaggtcggcctccgtttgcggtacgggcgatcagggaaagccgcgcgaacaactcaacgagaacactgcctttgtggatggatcaacaatttacgggtcaaatgccaaggatttgtac

SEQ ID NO: 61784 - DNA, 146 bp, Heterodera glycines
  Genomic contig location: Contig_ID=SeqID_6494; Location=1098..1243; Strand=-
  SCN-specific regions: Sequence locations=1-146
atgggaaaaggaagggcattcgggcaacggctggtccaaaaggggccacacaatggcaaaggaaagggagggcactcgagcaggcgcggacagggagggcactcgcacagacagagagcagcgaaggccgggtgcagtgaaaggcg

SEQ ID NO: 61785 - DNA, 217 bp, Heterodera glycines
  Genomic contig location: Contig_ID=SeqID_6494; Location=1405..1621; Strand=+
  SCN-specific regions: Sequence locations=1-217
ccaagtttgaggtcgacacaataaacatactcttattaaaattgtgcccaacttggtctatttgcctggacgaaaaccggcacgactcatcgctctccgatcggtcccgaccccctacgttcccccgaccggctactctgcgcgcctcgcccatttcatccccttcccgtccccttcaccccgcagagttcgacgcaaatttcttgtcgccacgaca

SEQ ID NO: 61786 - DNA, 82 bp, Heterodera glycines
  Genomic contig location: Contig_ID=SeqID_31442; Location=395..476; Strand=-
  SCN-specific regions: Sequence locations=1-82
atggaggaacacgagttggagcagtacgaccggatcatcaacggacggcacaccgaatgggaattgttccattatttctccg

SEQ ID NO: 61787 - DNA, 409 bp, Heterodera glycines
  Genomic contig location: Contig_ID=SeqID_31443; Location=5..413; Strand=-
  SCN-specific regions: Sequence locations=1-96,120-409
atgacggagcccacgggatggtcaatttttgtgttgtataccgaccatttctcgtgttcggctcgcaatcggtggacattcttttgttcatcagggtaattaattaactaattaattgagcattagttttgtgattgttggcactttttcactcgaccagggccttttggaatggcatttcaatgcaaaaacaatgtacgaatatttggagaatggcaagcaaattgagaccaattcgttcttgttgaccactcatttgtcacttcgaatgattactattcaattgctgacagtgggagaacattttggatacaaattttaatgtaaagtgtaaggaacttacgaaactcataattgttgactgttaaatttacctaatatgaatatctccggtttttttgctaataaa

SEQ ID NO: 61788 - DNA, 505 bp, Heterodera glycines
  Genomic contig location: Contig_ID=SeqID_31446; Location=364..868; Strand=-
  SCN-specific regions: Sequence locations=1-126,155-258,280-295,317 -390,419-505
caaaagttttttacaaccacatattgccaatctaatttcttgcagatttaaacccatccattgcctgccggttctcggcacagcaaagcactaatacggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactc

SEQ ID NO: 61789 - DNA, 566 bp, Heterodera glycines
  Genomic contig location: Contig_ID=SeqID_31448; Location=158..723; Strand=-
  SCN-specific regions: Sequence locations=1-58,80-151,174-201,223 -247,269-439,461-534,556-566
tttttggttgctatttatagaaggggtatataaaggagtgaaaggaccatttgattggtacattgtatcaaaaaatgcaaaaaccgataatcgtaaatataattgctctcgctaatctcggtaccggaattaaactaaactctctgatgatcaccgaatgcgaatttaagtataaccctagaaaattcaatgccgcggttatcaaatgtacaactcccatcaaagccaccgcattattatgggaatccgggaaaatgatatgtttggggacgaaaagtctgatagactgtgaaaatgcgataaaaattttcatagaaataataagggctcggggtgtccgggggcttcttacaccggacacacggttgaaaatattgtttcgacctttaaattcggacatgaaattgaactgaacgagtttcgaaaaaatcgtcgtgcattttatgaacccgaaatattttgcggtttaaatttcaagcggggtaaaagcatgacagcgttaattttctggaccggtaaagtcgtaattacgggaactaaaaacaattctgaaattgacgaaatgt

SEQ ID NO: 61790 - DNA, 333 bp, Heterodera glycines
  Genomic contig location: Contig_ID=SeqID_31449; Location=1..333; Strand=-
  SCN-specific regions: Sequence locations=1-333
  Gene Ontology: Mol. function=structural molecule activity; Cellular component=extracellular; Biological process=negative regulation of cell growth
gtaccggcaagtcccggtccaggcttctcaggtcccggcaagtcccggtccaggcttctcaggtcccggcaagtcccggtcccggcttctcaggtcccggcaagtcccggtccaggcttctcaggtcccggcaagtcccggtcccggcttctcaggtcccggcaagtcccggtccaggcttctcaggtcccggcaagtcccggtcccggcttctcaggtcccggcaagtcccggtcccggcttctcaggtcccggcaagtcccggtcccggcttctcaggtcccggcaagtcccggtccaggcttctcaggtcccggcaagtcccggtcccgg

SEQ ID NO: 61791 - DNA, 333 bp, Heterodera glycines
  Genomic contig location: Contig_ID=SeqID_6496; Location=364..696; Strand=-
  SCN-specific regions: Sequence locations=1-87,109-333
atgcaattcgttagcttatccgcaagcagtttcgcattagcaatgcaattgtgcatcggattggaccgattagccggtgttgcatttccaatttggtaacatttaaaataattaaactttgatgggaggattatcggagttaattaaaaagttgaaaggattgaaagaatgactattttcaggtacaaaattgatggcaaatacacagttttcaaaattttgattggcatttgtgtgatcaaagtgatcgttgacaaatgcatccagttttacgggagctccaaacattgggaaacgtttgttaattggaatatttcattttcaattgtttga

SEQ ID NO: 61792 - DNA, 842 bp, Heterodera glycines
  Genomic contig location: Contig_ID=SeqID_6497; Location=43..884; Strand=-
  SCN-specific regions: Sequence locations=1-350,409-632,662-813,835-842
atggtcagttcgaatacggttgatggtacggtccattttggtgaaaggtgcgcggaaatggacaatgtccatggtccggcttttccgccgcaatccaatttttgtattcattaccgttcagatcaagtaagtgcacggggacagcaaagtttggcaccttaatgagccatcattttgctaagtaataattaatcagttcattaatttttttgccttgtgcccttttgtcggtacggtatttgatctcgacgtacggtggtgtgcatgggtgtgagcagatgagcgaattgttcaagcttttgaattgaattcgcacttttgtgctagacataggctaaaatccttttcgcttattttatattgttaattcttatcattttaattatcatttttaataaataaaaatttgccgcaattcgccaatggcaacggcattctttgccggcagaagtgcacccgatcaccggtttcaacactttggcggtctgatcagattttaattccctcgactcatcgcccaaaatctcgcagttctcatctaataaatgggaggaacatttttgggatattttatctgccacttaatcgatttaataaaaccatttttctaacaattcaattcttcaattttgtaaaatttaatataattttaaattttttactcactctcttcgagttctttacagtattcgccaccgtatccgtccggacaatggcattttgtgcaatcattcggattcaaatagcccccgttttggcacttgtcctcatggtctttgcatgagtctgaacaaaaggaaaatttacttaattatatttaattgatttgcctttgcaataaa

SEQ ID NO: 61793 - DNA, 1675 bp, Heterodera glycines
  Genomic contig location: Contig_ID=SeqID_6497; Location=99..1773; Strand=+
  SCN-specific regions: Sequence locations=1-125,155-378,437-809,867 -1121,1151-1520,1544-1578,1600-1675
actcatgcaaagaccatgaggacaagtgccaaaacgggggctatttgaatccgaatgattgcacaaaatgccattgtccggacggatacggtggcgaatactgtaaagaactcgaagagagtgagtaaaaaatttaaaattatattaaattttacaaaattgaagaattgaattgttagaaaaatggttttattaaatcgattaagtggcagataaaatatcccaaaaatgttcctcccatttattagatgagaactgcgagattttgggcgatgagtcgagggaattaaaatctgatcagaccgccaaagtgttgaaaccggtgatcgggtgcacttctgccggcaaagaatgccgttgccattggcgaattgcggcaaatttttatttattaaaaatgataattaaaatgataagaattaacaatataaaataagcgaaaaggattttagcctatgtctagcacaaaagtgcgaattcaattcaaaagcttgaacaattcgctcatctgctcacacccatgcacaccaccgtacgtcgagatcaaataccgtaccgacaaaagggcacaaggcaaaaaaattaatgaactgattaattattacttagcaaaatgatggctcattaaggtgccaaactttgctgtccccgtgcacttacttgatctgaacggtaatgaatacaaaaattggattgcggcggaaaagccggaccatggacattgtccatttccgcgcacctttcaccaaaatggaccgtaccatcaaccgtattcgaactgaccatttgaatcgaggcgaggaaaattgtaaaataattttatttgttttttaaattaaaaaaattttaaatttgtattttaaaatgctttacatatctaatggaaaattgttctaaaaatctgttaaggcaacgtcaaactcataaattcgagcaaatgcgtgaaaatcgaaaatttgtatgccgagaaaaggagaaaaggaaccccgagcaccggcactttgcgttgttataacccgacgaagaatcaatattataactgctcctgtaacggtgataagaaatgcctcgctgaagaaaaatgggcacacgacgcgtttctttgtcaaataatacgggtgattaattaattaattaatttattattaatgccaaaagacactgccacagaaacatttcatataatattggcaatttaattttttttggctgtaaaaattaccactttttgtatcaaaaagcggaaataaggacaaatgagaacataaatgaaaaaaatgccgccatgtatttattgatttgtaaattcaaggtcaatggaattcaaatccaaattgattatcggtacaattggactcgtcttgatgttgattgttatgtgagttgggtcttcctaatttctcaaaccctttttaattgactaattttacagaaggccgaaggaggtaccgtaagcttttggggctacagtaagccggagaccaaagaaatcattcgtgtggacgaagtccactgtttgacttttgaagctgctggagtaacaccaccgtcacagaaacggttcaagagtttgcaagtcgaagaacagctgtcgatgaaattgaatccaagtacattattggacaatgcttcatcacttatccatgtgttcgtgccatttgttggccatccatga

SEQ ID NO: 61794 - DNA, 1381 bp, Heterodera glycines
  Genomic contig location: Contig_ID=SeqID_6497; Location=2039..3419; Strand=+
  SCN-specific regions: Sequence locations=1-26,50-131,177-214,253 -273,296-331,385-661,694-958,1004-1026,1069-1321,1344-1381
atgggagaaccgctaaaagtagcgcccgtagctcagttggttagagcacggcacggattgctggagtcttgggttcgagtcccaccggcggacgagttaccttttatgtttgttatacacaaaaaaatgacaaattttgatttaaatgtatataaacaattaaaaatttatttaatgcgtgtggagatgtctttttgtttaatttttccaattgtaaataagtattttattcatttaattatttattattttgttctttataaaatccgtgtcaaaatctattgaagacaaaaaagttcaatgaaaaatttacgtacaaaaaatgaatttcaaataaaataaaattaaaagaacaaaagaaaatataaatattttttaatttttgggagtgtttgaaaatttattagaaattgtaacatattcaaattattacccatgagcgaagacgaaccgaacccttcacacatttccctttttggccaatcgatgttattcatcttttcgatattcccccgttcatcatttcattcactatttctcttttctctaactctcacaaatccccgcaaatctccgccccttttccgttcaatttttcccccaccaatcagtcagtcgagtcggaggagatgatagtcggacgttggagcgatcaaaatacaaattaattatttattaattcatttaattattcacatatttcgcgcattataatccgacaataaagagccatacaaacgattggaccctttggacttcttggggatcagggcccgattcctaagattaagacctttcagtcctgggacaatccgtctcctcccatcccactctggcatggatcctcacgtcttactgttagcaccggatggttcgactttcgagtcgaaggaaagacgatccagcgaggggatgaaatccgactggctcaagctgcagaggcttagaatcacatttgaatattttacaaattaatttttatatatcattttttgaaaaaaatcgattttttagggatacattttcaaaaaaaaattttaaattttttacaaaaaatttctataaattctcaaaaatcctcaaaatatgtaaaaaaaatgaaaaatatgtacgaaaaattgcgaaatatgtacgaaaaagtccaaaatatgtaaaatatgtatttacataaaattagcatccctaattataacccggccgttaaatatatttgaaagaaaatcaaaagtcaaaacaaaaaaaatcatcagtaaaagaaatcattcattcaaaagaaaagtttaaaaaaatcagttctaaatcagtcaaaaaaaagagggagttcattcattcaaaaatcattctaacacacacaaaaaaaaccgtcataacttgaacacta

SEQ ID NO: 61795 - DNA, 231 bp, Heterodera glycines
  Genomic contig location: Contig_ID=SeqID_31453; Location=225..455; Strand=-
  SCN-specific regions: Sequence locations=1-95,117-231
atgtcttcgctggctgattttgtaaatgaacagcggagtaaggcgaacagttcgtccggtcgacaagcctatttcaatgtggccactctcggctcaaaagtcagcaattcgttcacagatttcttcaaaccaagaaattcgaatggtatcgacgacgtacagcgactcactgaagacgccgacgcggcacaaaacggacaattgccgtccaacaaaaacaggcacttgtaa

SEQ ID NO: 61796 - DNA, 660 bp, Heterodera glycines
  Genomic contig location: Contig_ID=SeqID_31454; Location=476..1135; Strand=-
  SCN-specific regions: Sequence locations=1-43,65-660
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaac

SEQ ID NO: 61797 - DNA, 90 bp, Heterodera glycines
  Genomic contig location: Contig_ID=SeqID_31455; Location=1..90; Strand=-
  SCN-specific regions: Sequence locations=1-1,24-90
aaaatctataaaaaatttaaaaatgagaattcatgcgagattttctggaaataagcttaattgggcctagttaagctgtaaaaaaaattt

SEQ ID NO: 61798 - DNA, 439 bp, Heterodera glycines
  Genomic contig location: Contig_ID=SeqID_31455; Location=314..752; Strand=-
  SCN-specific regions: Sequence locations=1-1,24-161,191-326,356-439
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagaga

SEQ ID NO: 61799 - DNA, 667 bp, Heterodera glycines
  misc_feature (4)..(4): n is a, c, g, or t
  Genomic contig location: Contig_ID=SeqID_31456; Location=356..1022; Strand=-
  SCN-specific regions: Sequence locations=1-354,376-507,534-616,659-667
cccncgaaaacaaaaataaatcgattttttcaagtgtccgttttggggtactcaaacaattatgggggagcaaaaatccaacgcataattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 61800 - DNA, 152 bp, Heterodera glycines
  Genomic contig location: Contig_ID=SeqID_31457; Location=1124..1275; Strand=-
  SCN-specific regions: Sequence locations=1-152
atgtcgagcagttttgtgtggaagcgggtgagcggataaacattttttgaggatatgcgtcagctttatctcattttacagggaatggttgcacttcgtcgtggctccactaaaatttctgcatgcggatttcatgggcggaatttttggag

SEQ ID NO: 61801 - DNA, 304 bp, Heterodera glycines; identical to SEQ ID NO: 51570
  Genomic contig location: Contig_ID=SeqID_31460; Location=298..601; Strand=+
  SCN-specific regions: Sequence locations=1-304

SEQ ID NO: 61802 - DNA, 137 bp, Heterodera glycines
  Genomic contig location: Contig_ID=SeqID_31460; Location=804..940; Strand=+
  SCN-specific regions: Sequence locations=1-137
aaaattccctcaaaaataaaaggtctattgcgcaccgccctccctatcatgctcgagagcatttgtatgtgtataaaatttctcaaaaaaagagatagccattttttctgggatagagtataaatttaaaaattccc

SEQ ID NO: 61803 - DNA, 1228 bp, Heterodera glycines
  Genomic contig location: Contig_ID=SeqID_6498; Location=14..1241; Strand=+
  SCN-specific regions: Sequence locations=1-95,161-307,398-458,491 -601,650-747,769-782,829-1114,1136-1228
atgcgatcggaaaatggagaacaaaatgaaggagttgctccactatcagcagctgatcagcagcaactgaaggcgcgtgaaaaacggagaagggcaattaattgttaaaataaataaaaatgaaaatcgaaattttattttatttattttaatttttttaggaatttcgtcaaaactttggcaaaatgcaaatggaattacgggaaacaatcgaaaaacttgtggctaaagttggcgaattggagaagcaacaacagcgccaaaaagtcaattaaatgggagggaggggacaaagtccacaatattctaaaaatttaatttaatttaaaattttctattttttcaatttaatatataaataaataagaatttttccattaaatatttaaaaaaaaatgttatttcatttgacagaacaacgcgggagtgttcacaaaagtgaccgttgcaatggttggaaataattttaaattataataaattttaaattcagcagcaaaattgttgggatggcaccgcttgccccagagaattggaaatcattggtgccaaacgtttgatggtccaatacaaaggaaatcgcttaaaaggtaattgtcacaaattaacaaaaaaattattaaagaaatttaataattaaaattaaaatcactttaaatacgattattttaattgaaaggaagtcgctcaatgttcacaaaacgctgcattctgagcacaaattcgtccatttcttacgtcgaagtgaaaatcatcagtatgaaaatgtaaataaatcttagaaaaataaaaatataatttaaagtttataatttataataatttttaggtgcgcaatgattggacttgcgaccaaagaaatgccattgtacggaagggttggcacttatcctaacagttacggacaccgaagcgatggccttttttgggtcaacggttcctgccaaattggcagtcaaagtgccaaatttggcatcggagatgtcatcggatgtggcattatattggccacgcgccaaatttttttcacgaaaaacggacaccgtttgggttgacaaatgactaaaacggcatttttaatgggattttttcagattccgccgattttgtggcactttttccttctgaagatgtccctcttttcacttgtgtcactttgcacgattccgaggacaaaattgaggcgaattttgggccggaattcaactttaatcttaacactctctga

SEQ ID NO: 61804 - DNA, 726 bp, Heterodera glycines
  Genomic contig location: Contig_ID=SeqID_6499; Location=520..1245; Strand=-
  SCN-specific regions: Sequence locations=1-141,164-471,503-546,568 -595,618-726
atgaatttaaaactactgccgaaatcaatcactgtcgaaaacgcctggtaaggcaaaatctctgacaattgctaatttaattcaaaattcaacaggttggcgtactgttttcgcagaacacccaattcccagcgaagatcattcttcaggcattttttactttgaaattggagttgaacacatggaattgttagaaaattacttcactaaatatgcataatggttttttttattactttttgcagtgacggcggtgtactgatcggattggccgctaaacagaaaccgtttctgtcggttttaagccgcattggcacttacgcttacccaaacaatggcactttttacattaacggttcctcgctctatgggtcttctaatcagttttatcgtgaagacattgtcggctgtggcgttaatttggccaaccgacaaatcattttcacgaaaaacggacgtcttttgggttggaaaaaaaaattaaattaaaattttaatttatgcttttcagatgtctccaattcgttggtcgcttctttcgctgttccgttgttttccttcgtttctttgtgtggctttggtgacaaaatcgtggcaaattttgggcccaaatttcttctcccagacatttaaaaagagaacagaaaaacatggaagcgagttgcataaattaagaagaccacttttgttgttgttttttttattttccatttttgaaaaaataaa

SEQ ID NO: 61805 - DNA, 477 bp, Heterodera glycines
  Genomic contig location: Contig_ID=SeqID_6499; Location=1279..1755; Strand=-
  SCN-specific regions: Sequence locations=1-75,141-338,360-477
atggaaatgcaaatgaaaaaagaacagcagaaaatggtaaattaatgacaaaaaatgataaatgaatgggctgggaaattaaaatttgaaataaataattaatttaaatatttttaattaaaataaattaattattttaagctttttctaaaactccaacaaaattattgggatgtcaagttttgccaaaatgagctcgaaatcactggcgacgacggtcttacagtggtcaataagcaaaaacattcaacaggtaaatggaaggaaaacaaaaatccttggtacgcccttatgtctttggcgccgccgcaggacaaaccaattaaattgaaattcaaaaatgcataaaaattaacttttttgggggagtagcaaaatcggtgctgttagttttcgacagcggtgattcgacagtaaacttttgcttttaaaaaacttgtcctatatggtacgtctagtaaaattttgaaaattaaa

SEQ ID NO: 61806 - DNA, 1356 bp, Heterodera glycines
  Genomic contig location: Contig_ID=SeqID_6500; Location=120..1475; Strand=-
  SCN-specific regions: Sequence locations=1-67,89-277,334-446,468 -505,539-557,580-667,718-838,882-1228,1252-1313,1336-1356
atgtcaatttcgaatgattcgacaaatgacggctttataccagcagaagcagctgatcagcagtttcaaggttcagaagagattaattattatgacaagatttttttcttaatatgaaaataaattactaaggaattataggtaaatgccgatctttgcgagtaaaacgccaaaataaacaacaaacgcaattcatttttgtaactatttggcacttttgtaaagcttagggtttttttgcgaaatttcttaaaaaggccaaaagaaaactttacagaaaatttaataaaaattcttttaaaatgaagaaaaaaatacattaaataaattaaagattagagaatacataataaataatgtgaattcttttctcaagtgattggcgatgcgttcagtttggatgactttggatataaagatgaaaatgctgaacaagttggagatgagcagctgaggaaggaggccaaaagcaaacagcaggacgatgatgaagatggcattttggtaaaaaaaaatgaaaataaaatttaaataaattcaattgaattcagttttgggagaagttagagaaactggaaatggaattgaaggtggccaaacaaatgtgcgcgttcaccaaaatggaacttgaagaggcatggggatttccagcaaaacataaaaaaccttaaatatttttatttaaaataaaaaatggattttcttaaattttaatttgacagaaatcgcttcaaacagaattaaaacagcaaaggctgatggcagaaaacattgagttgaaggacaaaattgacagattggagaaggaaaaggaaaagcttcaaatggaaaaatacagttaaaatataaatttgactattttttaattattcattaattaagctaacctcaagctgtgtggagaattttcggggcacatcattgaatgttttactcataacagttgtcagatgagttagcagggttcccagatctgaggctttagcctcattttgtggttttttgataggtcaatgaggctaaattttcaatttgaggctttttgtggttttttaagaaattttgaagatttttggggaaaattcgtcagattttttaaattttgattaattttgataaattggcataatgtttttggccatatttgtcgacaaatctgttaacaaatcgtattaaaaatcacaaaatttttcccggcggcgcctatcggcaccgccggcccaccttgttccccaaaagttttttgaaaaaagcgccgcaaaaaaatcaacttcggtttttcatgcttagaatttcacaaaatgtttatttcgaacaaaaaattgctcaaattgatcatggacaatcaaaaataaa

SEQ ID NO: 61807 - DNA, 807 bp, Heterodera glycines
  Genomic contig location: Contig_ID=SeqID_31462; Location=162..968; Strand=+
  SCN-specific regions: Sequence locations=1-9,31-52,74-292,343-381,404- 807
  Gene Ontology: Cellular component=extracellular space
atggacgacggaggaaaaggaggaggatggcatggacagcgcaaaaatgaccaaaaattggggggaaataaaacggcggtggtttttgtgtcggaccctgacaaattccgactccaccgacagttcgtgccgattttgaacgaagccaaagaaaggaaaaagaggaagcgaaatggtagcaaatgggagaaaggtgcggcacttcgccccgggggatggaaaaatgccaaacggtggccaaaacgaagccgaaaatgaataacaagtgccaaaaacatggtctacaaaacacaaaattaaaaaaaaaaaaattaactaaaaatattaaaaaattaaaatttagttcaactaatattttataggatttcaaatctattgaccaaataaaaatgaaaactaaacaaagttcctaatgaaccttgagcatttcggactattttagactttatccaaaatcttccaggccattggctgaccgttcgtgtgaatgcgtccgcgcgctttcagtcactgctcggtttcggtggcgcgttcaccgactcggccacgttcaacatggacgcgttgagcgggccaacccgctccacccttctgaaggcttactttgacagaaacattggtcattttataatgatgattgaacactcttttgtgattactcccatttttgaaggcattcggtactcagtcggccgtgtgccaatgggtgcgactgatttctctgtgcgccaatattcgtactgcgacacgcccggcgatttgaatctgaccacatttgcactggccaaggaagacttagaatggaag

SEQ ID NO: 61808 - DNA, 672 bp, Heterodera glycines
  Genomic contig location: Contig_ID=SeqID_31467; Location=114..785; Strand=-
  SCN-specific regions: Sequence locations=1-243,268-592,614-672
  Gene Ontology: Mol. function=structural constituent of muscle; Cellular component=striated muscle thick filament; Biological process=striated muscle contraction
atgcagaagatcaaagtgaaggtggagaaggacaagcagcagatccaacgcgagttggaggacgccacgcaaacggccgactcggaactgcgagcacggcaggaagcggagaaagtgatcaagaacatcgagctgcagctcagcgaactgcagagcaagacggacgagcagtcgcgactgctcaacgactttgccgcgctgaagagccgcttgcacaacgaaaacgcggacttggaacatcaagtggaggacctggagaaccaggtgagacggatggacgagcagggattgggacaatgctatcaccatggacatttgatcacaggtgaattcgctgcatcgcctgaagagtcagttggtcagccaattggaggaggcgaaacgaaccgccgacgaggaaagccgcgagcggcaaaccctcgcgggacagctgaagaacgtgcagcacgagaacgactcattgcgcgaacagctcgacgacgagcaggagggcaaagcggaatgcctgcgtcaaatcagcaaactgaacgcggagatccaacagtggaaggcgcggttcgagtcggaaggattggtcaagatggaggagatcgaggaggccaagcgcaacttgcagaagaaagtgcaggagctaacggacgccaacgaagcggccaacacaaaggtgattag

SEQ ID NO: 61809 - DNA, 91 bp, Heterodera glycines
  Genomic contig location: Contig_ID=SeqID_31469; Location=135..225; Strand=-
  SCN-specific regions: Sequence locations=1-91
atgtttattcgaaatattatttttattgaccatctaatgtcgagattattaaaaattattacaatagatggaaattttacaagttaccgag

SEQ ID NO: 61810 - DNA, 290 bp, Heterodera glycines
  Genomic contig location: Contig_ID=SeqID_31473; Location=16..305; Strand=-
  SCN-specific regions: Sequence locations=1-290
atgaaacgaagcaacacgacaaaagacactcctcctcaaccaaaacgctcaatggcatttgcaccggactcgggtccaaacactgcggcactcgctgagcaagaacgccaacgcacattggtgctcattggcctcccggaaagcaatgctgttcgcccatcgcagcgtgttaaagaagacagggaagccgtgactaaaatcttggaccatcttgatgttgaggctgaaccaaccgccgtctttcgactcggccggttcaacccgcagcgaacacacctcgcccgctcaag

SEQ ID NO: 61811 - DNA, 76 bp, Heterodera glycines; identical to SEQ ID NO: 51235
  Genomic contig location: Contig_ID=SeqID_31474; Location=572..647; Strand=+
  SCN-specific regions: Sequence locations=1-76

SEQ ID NO: 61812 - DNA, 1070 bp, Heterodera glycines
  misc_feature (139)..(139): n is a, c, g, or t
  misc_feature (170)..(170): n is a, c, g, or t
  Genomic contig location: Contig_ID=SeqID_31475; Location=25..1094; Strand=+
  SCN-specific regions: Sequence locations=1-146,335-757,779-824,879 -1070
atgtggggcgcagcacaggcggcgactgctgccgctggaggtggcacaccagtgagaaatttcataattatatattttcactactttttatccaccggtttggtaccgttgtcttttatttccatttatattcattctntacaatcataattaatttaagaataaatttntaaattttatttctaaataatatttttaaatattttttcaattatttcaaattaatcatttttaattaattttttaaattttgttgtttttaaatatagtaatataattatgatatttattacactttttcagtaaaattttatatatttttgtaaaatattttcatatacctaaacactagagatcgacctggacctggatccagttccaggtccaggccatttttcggcaacctggatttttcctggacctggatttttgtccaggaaatccaggtccaggtctattgtgaaaaaaaatccaggtccaagcaaaacacgaaaaaccctggattttcctggacaaaattttagaatttgttattttaagtgaccgatgttttttcaagttttcaaaaaatgattaaataacttagaaacacattattattattaattagatatttttagaggtttataagcaattaattgattttttcaaacattttttgatttttaaaatgagtttcaaaaaatccaggtccaggcctggatccaggtcccgaggagtctggatttttcctgggctggatttttgtccaggaaatccaggtccaggtccaacatggaatccaggtccaggcttttttcaaaatgtcgatctctactaaacactatttttaaaataaaaaaagtatttctaaatttgaattttatttaaaaattattgattgtctttttagtcatcgattgctaacagttcaccgtttgtcaccatgtccggaaatgctgctgctgctgatagagtgacaaaatgctagaagagaagcgccagagaaggaaagaaatttttgtgatttttgatcgatagaagaaacaatttttgatcagacttttcttatccaatcaatgatctaatca

SEQ ID NO: 61813 - DNA, 930 bp, Heterodera glycines
  Genomic contig location: Contig_ID=SeqID_31479; Location=576..1505; Strand=-
  SCN-specific regions: Sequence locations=1-18,41-930
gtagagaaaattttatcgaaaatttattttaatttaaaatctccggcaagttttgctggaattcaaaaaattttaaatgaggccaaaaagattgacccgaaaattacgaccgatgacgttaataaattcctagaaaggcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgattgaggcttttgatcgggtgttcgaaaagtctaaaattatcccgatgaaaatatatagtgacagtgggcttgaattccaagcaagaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaaggggtacctcccaaactttaccgaagaattgtttaaaatcgttgttgccaattcgacgacacccgattcatacaggatcgaagatttggaaggaaatttaataaaaggcatattttataaccaggaattagtgaaa

SEQ ID NO: 61814 - DNA, 952 bp, Heterodera glycines
  Genomic contig location: Contig_ID=SeqID_31481; Location=30..981; Strand=+
  SCN-specific regions: Sequence locations=1-90,113-726,760-777,805 -911,935-952
atgaaacgctgtgcaacaaaacctcagttggccaatgttcttcagacgctgatttatgctatgcaatcaaatgcgatgacagttaatctgccaaataataatttgtttcattcagaattcggtcaaaatccctttttttgtctaaaggtaatcagccaaacaaatttgtccaagagtggggctgtacttcgagcttttcaaatgtttccaagttttgcatggataaagctgctcaacttggtttcggatctgaccagcgtttgtgcaaatgtcatttaaaaccaccaaacaaatcgcacaaaatcagtgcttctggtaatgcataggatttttagtggttaaaaatagtttttcttaagtaattttagggatgtaattttttaaatagctgttttttaatttgcaaataattttaaacttaagcaaacaattttattcactgattccagttactttttaggttttttattccattttttgggaaattttccaaaaaataccaaaatagtggagaaacgcaaaaatagtggcaaaaaactattttagtggccaacatccaaaataattttttttaatggcaaagctccaaaatagtgattcctagtgatgaatagtggcgttaaaacgaagaatttccgagctaaaattatgtttttcgtgcatttctcgtcgaaataaagccgcagaaaaaatagttaaaaaactaaaaatccccaccctagctataatataaaagcattttttaaaaatggttaatttttgtgatttagccacacatttgctgaatttaaatattttccaaaaattaacatgcatataataaaatttcagttagaataagctcaagaaaattcgggtgttcttatatattcgaaacacattttatttgaccgagaccgattgacttaacgaaaattttgaaaaacaaaactaattaaatttaatatttcga

SEQ ID NO: 61815 - DNA, 56 bp, Heterodera glycines
  Genomic contig location: Contig_ID=SeqID_31482; Location=880..935; Strand=+
  SCN-specific regions: Sequence locations=1-56
gctatagggaagctactcccgaaggattcggtctccccataaatctgggcacatcg

SEQ ID NO: 61816 - DNA, 594 bp, Heterodera glycines
  Genomic contig location: Contig_ID=SeqID_31483; Location=66..659; Strand=-
  SCN-specific regions: Sequence locations=1-16,39-594
atgttaaacaaaattaaaatagctccctataaaaatatttgttccgaacaaattcgcaatggagagaacgaagaagtcgaaaattttatggacacaatttcggaccttgttgttggtgagaacatcacaattgattcggtaagaagcaggtcaactgcctgtttttatgaagggtcaattcgatttttttggcaaatttaaaaaagaaagacgaattcttcaattttgaaaattttatagaaaataaagattttgggatggaaaaaatacaatttgttaatagatttttactaaaaataatttttttgtgatttttaattcaagcggtgattttaaatatttaacagagcattttttgcagagcattttctcacattgtgccgacgcgagaaaaactaattcttaaaactaaactctatttttaggcgaataccaatggagaataccaggaaggtgaaactgacaatgtctggaggccaaatcaagacgtcgttccgtacgatgaattccaaaatgctttggcattaaacatggacgggggaaacaataaccttgaggaagaaaattcggaaaggtaactccagttaaattaaa

SEQ ID NO: 61817 - DNA, 824 bp, Heterodera glycines
  Genomic contig location: Contig_ID=SeqID_31485; Location=309..1132; Strand=+
  SCN-specific regions: Sequence locations=1-246,268-487,509-737,772-824
atggcacaatcaaatgccaacatgggcctgaagagtgtcggatcaacaaatttcatgttgctttattttattgaaactaatacattctcagaaggggtccgattttatgtaagaaaatcgtaatagcaatatattggcatgccaaaaaaagacataatttgcttgtaactttttttatttgtttttttttcaaaaatatttttgatatccgttaaaaaatttttgaagagtgcctttgttcaaaaattttttggttttcataaaaaatctcgaaaaattctataaacacaactaggtcaaggatttttagatctttctttacctgcctaaaatttaattttatccaaaatagaaaatattttgtacttgcactttttttggcacttctccagccatcccgacaaattttgtcgtgaatttcctccccgacttttctctttctgaggggcggggagaaccctaatttaaagcatgaagattctgaacaaacaaaatatttcatcaaaattggatcccgagttaaaattacacaaagagctaattaaacacttatcactgtagtcgtgtgccattcacttcatgcacgacccaatgccattcatttactgccttgaaaagctgatcagttcaggcattccgctggagaaagcatccaaaaaatgctatgtcaaattgcatccaatcccgcacatttacgaccaaattacgtgagcaaatggagctttacccattaaatcaactatttttgaaattagaaaagtatatttatagttttcatggtataattcgagaatcttaattcttctttattaacatttaatcca

SEQ ID NO: 61818 - DNA, 1009 bp, Heterodera glycines
  Genomic contig location: Contig_ID=SeqID_31486; Location=1..1009; Strand=-
  SCN-specific regions: Sequence locations=1-839,861-1009
ggcaatacttttgttaatcaatgttttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaagcatttgactcagtgccccatgaattacttttatacaaattggaaaaaataggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgttataaagcaagaaccgacacagaaattatgcataaagcattgcataatttattcgaatgggcaaataaatggcaaataaaagtttcaatgcaaaaaacttttgtattatatttgggttcaaaaaacccaaaagaaacatatgaatttgatggaaatacaataaatgctgtggatacaattagggatttaggagtaaacattgataacaaattacaattttccgatcatattaa

SEQ ID NO: 61819 - DNA, 696 bp, Heterodera glycines
  misc_feature (440)..(440): n is a, c, g, or t
  misc_feature (468)..(468): n is a, c, g, or t
  misc_feature (599)..(599): n is a, c, g, or t
  misc_feature (623)..(623): n is a, c, g, or t
  misc_feature (638)..(638): n is a, c, g, or t
  misc_feature (640)..(640): n is a, c, g, or t
  misc_feature (647)..(647): n is a, c, g, or t
  misc_feature (668)..(668): n is a, c, g, or t
  misc_feature (673)..(673): n is a, c, g, or t
  misc_feature (680)..(680): n is a, c, g, or t
  Genomic contig location: Contig_ID=SeqID_31487; Location=92..787; Strand=-
  SCN-specific regions: Sequence locations=1-27,49-474,544-696
atgacagaggagattttcaatgatgaagttaattttgtaaaagcaattcaaagtgttgtgtcggcagatgacaatttcatttgcgaaaagccttcgttttgcattgcgccgctgcttaattcggcactgttcgaaatacttttcgcattggcaattcgtctgggtttgctaattggacagaatggttttgttgaaaaatatttgccgacctttttaatcccattatacgagtaaggcattgaattacgcatttcttaaacgacgcccaattttgacattttctactattttttgctttttaaaattcaattactaaaacaatggaaaaaagcttcataaataccctaacaacataaaatttactcaaaaattcaacctcaaaataaaatctttctcaaatatacaattttttctaattacttcactttcaattttaattncttcttctcatattaattaacaattttntctcccattaaaaataaatttcatttcttaaattaattaaatttcaatttcaattaataaaattctaatttttttcacaaatccaactcccaaaatatttaataacctaattattattatcataaatattntccacataaccatacaaaattcanatttcccttacactntntttttcnaaaatcaaactcaattaattnacaanaaatcanacaataattcaataaa

SEQ ID NO: 61820 - DNA, 218 bp, Heterodera glycines
  Genomic contig location: Contig_ID=SeqID_31489; Location=955..1172; Strand=-
  SCN-specific regions: Sequence locations=1-11,33-64,86-180,202-218
tgctcacaaaggaaggtctggaggtgtccgtggagtttcggaatgaaatttggtgggtgcatagaacacccatgggttcttaagaaaagtggttttattttctgcgaaatgagtacgagtgccgagatatgacgtgccaaacttttttctatcccaataaatcgaataaacatttgcaccgttttgtgttgttcggtggtgcggaggttgtgcgtttg

SEQ ID NO: 61821 - DNA, 1342 bp, Heterodera glycines
  Genomic contig location: Contig_ID=SeqID_31489; Location=208..1549; Strand=+
  SCN-specific regions: Sequence locations=1-255,277-320,342-345,407 -667,689-764,786-880,902-933,955-1050,1078-1111,1153-1156,1178 -1204,1245-1292
atcacaaaatttatctccaaaacccattttatcaatcttgaaaaaattaaaatggaatcccaacaatttgtggaacttacgaggcaatttgttgaaactaaaatgtttcaattcgagacgttttaaatgcagaccaaagtggtttcgagctcgaattgcaccagaaaagatcactggcaccaattggaacaaaattggttgaatgtgtagtccaatcggtagctagcactacccacagttatacaattatgccaattatcactgcaaatggtttattgttgtcaccattgtttattgtaatagcagagcggaatggaaaatttccccaaaaaggcatttttcaggttaaaaatatatttttagaaaataatagtaaaaatatttgatttatcaaaattaatattaaggctaaaaatgtttatgcggtacccaatacttcccatattatgacaaaaaatttaatggtcgaatgggtcaacaccgtcttatgtccagtgttgcgacctggagaaagatcggtgttgttggtcgatagttggaacggttggaatgaatttcggctcccacaaaatgtccaactacaagtcaaacaaatcccaaaacacgggactggattttcccaaccattggacgtttatgtttttcggtactaaagtcggggtagtaaaaaatccatcaaatatttttagaatttggaagcaattcacaagaagaataacggaatttgttatggtttacgacattaaccaaacgcacaacctccgcaccaccgaacaacacaaaacggtgcaaatgtttattcgatttattgggatagaaaaaagtttggcacgtcatatctcggcactcgtactcatttcgcagaaaataaaaccacttttcttaagaacccatgggtgttctatgcacccaccaaatttcattccgaaactccacggacacctccagaccttcctttgtgagcatttattggcaaataaaaagtgaaaatccaaaaatgagtgataataaaattgcaaaaatattgaaaattcatctaaagagcattttcaattggaagaaacaatttggagaagaaatactttgaaccattcttaattccaccaaaaagtaataaaatttaaaaataaatatattttaattgtataaattcgagtacatttaaattattgattactttctatagctgaaggtatttcatctctttaattttttaatttttttatgaaaagaataaaaaatatgcattaaaatcttaaaaaccctcaaatggtcatattaatgcaaaattgaaataaacatttataaaaaaaaaaattaaaatttgataaaaaaaatttaa

SEQ ID NO: 61822 - DNA, 315 bp, Heterodera glycines
  Genomic contig location: Contig_ID=SeqID_31491; Location=843..1157; Strand=+
  SCN-specific regions: Sequence locations=1-315
atgatgattacggtggagaaagttgttggtgccggcggtagcggcactattgttggcgctgccagtgtagatggttcaccagcacgacgggtggataaacaggagctgaacagggcgtacaaaatgatgctgcaccaacgacgggacgccgtctcaggacagtctggcaatgaggcaatgctgcgcagcacatcgccagcaacaaaaggcggcacaaacagttcgatggggttgacattggcatcggaggatgagcaaaagcagcacaaagaagtgggtgaattgatgactggtcctaatggtgaaccaaattaa

SEQ ID NO: 61823 - DNA, 1576 bp, Heterodera glycines
  Genomic contig location: Contig_ID=SeqID_6506; Location=299..1874; Strand=-
  SCN-specific regions: Sequence locations=1-262,285-364,509-869,891 -907,933-998,1091-1161,1183-1289,1311-1498,1521-1540,1562-1576
  Gene Ontology: Mol. function=mannose binding lectin; Cellular component=integral to membrane; Biological process=ER to Golgi transport
atgccactattatttgtcccagcatgccaacgcgacttccgcaacaagcagtacccggtgcacatcaaggtggaatacttccgcaacacgctcactgtgcacgtgtccgacgggatgagcgcgacgccgcgctttgaaatgtgcatccgcgcggagcacatttttctgcccaaggcgggcttcttcggcgtgtccgccgccaccggagggctggcgggtgagagagagtggatttaggaaaaacaaaatcctttagaatttcaaaaaaaaaaaaaaaatttaaacgcagcgccgaacccccaaatactacccttagacattataaaaccattaataacgtcgatttttataaaacaaaaagtgcaaaaaatatgaaataaaaataaataaataatgtttcttaattaaaaaaatatatagtttatgctaattttacaaaaatctttgtccaaattaatttttttttaattatattaaaacaaaattcgttaaatttcaaaaaaaattactggcagcgcccgctgaacccccaaattcccttcgatattactcggtcgaaacaaaaaattgttatgttttttatcttgaaaatggcttttcaaatttttttctttatcgctgttattttgagcatcatatacaaggggtgtctcgagacacccccccccccctctcgtcgtaagaggcctcggaccagggctggccgtgatcacggaaatcacggggtttttggggtgccgtgatctcagatcacgggtcacggattttttcaatttttccgtgattttgatccgtgattggcattttatatagggaatttttattgagacgaaaataggaaagtggtgtgtgaaaagaaattttttgagaaaaaaataaataaattatttctgtttagggagtaaacatatatatatatatatatatatgtagtctggtggttaagccttctgtctttcgctgtctgtcccttgggttcaattccccattgggataggataatttttatattttgttttgataatttaattgaaattttattaacaagaaatttcctaatattgaaaattatttttctttatttttaaaacgtccatagaccaataaattaaccaatgattggacatattttggacaaaatctcttaacaaattcactcaaaatttcaaaatttttcccggcggcgcctgtcggcaccaccggcaggcggacccccattttaccgtatttttgaaattttgaccccaaaatggcaaaaaaaatagcccatttttggcacaaaaacggctaaaaatccctattttttctctccgtcgcataaatttaaaatgacaggcctaatcaaaattttcacaaaattttcccaaccccctaatattttttctaaaattttcccgactttcagtatcttttggggtgttcagatcgccatgaaggagtaatctgatcatgttggtccaaaagatttttttgttcagcatcaaaagttagcttacaaattagaggaaattttttgctctacataaatagatttttggttaaatttaagaaaaatttgaaaaattttcttaataaa

SEQ ID NO: 61824 - DNA, 122 bp, Heterodera glycines
  Genomic contig location: Contig_ID=SeqID_6506; Location=3250..3371; Strand=-
  SCN-specific regions: Sequence locations=1-122
ggggacctctagagtctttcgaatgataccatgattgtgaagtttggccaacaaagaaaaaagttatagctttttgaacattgctgagacggagttggccagacggagttgacccctaccgt

SEQ ID NO: 61825 - DNA, 280 bp, Heterodera glycines
  Genomic contig location: Contig_ID=SeqID_31493; Location=900..1179; Strand=-
  SCN-specific regions: Sequence locations=1-57,79-126,151-280
attttctaagaaaaaaataggagttttgggggcgcggcggtgccgataggcgccgacggggaaaaaattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaatgcgaaacgccaaaaaatgcgaataatgcgaaaggcgaaatgcgaaaagcgaaacctcggcccatccctg

SEQ ID NO: 61826 - DNA, 356 bp, Heterodera glycines
  Genomic contig location: Contig_ID=SeqID_31495; Location=1336..1691; Strand=+
  SCN-specific regions: Sequence locations=1-98,159-293,315-356
atggaagcgcaattccacttctctaaaatctcgggatcagatttcgaggctcagaaaaggaatttggagttgatatatctgggtcatcccccccaaactaatttttttaaattattaaaaagaaattttaaaaaacgatttttttaaaaatttattatgacgaatttgtaaaatttttccaaaatttttcaaaaaatcgccgaaaataaaaaccgggcttggcagccttctccgaatacgtaaaatatccctggccatgggtggcaccactggcaaacacacaggcaattattaaaaagtatttcctttaattacatttttcagggactcccgactctcggcactcgtacaaaagg

SEQ ID NO: 61827 - DNA, 791 bp, Heterodera glycines
  Genomic contig location: Contig_ID=SeqID_31496; Location=177..967; Strand=+
  SCN-specific regions: Sequence locations=1-153,194-444,467-665,687-791
atgcctaaaattgatgatattgctaagtgtttgcatttgcgacataagcgcgccgcctttcaaagtgcggtcttattactaacagaaaaagcgagttttttaaatgtttttttctctattaatttaaaaaacttttcagccgtcaacttttctgccagaccaacgcgcggacgaaacacaacagcagcaacagttgacgcaacatcagctgcaacagttgatgaacgacatcgctgattggcttggactgtatgagcagctgcctcaagagacggaaaagacaaaaacggaaatgttcaacacattggtcaacagaaatggtcaacaggtgggcagatgactcgggaggggtggcaattaaatgcttggtgatgggtgggacatttgttcattaaccaaaaacaaaaaataatactaacccatagaattagccgcacaatttcgttttttcccttttattttcataaacatttctctcttattcacaggtcgatcagtcggaacagacaacctcgtcgctcattcactcgtccgttttgcgcgagctggcaaatgcaaagcggtgcgaagaaaatgaacgtgtaagtataaatttaacggatcgatcgggagggggggagggagtcaaaagatgtgaaaaatacaaattaaatgaacaaatttcctttttttatttattttttaaagctggtgcgcgttgtgattgacgaagacgagtcagcagatgatcaaccaccgacaacttgcagcgttgggacacagacaaagatgagttttgcgaataaataaaa

SEQ ID NO: 61828 - DNA, 793 bp, Heterodera glycines
  Genomic contig location: Contig_ID=SeqID_31497; Location=40..832; Strand=-
  SCN-specific regions: Sequence locations=1-292,349-434,457-479,526 -719,741-793
atgcacatcaaaattggtgaagcgcaagcagttacacataagtttaaagcagttaatttcaatcaaattcaaaggggtaattttatcgacgtcgaatttgaggtattttttacgcttaatttatttgaaaaggtgttttttgtgcttctattttaatgctaaaaatttcatattaaagaatgtgatgaatatttgcggagcacattataatgatcccataatgataaacatcgatataatgccagatacttgtttggtctcagataggttaataaaaccctatttacttaggttaaataaaattaataattaacttaattattaaatttaattttttatgtttaaatagcacagtccttttttgtgtttttttcttcgcttttcagtttttctcttcctcctcctcagttcggtgtattatttgtgaaggaaaatgaaacttgttcaccaaaacatattaatgttgataaaaatgtttgttttttattgtttaaatttgattaaaaaaaaaaaaaaattaaatttggatatattatagggccaattcttggcactccattcattcatttgacaattaattttggcatcctattccttcattgatcctttcaatttgcagcttttggcacttcattctccgttcttccgtacattattcttcagcgaaagtgagctgaacaaaatttctgccgttgatcatcaacatgaaattagcattgaagcaccagtaacttttgagcatttgaagcttctaattgaccttttacacgacaaaaaggcgagcaatcactga

SEQ ID NO: 61829 - DNA, 58 bp, Heterodera glycines
  Genomic contig location: Contig_ID=SeqID_31497; Location=1439..1496; Strand=+
  SCN-specific regions: Sequence locations=1-58
tgtagaacataaaaggtaactcgcccggtgggactcgaacccacgacctcagcaatcc

SEQ ID NO: 61830 - DNA, 255 bp, Heterodera glycines
  Genomic contig location: Contig_ID=SeqID_31497; Location=1507..1761; Strand=-
  SCN-specific regions: Sequence locations=1-255
gcaaataagcagcgaacagcaccgaacggcgagaagttttactatttggcgctcctgggtggatcccctccacactgccgggaccactggaccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaagaggcgcccgtagctcagttggttag

SEQ ID NO: 61831 - DNA, 827 bp, Heterodera glycines
  Genomic contig location: Contig_ID=SeqID_31498; Location=307..1133; Strand=+
  SCN-specific regions: Sequence locations=1-413,436-569,607-648,670-827
atgtgttgtgaaagtgagcacgacccgagcaagcagcatttgaagcgtcctgataaggcacaaaaggaatttgaagaaccaaaaattccttttcaaccaattccgttttcaaaaaaggaaacgccaaatcagcaacggacttttatggagatgtattccatttgtgagttggacggcaatcaacggattctcaatggttcgttctcaagaattgttgttgaaaaatcacaaaaagctcattttccctacaacgcaaagccaatcccgataaaagttaatgagtttgggaaccggctgttgttaggcaatcatatctcaagaaattttttaaatttcaatgccgaaaaaatgccttttgacccaatcaaattccatcctaataatttccaaatgaattcaagtcaagggctggcattaaaaatttttgtttcaaatgatagtcccatttcaaattttaatccgatgaaaacggagaaagtgggaaatatgccgaaaaatgaatttcatgataaaatccatcaattggaaaatgatttgaaggacgtgtccgccgaaagagatgagcttaaaattttgttggagtcaattttttctggaaaatttttgaagaggaaaggattcaaaaaattttcgaataaatttcagaagattttgaaatttcccaacaaaaaggagtatgcgaaatgtttggtggaaaaagccgaaactcacaaaaaaccaaattctttttatcatcagacagctctcaatcaaaatatttccaacaaaaacacatgtcaatcccaaaaactgggacactcacgtgttttcatcaattcaaagcttaa

SEQ ID NO: 61832 - DNA, 642 bp, Heterodera glycines
  Genomic contig location: Contig_ID=SeqID_31500; Location=936..1577; Strand=+
  SCN-specific regions: Sequence locations=1-642
atggatgtcggaagtgtcagtgccggatttggatggacttcggagtgcagtggaggcggctcggggcacgagctgtgcgagaaaatcacgctgggaagcatcgacccggtcctggacatgtcgaatttgggatcggcggtagtcaaaacgccgcttcaagcccttctcagcatctttttgctccgatcgggcgtggcttcatcgctcacggcagcccaaactttggtccagacaattgttggagcagaaccgaagctggagttgtgtatgtacacagggaaaaggggggaccaaatcagcaccggcaaatacccaacggaggaggaccaacggcaggctttggagaagtgggtcggatcgtgctttgtggctcgacaggctttaaccgagtcgggatataagcccttgtcgatgcaaatgccagagggagtcaattcgctgcccgattctgagaaaaatggcacgaggtcttcaaagacagttcatgggcactcgaacgtgtgcgggccacgattgtgcataaagcgagccgctttttggcacatgaccgtgttctgctcggagactcgtcggcagaaatgctttccaaacacatcaacagctcctactgcattggcggagagagttcgatggcagatttaa

SEQ ID NO: 61833 - DNA, 1431 bp, Heterodera glycines
  Genomic contig location: Contig_ID=SeqID_6508; Location=569..1999; Strand=+
  SCN-specific regions: Sequence locations=1-287,319-587,610-1431
atggccaaaagaatgcatctgaaccatccgatcactttcttcgggcattcccactcgaccgtttgggttttgagtaacggaggcatcggattcgacaatggcataaagcagtacaagccaaacgcattgccaagcatgggacagaagctgatagcaccgttttggaacagaaacgacttgagaaatgggggcaaagtgttgttcagagaagtgaacggtgagagagggggggggggcaattcgatcagagatcatgatcaatcggaagtgggcgaaagtgcaaaaacaaaaataattaattaaataaattaattaattgcccacaggcggtcgtgttttggagcggggtcaaagtgaaattcgctaccaatacgacagagaagtgaaggtggtgtccgctgttgtggtcacttacgaaaaaatgcaggtgaagaagaccggttggccattcataaattaatcaattaaacttttaattgtctataatcaattgccaaattgatcaattaaacttttaattgactatatataatcaatgtttttttagcccgtcggttcgtcgcccctcccagacgaagttggtgatcaaatgagtaaagaaaccaaacagaattttaatgttcgcctcccatagaatacaaacagtttccaattggtgctgttcatcaccagcaatggcacttttgccaatttcatctacagtaacatcgggtggacgcagggagccgaagtgaccgtttcaaaattggcatgcgaaaacaattcccaattttcaggccggctttaatgccggcgacggcaccaatcattttgcattgcccacctccggcaccggaaacatcatgtacttggaggagtacgggaacacgggaatcccaggagaatggatgtttattttggaggaggaacgtgtggtacggtgcaaggccggcataaaaggggacacttgcgacgagggtaagcggttactgatcagctattgatcattcagtgatcactcactaaatatcactcggaatcactcataatctcattaatcgcggttctcactgactgatcattcggtgattaatattattcacttggtgatcatcgctcacccaacacgcagtgatcacgtactgacttatcattcgttgattattcgttggcttttcatacggtgaagcctatttaatgatcggccgatgatcacttagtgatcgtatgatactcactgatatccagtgatcactcgttgaataaacatccggggatcacgcactaacttattactcactgatcactcgtttactgtgaataagtccattagcctcgacctttgctgcatcctgttgatcattttcagcatgttcgcctggtgaatggggcgaggattgtgtgaagtgagtcactgatgaatagcagacaaagatattcactaaaatgaga

SEQ ID NO: 61834 - DNA, 282 bp, Heterodera glycines
  misc_feature (83)..(84): n is a, c, g, or t
  Genomic contig location: Contig_ID=SeqID_6509; Location=1919..2200; Strand=-
  SCN-specific regions: Sequence locations=1-136,159-282
ggggacggcgaattgggcttgttcgtgctgttcgtgatcagaatgaatgttcggctcacttctgctggtgtgttcctgagtgnnttgccttttctttgtcaattttcccttttggtgtttccctctgttcctccgttgttgccatttctgtcgatggccgtgccgttctcttcgcctcgggggtcgtcggccgttgcctttgtggcggagatggcggcacggcactcgacgacgccggctcgtgctgttccggcttttcttcggcttgctgttgcctctgct

SEQ ID NO: 61835 - DNA, 365 bp, Heterodera glycines
  Genomic contig location: Contig_ID=SeqID_6511; Location=578..942; Strand=+
  SCN-specific regions: Sequence locations=1-113,135-158,180-365
atgaataactggctgcagaatattaagggtcaaatcacagaactcgccaccgaagttcttaacgatgccaccgaagagggacaagtttcggtctccagtgaacttcaggtcagttttgggtaataaaaagttgaaattttcctatttattctaagacaatatttcaggttgagaaaaagaaatgtgccgaagtggaaaggcaatttttgtcagaaaaagcaaaaaacgaagcattagagaagagagtcaaagagttggaggagcaattgttcaacacaaacgaagaaaacgacgccataaaggaaaagttcacgggaattgtcagcgatcgggagcagcaaatacagcgattgaatgtgaattaa

SEQ ID NO: 61836 - DNA, 973 bp, Heterodera glycines
  misc_feature (777)..(777): n is a, c, g, or t
  misc_feature (781)..(781): n is a, c, g, or t
  misc_feature (787)..(787): n is a, c, g, or t
  misc_feature (795)..(795): n is a, c, g, or t
  misc_feature (810)..(810): n is a, c, g, or t
  misc_feature (833)..(833): n is a, c, g, or t
  misc_feature (839)..(839): n is a, c, g, or t
  misc_feature (864)..(864): n is a, c, g, or t
  misc_feature (904)..(904): n is a, c, g, or t
  Genomic contig location: Contig_ID=SeqID_31506; Location=1..973; Strand=-
  SCN-specific regions: Sequence locations=1-45,67-100,122-352,390 -428,451-455,547-883,926-973
  Gene Ontology: Cellular component=integral to membrane
cccagaaatacttggagcagaacgagtccaaagtgtccaaaacgcatttgtacaggagggagttggtgaaacggtggcgctggttcctccgttggttgagcaacattggcatttattttgtgggaattgtgccactttttcagtgttttgtgatttattttcattttaggtcccttgggagtcgcggataaaacgaattgaaagtgaaaatttcatttaaaactgagaatttaatttaaatcaaaggccaatttggctctgtcgtgtccagttacttcacattccttcgctgggtgatcttcatcaattttattatcactgtaagttcttcccctttttcaaaatacctttgattattattattgtattaattaattatttattttttacatttcctcagtttatactaaaaaaagtaattttaagccatttttattttaattgtttttcagatcattttttattactttttaaattatttttttgtcattaaattattaatttatatttcattactattttctttcttttataaataataaatttcaaatttcacaggcaattatcattgcttttgtcgttgtgcctgaatgtgcggccgacgcgaccgccgatgccggacgccaaaatcggacggcaagtcgaaaacgcattccgcccgaggaacagtcgcacgtggacgagtgggcggtggtgtggcatttcgatgtgagttggcacaatgccaaattcggaagggacgaaattattgacaatttgacagtaattaacagtganccanccattnacagaagntcaaaaatgatttgncaaattaaattattccaaccaancctttntttttccaatttttaactttttatntttgtttcccctctttaccaataaaaagtaattaattttnctaaaattattattatttatacctatgtaagattttttttatcactctcttcggcatcatcgatttcct

SEQ ID NO: 61837 - DNA, 663 bp, Heterodera glycines
  Genomic contig location: Contig_ID=SeqID_31508; Location=449..1111; Strand=+
  SCN-specific regions: Sequence locations=1-200,237-663
atggcggggccaacctgctcaatttggtccactgggctgaacgaggcgattgcgcgcgaacggttcgcccgggacgcttctttaacagttccgcgaaacaattcgggacacgcccaattggcgttggaaatggccgtgccgccggggggcattttggtgccgcaccatttgtggcagcagcagagacagcgccaccaaatgcaacagcaacaacagcagcagcagcagaagcagcaaattcggcaaagtgtgaagagcaacatcgtcaccaaaatcaacaggcgtcgaaaggcggcgatcattgcgcgatgtgccggaggcggcactgaagccgatctcattttgatgtccgcactttctacagcgaatgccaatggcggcagcaccattgggccaccacagccacaggcacagccgacgattggtgccgtgccctcgggcaattgtaccaaccagttcccaaaaccgacaaagcaacgaactccgacgacagcgaagaaaacaattacagcggtaaaagagccatcgcagaacccacgcggagcaacgacggacatttcggagtcggacgatgagtcggacgtggaggtattcgaagtggacgagaaggaattcgggaacgacgatttgttcgagaaactgaacagactggaggagcgcaag

SEQ ID NO: 61838 - DNA, 48 bp, Heterodera glycines
  Genomic contig location: Contig_ID=SeqID_31510; Location=84..131; Strand=+
  SCN-specific regions: Sequence locations=1-48
gcagacaatcaatgaaactcacaacctcgggtgtaaattagaggggct

SEQ ID NO: 61839 - DNA, 151 bp, Heterodera glycines
  Genomic contig location: Contig_ID=SeqID_31510; Location=1198..1348; Strand=+
  SCN-specific regions: Sequence locations=1-151
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaag

SEQ ID NO: 61840 - DNA, 387 bp, Heterodera glycines
  Genomic contig location: Contig_ID=SeqID_31512; Location=694..1080; Strand=+
  SCN-specific regions: Sequence locations=1-81,112-200,233-332,354-387
acacatggccgccgggcaaggcaacaggtcggcacttcactttggcattttgggggcgagcgccggagggcgacggcatcgttttaataattttatttgaatttaaaaaatgttattcgcttaagtgaggtggtcctttggttcggttacattcgcgggggccacgtcaaaccgccggtggatttaattgacaggcgccgaaaaataaaaaaataataataatgattttattgtttttctcaggacaccctttcattacgcgtgtctcggtggacaagcgaacacagttgaagcgatggtataacacatttggagatgaccaattcattggtcaaatactttcttcatttattaatggccggcactttttctgatcactaattttgc

SEQ ID NO: 61841 - DNA, 907 bp, Heterodera glycines
  Genomic contig location: Contig_ID=SeqID_31515; Location=239..1145; Strand=-
  SCN-specific regions: Sequence locations=1-313,335-608,647-754,776-907
atgaaaattgtcaattccgatggaaaagaattgccaatccctcaaaatccgttgccgaacaaagtcatcggattcaaaagcatttcgatcgggtaaaaatttaattgaatttggaaatgatttgtgatcttcaatcacacacttctaattttcagattcatcaaccaaaatgtgatcagttttcttggccgttttgaccgctttttcgcttcatgtacaacaatgttgtccattaccactggaaatgttcgcgtttcggagttcgttgttcgcaccatttggccgatgttcaaggataccatttatcagctgagtttggacatcatcgcttttcgtcgaatgcgccaattggccccgtcaatgctcaacgactgtccatcacttcgctttttcaatttaagcaacggcatttccctcgaatttccgcccgacgacagtgccaatgcgacggatggccaagcggtggccaaatggctgttcacgcctcgtcacgataattttccgaaggagctcatatgctatatgaattcaaccatggaagaacaatggtcggcaaccgtggaacaaatcaaagcggtgatttgtctaatttaattcgtttttctaaatatttgttttttagtcattttcctctgcttcttctcctgtttcttttggcatttctgttttaattccgccgtcctcttcactttctgccgttgtgccatttgaattgaccaacgaattcaccggagaaaaattggcactgtccaaagaagatgaagaagcagatttaagtggtttttccatcattcgttgtccaattgtgcccgatgataagagacagcagcaaatgaataaggaattgggcgaccgatggaaccaaattaacatttttatcggagacgacggattcggcgatgggtga

SEQ ID NO: 61842 - DNA, 524 bp, Heterodera glycines
  Genomic contig location: Contig_ID=SeqID_31519; Location=143..666; Strand=-
  SCN-specific regions: Sequence locations=1-31,56-173,196-524
atgcgtcgtgagcaggaatattctcaattcactcggaaagaagaggaagaaaaggtaattgctgacgatgagtctcagaaactcaaagcatttgggattttccattgaaaaactccctttgtttttggttttatttatttattttaatcccattatttagcgatatgaaaaatcgaaggttgaaagtcatctaagcggagaattttgttcaaaaatgacaaacacccaaaagagtctcaaggaattttcggaggtaataaattaattaatgctcttctcttaattgttagaaattgcactaggaactttcttctgttcgtctaaacgtcaaagaattgggaaaaatcgtcgattgtcttcaaagttccgagttggctcaatctgtcgacaattatttccgtgataaattctctacgcttgtcgagctacgacaaattacttccgaggaaaataacaaaaaaatgattgccgaggttgagcagaagtttaaaactcaaacggagtacatcgcaaatgaattggag

SEQ ID NO: 61843 - DNA, 1731 bp, Heterodera glycines; identical to SEQ ID NO: 31521
  misc_feature (70)..(70): n is a, c, g, or t
  misc_feature (85)..(85): n is a, c, g, or t
  Genomic contig location: Contig_ID=SeqID_31521; Location=1..1731; Strand=+
  SCN-specific regions: Sequence locations=1-91,113-244,266-544,569 -807,830-1119,1142-1151,1175-1293,1358-1731
  Gene Ontology: Mol. function=dihydropyridine-sensitive calcium channel activity; Cellular component=voltage-gated calcium channel complex; Biological process=adult locomotory behavior

SEQ ID NO: 61844 - DNA, 2635 bp, Heterodera glycines
  Genomic contig location: Contig_ID=SeqID_811; Location=859..3493; Strand=-
  SCN-specific regions: Sequence locations=1-1197,1219-1262,1284 -1906,1928-2635
atggaaaaccgtccaaaacgcccattcccattcactattaatgatattctcaccacaccgccacccaaaaaattgcggcaaggcttcctcatcaatcagctacttggtctgaccgttcaggagggagaaggagcaacacagacaacgtcgtccaaaaaaatacccagcgaatttgtcgaaaagttggattgcaacgtcgaacacattgccaaatttcactacaccaaagtgaaatcgcgcttcgtcatccgggatgtgccagccgatcccgaaggccttctttccgccatattcaaacactgcattgatgaggcaaagagcgacagtcgtgagaagagcagcgaaccaacacaccttgggtgtctgatcagcagtgcattgttagacggcggtgatgtgttcgtacccgtgcgccaaataactgccaacacaattgacgccatcctgaatttgttcaccaaagttgcacagtcgaaacagcagaatggtgtgacgctgtggggggaaccattcaccattaccataacaactgttgaccgaagccgtctcccaacaaaaagacatctgaaagggggagcaagacgtcgtctggctccagtgcgtcaccaaatcaccgaaaagtgtctgattaaggtggtacccctcccacacatatatcatctcaatatttaaaagtttaagattcacaactcggacaacttttgtttattttatgctcttcaagcgacaatggtgtccaaaacgcgcgggctgtcacgttctgcattttatgagtacatccatggtcggtacggacaacgcggaaaatttcaagaggaaacacgacaattgatgcgacagatccgagcacctttcgacttggacacctatgatgcagacacctatgtgccactcattattgatcattggaacaacgagcagcagcagcaccggcttgcagtgttcatttttggtgcatccggacactacaagccgttgtacaaatatggcaacgacgactatgacacgcccttaattctctacttcagcaacaatcattttgacggtgttcagttcatcagcgggctattcgcgggaaaaaagtactgcctcgcttgtgagcgaccttactcgagaccgtcgctgcatgatcaatcatgcaaagcgcactgcatgatgtgctctcgagtaggccctgcattcccatgttctgcatcaccagctggctttttcaaaaaatgcgatggatgcaacaaagtctttcggaacaacgattgtcatcaacatcacttaaaatccaatttctgcaatcgatcaaagaaatgtaaagattgcggtgtcatttggaatgtgaatgacaacaaaagaaaagggcgtgaggggcatgtatgcggagaaaagttctgcactctctgcaacaatttccacagcaccgagagaggttgcttcatacaacaactcgagccaagaatgcagccaccatatcgcattgtagctttcgacttggaaacaatgcagcatctgccagccgatccactgcaaccagagcgaagaaatcacgagcccaacttcattgcagcaagagtggtgtgctcggggtgcatagacaacaacaagtggcggagcgcaactgcaggctgttcggtttgcggcccttatcgcactgcagtgttctgccaacggcctttcaacggcacaaccgttgacaaaaaggttgtgacagacaatccaatggaggcatttgtcgactggttggtcttcaaactaccgatcaagtacgacacatacgcctacagtcactttggtgggcgattcgacatggtgatcaccttccgcgagctcttccgacggggatttaacccggagatgatccgtcaggtgagaattttttgaaacatactttcatttcgctcatttaatttagggaaataaaatgtacgagatgaatgtccaggcgcagaggaaaaagaacccgaaggttgtgttccgcgactccttcaaccttatgccttgtgcgctcggacagctggtgcctgcctatggattggatgtggaagaaaaaccgttcttcccgcacatggccaatcggccggacaactacggacgacaaatctacccgacaccggacgactatctggcacaaggaatgatgcctgaaaagcggcgccaattcgaccaatggtacgaacaacaccgccacgaaccatttttgcttgacgaggcattggccagctactgtaaaaacgacgtcgacatcctcacggcagcgctcgtcgctttccgccgtgaattttttgagataacaaagaggcaggctgtaaatgagacagacgaccaagaaagcaacgccggcattgacgttttgcgggagtgcatgactatcgcaagcgcctgcatgaaacactttcgcagcaaccacctccctgccgatcacttggccatcgtacctgaaagaggctatgacaacgcgcaaaaccagagcctgcttgcccttcgtttcttcaagtggtacgaggaaaaacacggcgtcaagttgcagacggcccactcagctggtggagaaaagcgagttgccaactactctcttgacgcatggattgaggctgagaagagggccatcgaagtgaatggtatttttgatcttaaaaaactttga

SEQ ID NO: 61845 - DNA, 1084 bp, Heterodera glycines
  Genomic contig location: Contig_ID=SeqID_811; Location=3947..5030; Strand=-
  SCN-specific regions: Sequence locations=1-68,90-101,125-527,550-1084
atgtctcatcaaatcgaagatggtaaaaaatcgtgacccgtccaaccactctttttaggtgtacattgaaaaagttgtaaatttctttgtcatcagagcgcacctggggctgaattcctttgctaaccatgacgcgtgctggcagacttagggacttgggcaaatgaatcggatgatgccctcccacgcatatccgtttttgcatggtgaacgggtttggtgattccaggatgaactcaaatagttgctccaaaagtggacgaataaaaatacactaaaatataaagtttaaatgcaaataaaaaataaaatattacgttcagaatgggaacggaaatcgcaacgttattcaacaacattgctgtttcatttcccccatagcacaaatacagtaggactccttttcggaagtcatccttcgccaatccgttttcttcgcgaagcgaactgaagtccaaattgcccccctcaaactgcatttttcgcgccctgcttgccatgttaaatttcttcacaatttcgttcttaattttaaatgagaattaataataataaaaactaaaaacaaaaatacaattgctttttcagcttttgtatgtgcattctttcgtccatttcgtaaaacctcaaatttccaattaattgcgctgatcgttgatttggatgctaaacaacataaaatttaaattcgattattaccactgattacaaccatttgagtagaacaggcgcatgagtgggatgaacatgatctgctcccaaagcagctcagttgggagtggtcttgtaattttgggttttttgacatgaacaacacactccatttttcgagatttttttgtaatgaaaattataaaaaatgaatccgaatttcagctggaatttcgattatgcaaattttggttgtgcaagcacgcagggacctcaagtcgaaaaatgggcgtggcctattaccaataaccggaaaattcaactggttctaacacccgaccgatttggcaaatcatttgtaatattttattatttttggcacgccttttctttttttgttcctttctctcctcacatttttcgctcaaataaa

SEQ ID NO: 61846 - DNA, 1807 bp, Heterodera glycines
  Genomic contig location: Contig_ID=SeqID_6513; Location=168..1974; Strand=+
  SCN-specific regions: Sequence locations=1-19,132-238,260-440,462 -834,856-1234,1256-1355,1384-1618,1640-1706,1757-1807
atgcgacaaccaaatcatcataatgataataataataatgatgatgatagtggtaacgatagaggccatgatgatgatggtaatgaagtggaggaggaggaggaggaggaggaagatgatgatgatgatgacgcaaacagtccaaaaaaggcagtcaggctttgtttttttgatgctgaaacgtcccaggatttaccacttcaacttcgcaccaaggttgtacagaagcatgtcccgctgctcattattgctgaaataatctgcgaagcgtgcataaatgaaggaatttcggttcactctggtgttggacaatacgcaaatggatgtgtgtgcagtccccctgtgggaccaaggggacgtcgttggtgttccccgccatttttaaatgtgcctggagatgacagtgctctaccagcctatgtcaattacaacccacgaagactgtttttccatagttttgacaatgccaacaatgacccagtggacgactttatcaattttctcacgggaactggcccgcatggtgtcaaaacaatttgtttgtctcataatggtggaaaatacgacattcacttgatactggagacacttcaccggcgcaatttaccaccaaagcgtatttgcacaacagggctgaaaattttttcgatgactttgaaggggaaccaccaacggcatgtggtgttcaaagattcgctgaacttttttttctgtgagttggatgccctgccacgcacatttggattgaacaccgaagttgcgacaacaaaaccgttttttccttatctgttcattcggcgtgaaaatttgcatcaaagattgcgtggtttaccgcccaaagaattttatcaacctgatcacatgaaagcacaaaaaagagatgccttttttcattggtgggaggccgagaatcgcgcttcacgctttcaattacgtgaacaactcatcctatactgtatgaatgacgtggcaattctacgcgaaagtgtgctccaatttcgcaaaattattgctgagaatacgaatgggctcgatccgttcaaagtcgcatccacagcagctggccttgctttggcaactctgcgtcgctgctttcttccaatgaataagctggttaacgcgccagagggtggctatctaagggggaggagagcatctgctgaatcggcacgttacattcgttactatgaaatgacccatcctggggtgcatgttcaatctgcacagtggtccattggtgaagctaacgttgaggacactggttaccgccttgatggattagtcacacgagatccacctgaacgggaccttgccattgagtatatgggctgcttttatcacggtaaaaaatgttattattctttttctttaattttcataaaacggtgaaggctgtccaaaatgttacgtaaacgacagacaacaaaaattggcgggtggtaagacagctgaagacttgtatgaacgaacaaagaggcgattatttgaactggagaatcaacatgggtttgaattggaggttgtctggggatgtgaagtgaagcaacgccttcgagtagacccagaatttcggcggctgtataatgcctcatttgttccaagaccacttgatccaagagaggatgcactacgtggtggtcgcactgaaccatttattcttcattacacatgcaactcggacgaggagataatcctcattgatatagttataaaataataataattgagcaaaaaaaattttaattatttatttttaggtaagcttgtatccatatgtgatgaaggcattctcgtttcctgttggtaa

SEQ ID NO: 61847 - DNA, 452 bp, Heterodera glycines
  Genomic contig location: Contig_ID=SeqID_31522; Location=354..805; Strand=-
  SCN-specific regions: Sequence locations=1-60,95-452
atgtttaaaaatggaaaacagaatcaatttgcgaaagagttgggaattggcaaagatacattaagaaaatggaaaaaggaatttggtattgaaattagcaaaagtaaatttaaatttagattttttatccattcttttttattttagatggaattcgatattcaatgaagaaaaaatgagcaaaattaatgattattatgaaatgaagaatggtaatgcttctttaactgacaaagaaattgctggcattttgaaaattggaaccaccactctaataatattgaaaaaacttaaaaaatcgtaaaaatttattcggaattctgacacttaacgggcctgcccctttctacaggaaaatttgttttgtataagggctaacataacattcttcaaaatttctaaatgttttcaatcatcaacaaatttttaaaaaatcaactttttcaaataaa

SEQ ID NO: 61848 - DNA, 65 bp, Heterodera glycines; identical to SEQ ID NO: 56492
  Genomic contig location: Contig_ID=SeqID_31523; Location=99..163; Strand=+
  SCN-specific regions: Sequence locations=1-65

SEQ ID NO: 61849 - DNA, 59 bp, Heterodera glycines; identical to SEQ ID NO: 52421
  Genomic contig location: Contig_ID=SeqID_31523; Location=277..335; Strand=+
  SCN-specific regions: Sequence locations=1-59

SEQ ID NO: 61850 - DNA, 59 bp, Heterodera glycines; identical to SEQ ID NO: 52421
  Genomic contig location: Contig_ID=SeqID_31523; Location=407..465; Strand=+
  SCN-specific regions: Sequence locations=1-59

SEQ ID NO: 61851 - DNA, 59 bp, Heterodera glycines; identical to SEQ ID NO: 52421
  Genomic contig location: Contig_ID=SeqID_31523; Location=537..595; Strand=+
  SCN-specific regions: Sequence locations=1-59

SEQ ID NO: 61852 - DNA, 59 bp, Heterodera glycines; identical to SEQ ID NO: 52422
  Genomic contig location: Contig_ID=SeqID_31523; Location=667..725; Strand=+
  SCN-specific regions: Sequence locations=1-59

SEQ ID NO: 61853 - DNA, 59 bp, Heterodera glycines; identical to SEQ ID NO: 52421
  Genomic contig location: Contig_ID=SeqID_31523; Location=797..855; Strand=+
  SCN-specific regions: Sequence locations=1-59

SEQ ID NO: 61854 - DNA, 59 bp, Heterodera glycines; identical to SEQ ID NO: 52422
  Genomic contig location: Contig_ID=SeqID_31523; Location=927..985; Strand=+
  SCN-specific regions: Sequence locations=1-59

SEQ ID NO: 61855 - DNA, 982 bp, Heterodera glycines
  Genomic contig location: Contig_ID=SeqID_31526; Location=200..1181; Strand=-
  SCN-specific regions: Sequence locations=1-322,411-520,542-603,742 -818,840-982
atggcctacccatttttgcgttacagtatactaattgtcattttgtgctttgtgtacggtaatgatgaagaaaataggcaagaaacaatacaaaaagaagctggcattgatcataaaaatgacgatcatatcattggtgatgtttatcttggtgacgaattttgggaccaattttcaccgatcactgatttgcccacaattgatggagtcgaatttgttggaaatcatttaaaatatactgatcaaacggagaatgataaaactcatgaaagtgtgattgaaaataactaattaaaacattttgataatttgacacaaaatcaaaaaaatatataaaattaacaatttttaatatattgaaaaccgatgagtattaaaaatttattttaaaatatatcttttattaaaatgctaattgatttagcaattgatgacaatgaatggaaaggcaaaaaagaggatgacaaaaacaacaaattgaaaagaccaaatgaccaactgaaatctctaaatgcgattcacaagagtgaaacatctcaaataattaaaaaaaagatacgaagggttcgtaatttaattttaaaaattcgaaaaatcaaatgcttattttattaaaatattcattattttttatgaaaattttaacaaactttctgtttaatattttggattaattttagataataattaaaatatttccatttatctttaatatttatatagtataaaaaaacaaatttagcctaagaaaagcgaaatttgggaacattttatgcagaatgaacattcaaatacatgcaattattgtggtaaagaaattaaaattcaaaataaaagttcaaccttccatctttgggagcatttacgtagtcaccagacacaatatgaagcaacaaaatatgccaaaatgaaaaatgaaaatgagaacaaaaagttggaagcccagcaaaaagaaaaagaagaagacaccgccagcaattaa

SEQ ID NO: 61856 - DNA, 651 bp, Heterodera glycines
  Genomic contig location: Contig_ID=SeqID_31527; Location=164..814; Strand=+
  SCN-specific regions: Sequence locations=1-651
atggcgcacataggcatcgaaaaagccattccatgcatcatcgtcatgatcagtgagcaaattgaagaggccgtaccggttcgttaacggttgtcttggcaacagccatgcaggcaaagccttgaaacatttttatcaaatgggaaaaaatttcaaaaaatttcttgggttttaaaaaatttatgaccagaaaattacaaagttggtttctaaatatttttggccgtagatttttttaaaacccaacgaaattttttgaaattttgcaggctaatagaggattcttagggctatcgaataatgcaaaaaatgtttaatttggatgcttcttgaaaaagttattgttcactaaacttgcaaaaaattttatggtcgtgtttttttatggtcgtgtgaactgcaatagagccaaagcttgacgtcttaacgtttttgttttcgctaattatgctatattactcgtgtgcggaagcggtgccgggtgcgtggccacatgcactccaagacattggccaggccgattagggtattgaccaaagatcgtcccctggtgatcttccttgcgccgaatgtggtcggtcacccggaccaggttaggacgtgcaaattgacagtttgggcgacttaacaaaaaagagtggccataagata

SEQ ID NO: 61857 - DNA, 895 bp, Heterodera glycines
  Genomic contig location: Contig_ID=SeqID_31528; Location=68..962; Strand=+
  SCN-specific regions: Sequence locations=1-100,148-150,178-232,254 -414,465-525,550-612,636-695,721-895
atgaatgagagagtgaaaatggttagaatttttttaaaaggcccccccaaaagtgagaaaattgcaaattatggggggcttttccccctttttttagcagaaaaattggggtttgccccccagaccggttttttctgggctggtttcccccaaataaggtaaaacttcttgaaatttcattttttttgggggtttcctgaatttttccccctcatttttcaggtttttttcccctggtaaacccctgcaaatatttggtgcccccccctttccctgtttccgatgttatgcaaattgtttggcgttggctgcaacttcattcggatcaaaccttttatttgttcgtcatacaaaaaagggggtggtttgaccttagagcagcaggccccccccccccccccgaaaatttcaaggaaaatttttttttgaaaaaaataatgaatttgcaatttttaaaattatttgttcatatttttagggtggtcaatgagaagtcgtgggtgaccatttcgatgacagttggccaggtttggttttgttttcgtttttcaaattttcgacaccaaaaatttgcatttgaacaaattaataacattttttcagctctacgatcaggagaaggatgaggacggctttttgtacatagtaagtttcttttggccaattaataaaaaactatttcatacaatttggtgaaaaaaaaaaatttttttttttattgggaaggggaagggaatccgtttatacctccccaaattcgggatgttttaccaactaatactcatcttggcctccgcgtttttcggcactgataattaatttggatgaattatctatcggcaattaatgaattcaattgtttcaggtctatgcaagtcagcacgcctttggatga

SEQ ID NO: 61858 - DNA, 59 bp, Heterodera glycines
  Genomic contig location: Contig_ID=SeqID_31529; Location=110..168; Strand=-
  SCN-specific regions: Sequence locations=1-59
aacattctccttctctagtctggctctaccaaacactcacacgatatttgaaatgctaa

SEQ ID NO: 61859 - DNA, 59 bp, Heterodera glycines; identical to SEQ ID NO: 52421
  Genomic contig location: Contig_ID=SeqID_31529; Location=240..298; Strand=-
  SCN-specific regions: Sequence locations=1-59

SEQ ID NO: 61860 - DNA, 59 bp, Heterodera glycines; identical to SEQ ID NO: 52421
  Genomic contig location: Contig_ID=SeqID_31529; Location=370..428; Strand=-
  SCN-specific regions: Sequence locations=1-59

SEQ ID NO: 61861 - DNA, 59 bp, Heterodera glycines; identical to SEQ ID NO: 52421
  Genomic contig location: Contig_ID=SeqID_31529; Location=500..558; Strand=-
  SCN-specific regions: Sequence locations=1-59

SEQ ID NO: 61862 - DNA, 59 bp, Heterodera glycines; identical to SEQ ID NO: 52422
  Genomic contig location: Contig_ID=SeqID_31529; Location=630..688; Strand=-
  SCN-specific regions: Sequence locations=1-59

SEQ ID NO: 61863 - DNA, 59 bp, Heterodera glycines; identical to SEQ ID NO: 61858
  Genomic contig location: Contig_ID=SeqID_31529; Location=760..818; Strand=-
  SCN-specific regions: Sequence locations=1-59

SEQ ID NO: 61864 - DNA, 59 bp, Heterodera glycines; identical to SEQ ID NO: 52421
  Genomic contig location: Contig_ID=SeqID_31529; Location=890..948; Strand=-
  SCN-specific regions: Sequence locations=1-59

SEQ ID NO: 61865 - DNA, 345 bp, Heterodera glycines
  Genomic contig location: Contig_ID=SeqID_31531; Location=16..360; Strand=-
  SCN-specific regions: Sequence locations=1-294,316-345
atggaccgacaaaatgacttgcgacagcaacaaaacgttccagaatttatttgtcaagaaagactggacacaaattctccaattgccttcaaagaacctttgccaggggcgtggaatttgcacagcgagtatttggtgggccgattcttaaaagatccttttgcatttcgttgattttagtcgacgaaaacaaaagaggaaaaggaacgaaatgcttcacgtttcagaactgagttggatcccgaggatgtgaagctggtcaatggtcatcaccaaccgatggaatactttgcattttatttttcagaattgggtcatttatcggctgacaaattgatggaatat

SEQ ID NO: 61866 - DNA, 1258 bp, Heterodera glycines
  Genomic contig location: Contig_ID=SeqID_6514; Location=293..1550; Strand=+
  SCN-specific regions: Sequence locations=1-842,864-1258
  Gene Ontology: Mol. function=signal transducer activity; Cellular component=actin cytoskeleton; Biological process=dorsal closure
gtgaccaatcatccaaggaatcggcaaaatatcctcaatcgcccaccattaaccccagtcggcttcaccaccgtcgtcagcagcaccaaatgcaattgcactcccagcaaaagggcgaaagggggcacactgtcaacagcaaagcccacacagcgaacaataaagacgccaccatggctatgacgtttatgcttgggaaggacaacggcattggcattgttggtgtctcttctgcgaatgccggaacatcgctgcccattgctaacaatgccatcgctacttcggcgtctgagtcggcgagttgttcctccgtgacgccttcaccatcgccttcaccgattgttgccttcaatgctaccaacgacgctctcaattcatcatcacctttcgtaactctccgtaaacagccgtaaggggggggggagcgaaataggcatttgacttaataatttcttttttaggtttatcggaataaagctagttttggtgataatttaattgttgtaggcaatgtcagcagtcgacgccaccgactcagccaatttcgagcagggaaagtgaagcggagcgtaaggccaagtcgcgtctgaagcgttccacccgacgttctacgcaggtgtacttcctaccttacttatattaaagctcttcttatttgatttagggtgttactttggaacaattgggcgaggtgaatatgcgaaatcattcaccaaaacaccacggacgagcggagattggcaaggaacagaagcaaaggatggcaattggacatgacggcagctgcgaattggtcagttggaatcatcttttctttttcatgaagcattttcaagcaaatgccggcttctccctgctcgtctacgtcgtcgtcctccgcctatttgacggccgcctctcaccgcgccgttgaccaacataattccaaagtcgaacgcgtcaaggagaattacaatagcactaaaaatgaagctactccatcgccctcttctaccgcttcactgattgacgatttggaaaagtacaaagaattgtacgaattggaacggagtgaaagcgaaagactgcggactgaacggcgaatgtttgaacgacgtatttcggcgttggaatacgaattggaggtgagatttagtgatttagagtaattaataatgaaaaatgaattcagaagagcaggcaattgcagacggacaatgagaagttgaaggacgagaacattgcgttggtccgagttttggcaaaactttcgaaataa

SEQ ID NO: 61867 - DNA, 1478 bp, Heterodera glycines
  Genomic contig location: Contig_ID=SeqID_6516; Location=83..1560; Strand=-
  SCN-specific regions: Sequence locations=1-606,630-749,771-985,1007 -1244,1266-1478
atggtaaacactttgaaaacgacggtgaaattgtctgcgctcaatttgggcgcaattgcagcggccaacccgaaaattgtggtgccgaacttcgcgcgcgacgccctgtcggccggcattgtgcactttggcgttggcaatttccaccggagccatcaggcgagtttttggaatttacactcaaatttcaagttcatttagccttgtttacgaattgtttcagaattttttgactccattgccttaggcgtccaattttctcagttttttggccataacttttttcttacttattagtctaaacctatcttcttggtatcaaacgaaagcttaaagtctcgggaattataaaaaccagaaaagagcaaaaacagacaaaacgaaaaaaattacaatagaaaagatgaaattcagtttttcttcgagtatatttatgaataattttttgtctgttgcttttagcccaaatttttacctgtataacaacttttatagactttaagcgtttgtttgatgctaagaataaagacatttaccaaataagaaaaaaagttatggccaaaattttgtttttgtttgaaacaatggttgaaattgggtccagaaacgaactctcctgccattaaaacgcataaacaatataaccaaaaaatggttaaattgaaatttccttttctttctattcgtcgtaacataattttttggttttcaggctttgtacctcaccgaactgttcaacacgggccgtgacttggactgggccgtcgttggcgtcggaatgagggcatcggacgagcgaatgcgttgctacctgagcggacaggacttcatgacgacggtggtcagccaggacgagcacaacaccacggtgcaggtgttgtgttttgtgtaccatctccacggtgacaagagggggcaccaccgaataatgtacccttcctccaaaagaaatttcaaatttttttgtgtcttcatttcttgaaaaaattgtttcaaaaaatcttgcgaaggtatctgagtcttatcacgaatttgatatgctgctcatttcgaccaattccaaacctcgaatccaaattcggtaaaaaatgaaaattcaaatattgcatttatagaatttttcgaaaattttctcgtctatggtaggtcaagctttttgggactagggaccataaagatacggaatttgtcagaatgagtgtcaggtacttataaactaaaactacaaatgtcaattttccgtcgttgtgtttaagttggtttttgtttttacataacatttgtataaatttgtaattttcagatttggttcgaaatttgtcaaatttctttttttcattaatttcccatttttagttaaatttccattggtttttattcagatcgttgcttccatgatcgacttccttccggtggcaaattccgcggcggttttggcccaactctcccagccgaacattcgaattgtgtcgatgacc

SEQ ID NO: 61868 - DNA, 633 bp, Heterodera glycines
  Genomic contig location: Contig_ID=SeqID_31533; Location=985..1617; Strand=+
  SCN-specific regions: Sequence locations=1-108,157-161,187-633
atggacgtaactcttcccgtcagcaactcagttggtgaatggatcggtgaggaacggggggatggcagtgttgtgctctatgcgccgtggacggacgtgtggcatgtgcagcaacaacaacaacaacatcaacaacaccaacaacaacaacagcaaaacgaggtgcagcagcagcaacaacagcttgtccggcgaacaggcacggggtggacgcggtttccagcatggaacgaaccgctcgttgccaacgattggcgagagaaggaggaaaatctgatccaaaggaagcgactacagcgtgaaaacccggtgtattgggcgcgaatattggaggaggaaaagcgagccggtgaggagcgccgcttaagggatttgcggttggagcacacatgggatggctacaaggaaggccacttcgagcgtcggcacaatgacggctcgttttttgaggccagaaaatttcttggttcaaatcgacagaatgacttttttcattttcagtttgttgctggggtcgggaagacagtggttggaagttctggaggagggctttggtgaatgatgttggcatgggattgaaagtgttaagattaactatgattggggatggtatttgacattaatcgctgataa

SEQ ID NO: 61869 - DNA, 662 bp, Heterodera glycines
  Genomic contig location: Contig_ID=SeqID_31534; Location=147..808; Strand=+
  SCN-specific regions: Sequence locations=1-662
aaaacaaaaaaatcgattttttcaagtgtccgtttggggtactcaaacaattatggggagcaaaaatccaacgcagaattaaagtacaggctatagggaagctattcggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccatctatctgggcgcatcggttcagggggactgccccgaaaac

SEQ ID NO: 61870 - DNA, 200 bp, Heterodera glycines
  Genomic contig location: Contig_ID=SeqID_31536; Location=4..203; Strand=-
  SCN-specific regions: Sequence locations=1-200
gacaatcactttctgttgacaattgtgataagcaacgcgacgaaccacgagagcatttcgtacaaacaggacggaggacgattcgactcgtcacagttcacgctgaagttccacacgaacactttgtacaaaatttacgtgaagacgaagccggcacagcagtttttgtgagcattttgtcaattgatcagctggaagaa

SEQ ID NO: 61871 - DNA, 1392 bp, Heterodera glycines
  misc_feature (1334)..(1334): n is a, c, g, or t
  misc_feature (1344)..(1344): n is a, c, g, or t
  Genomic contig location: Contig_ID=SeqID_31537; Location=3..1394; Strand=-
  SCN-specific regions: Sequence locations=1-647,669-908,930-1232,1254 -1392
atggagttccaaggccgtggaggcccgcatgcacacattgtggcccagactgacctggatgcagttccagatgttattcagcaatacatttgggctcacattccacttttgccagaaaaaggtgatgacactcccatcgcggaaatgcaccgccaagtgcgcgaattgatgcatttgcagctgcacaggtgcagcgaaagttggtgtggtactcgtgaccaatattacgggcgctgcaaaaagggcttcccagccccttactcaaaatgtacgattttgcggcccgacaggcctgcgttgtattaccggcctgcaccccaggatggtggtgccaatattgaggtaaacggcttaatatacgacaactcacaggtcgtgccgtacaacccttatgttttactacgctaccgggtacatcacaatgtgctatttgcgtatggtaacaaggcaaatataaaatatgcactaaagtacccattcaaaggtcttggacattgttatgtcgagtgcaaagaagagtccggcaacaaaatcggtatcgatgagccggctcaatatgccaaaatgaacttccgtggtgctacggaggcatatgccgttgttaactcaacaccatatgttcggctttcgcaccacgttgtcaaattgatgattcatttgccaaatcaacagtccattgtatatagggctttccagctggtgagcaaagctcagcaaatccagcaaggcacactgccggaaacacaatgctcagcctattggaaacaatggcaaaatgaatggcggcatgatcctaagttcaaggacatgcttttcgaaaaagtgccggaacaattccgatgggataaggacaaatgggttctttacaaaaggaagcccatcaaaaggcctccaattggtcgaattgtccctgttccacccaaggatccggaaagatttgcgctatattcacttatgcgccactttcccggtgaccctgaccatcttaaaatggtaaatggtcagccttgtacctctttcactgatgctgcaataaggcacggtcttcttgaggatgacaaaatctgggataaaacactcgctgaggcagcgttgtcacgatggcctgatcaaatgaggtggctcttcatgagcatcctcgtttatggccagcccagtaatgccgtcgaattgtggaacaagtacaaagaccaaatgtactttcctcaaggcattaccacatcggcacaacgccaagcagcagagcttgaagccctagccgacattgattggcggctgcacagctgctttaacttaagctctgtgcattttggcttgccagaccccgcaaactncattgccaanatacaaatgcggcaattaatgagtttttctttggcgatgatgatttga

SEQ ID NO: 61872 - DNA, 353 bp, Heterodera glycines
  Genomic contig location: Contig_ID=SeqID_31538; Location=1..353; Strand=+
  SCN-specific regions: Sequence locations=1-301,323-353
tcaaatgcaaatgccatttcgatggtccgcttttgcccgttgcgctcctttttcgcattttcgacggcgttgacagtcctttcgaacttttttcgctgcgacttaccaacaaaaattgtgctgactttgtccgctcaaaaatcagcgtaatttgccaacattgatccaaatgattggcattattcattcattcctcttcagcgtgtctctgagatggaccttcgccgcgtctcttttgaccaattgtcttcgctgtccgtcaattcgtccggcacttccgcccaatcggagaccacagtgattttgcaaggggagcaatggtgagggcactcgttcattaagcgtggtatatt

SEQ ID NO: 61873 - DNA, 419 bp, Heterodera glycines
  Genomic contig location: Contig_ID=SeqID_31541; Location=483..901; Strand=-
  SCN-specific regions: Sequence locations=1-419
tgttggtcaagcgatgcaacaacaactcttcctcatcaaacaaaaccaccgaacatgtgccatcggcgggtgccattgatcatgcctttgtcacggttgtgccacgccgatcggtcggtggggggccaaaaattgagcccacaagttgtggcaatgtgtcagtgccggagaatgaggccatccctcaactgttacgaattcgaacattgcttgacgacctaacaacaacggatgaatttacggcaccaccagcagtggtttatgccattgaaggaggccattggcacaatgccaatttgttccacattgatccgaacacgggatggatcagcagcaccaaaccgttggacagagagacaatggcggagcatctgctgatggtgtcagccaccgacttgaacactgtgccaaagaaagtg

SEQ ID NO: 61874 - DNA, 1465 bp, Heterodera glycines
  Genomic contig location: Contig_ID=SeqID_6517; Location=304..1768; Strand=-
  SCN-specific regions: Sequence locations=1-852,874-1117,1139 -1162,1184-1465
atgggcctggtaaacaaatggccaaatgggccccaaacaacccctcccctttccccagccatttttccaggtatttaaggagcccgatttcctcagttggcatgcctcgacaagtctcagctctaatccagcgctccgacaccacttcaaaccaatcaaatacgacttgactactggtttgaccacgcacaatacgacttaactactggtcgccgattggtccaattgaggcatcggatcaacaatcgacaatcgattgagagatcaaaaattttccggcatttccatttgtccttgttccattgccttgtcccatttttctaataaattttgactccgacttcattcctttgcggtcgcgtcaaattttggtgccacgacccgggaacacggcaacacaaggacggacaccaccaacgacaacagctgccaaactgatcaagcagacaaaaaagccggtcatctgttcatcactgttctgcgaaacaactaaaaaaaccttcttctgccaaccgctgttcttcaaaccaaaaagtctgatttaaacgctgagatttaaatcagaaaagaaaaaaaacaataaaaattaataaattcagtggacaaagagccgaccaaaaaaccacaaacacgtggcaagagaagttcatcaatcgctgccaaaagcgacgagattacaacgaccgaagtgaaaaaatcttcgacaccgccattgaaaaagccgaaagctctatttgcaccagcaaaaagacaattgccggccgaacaaattgctgaactcaagcaatacttcaaacaagaggaagaagcagcaaaacgtcaacttgaccgggcaattaaagaggtcaagaaaacaataaaatttaataaaaacaaagacttaatagaatatactcgtgcactatattctatcaagccaggagcaccagaaaaggtcgaggacttccttgattcattcgatccgacgactaacacagaagtgttggacgagcttgatcgtgtccaaacaaagaaacagcaactgttcgacgctgccctcacacaccacgagaaaagaattgcaaaagaagctgaaaattgtcgacacccgcacaaattccattctgatttctgtggaaaaggctcaaaaagcctccaattttaatcaacgtctgattggtcaaattcaagcattaatcaattcccccgcacgagtcaatactcgatctggaatagaaacactcaaattgcaattcgacacattgtctaacaattatacccactttgatcgatttgttcttggtctaaatcgttctgtaaaatctattcgaaaattattcgacattgttgacaatcctgattctgtcaaaccagaaattgtccttgacgatccaagctcatcataattcatttgaaggtgatcagataccattaattgtactaatttcgaaggcgatcagatactattgtgaaattgttgaataaa

SEQ ID NO: 61875 - DNA, 698 bp, Heterodera glycines
  Genomic contig location: Contig_ID=SeqID_6517; Location=2225..2922; Strand=-
  SCN-specific regions: Sequence locations=1-117,141-209,231-698
atgattggtgaggacgaacaattgcgccgcttgggggacgacccggccttgctgagtttcgtcctcggcgacactgacgaagtgaaggctcgtaagaagaagaagcggcagagcgtctcgccgccgccgcagcagccgcaagaggcggttgcgaaacagcaatttgcggcatcaggtatgtaagggggtgcatttattttgtatgtggcaacacttttatttttacaagtaatatatgtataaaaatggtacatttataggaaggtgaataattccccctcccctgggcctggccacagtgccgacactagtgcggctgaagcagccatggcacaagttgtggctgaagatgcgatcatcgcagcggagatgagcatcgccgccggcagcattcttgctagctcgtctcgtcgaggaggggatcgccactgctgaccgagctacgccgccggtgcctcggcgtcctgctgcagcagttcggcatccctcagttgagagggcggttgcagataagttaggcgtcggtgctgttcgtgcccattttatcccttactttataggcactactcctgctaatgtgcgcaagccggtcattcgccgctcatccaccgtggagcgggcggttgccagcaaaggtttgccgttcatgtctatcccctgtcggatttaatccgaaaaaatacaaaactattaataaa

SEQ ID NO: 61876 - DNA, 1612 bp, Heterodera glycines
  Genomic contig location: Contig_ID=SeqID_6518; Location=65..1676; Strand=-
  SCN-specific regions: Sequence locations=1-167,192-258,281-455,477 -1165,1187-1430,1452-1475,1497-1612
atgtgcgagtctcggttctcggttcccgactcgggaaatttctcgggtttttcgcttcccggtctcgtagttttctgggtcgctaatcacgaatatggtattcattttgacaactgcgaagcccggactcgatttcgaacaaaaagggtttttgaacatatagattgtatctgttttgttttatcagaactgttttaatttggagggtccaaatcttggggtagtgaacaaattttgttctaatttcttaaatataccgttaaggttatgtttataatcacaaacttttttgaaattttaacagaaaaaaattaagcgccacaatgttttgacattttttgtaggaaagagctgaaaatttttgctaagtcaatttacaggttgatcaaaaaaatcttttcggcaagttgatcagatcactccttcattcgatttgtctcatcgagactaatcgaatgatatatataatttatatgaaaaatcaaaattggtagtattcttcaattttaccaaaaaaaatttatggggttcggaatttttttttttgaaaattagagtaagcccattggaaggtaaaattttttcaattttttgtaaaatttttgatcaaaaatttaccctttcgaggaggtttgtttgcctttgacagtcccaggctaaggggtagtgtacatagaatacccttgtgggcaactgccaataaaggtataattcttgttgttttaggacaccatcgtcgctggggcggacgacctgaacgccatcaccggcaggaaggccaaatctgaggcggagcgaaacgtgctctgcaaccggctggtggagcgctcgctccgcgtcgccgctcagatgagacagttgcaggactacgtatgtatttttttccaacaatacttccaacattataacattttaaagtatgctgagagttccgaagcaaagcgtcgattgcgctgggcggttgcccagaaggataagcagatcagtcaactgaacaaagacaacaaacaactgcgaaaggacgtcgagcacctggaggactgcaacaatgaggtggttctgcaggtcaaacaggtattttttaatctttattggcagtagacaatacgggtaaatattaagcagcaaaacgtcaacttgaccgggcaattaaagaggtcaagaaaacaataaaatttaataaaaacaaagacttaatagaatatactcgtgcactatattctatcaagccaggagcaccagaagaggtcgaggacttccttgattcattcgatccgacgactaacacagaagtgttggacgagcttgatcgtgtccaaacaaagaaacagcaactgttcgacgctgccctcacacaccacgagaaaagaattgcaaaagaagctgaaaattgtcgacacccgcacaaattccattctgatttctgtggaaaaggctcaaaaagcctccaattttaatcaacgtctgattggtcaaattcaagcattaatcaattcccccgcacgagtcaatactcgatctggaatagaaacactcaattctgatgattacaaaataattaagattataaatgcctttattctatcataaaattaaaaaaacaaacaataaa

SEQ ID NO: 61877 - DNA, 887 bp, Heterodera glycines
  Genomic contig location: Contig_ID=SeqID_31544; Location=202..1088; Strand=-
  SCN-specific regions: Sequence locations=1-341,363-476,503-522,548 -817,839-887
atggttgcacacgccgagcaaaaatggacaaccaaagcaattacgtttccgtgcttatgtgagtccaccaaatttcgaatgggtcaacaacttcaaagaggtcgtctcgccagaattttcgtcaatttgtttttgttttaccaatttttgtgtttaggcattccgtcgtgccaccacttctgtcagttaccaaattcaactttattttcgtgtggaaacaatgccaattgcgccatttgaattgatgaacgaagtgacgaatgaaaagctgacactgaaacttagcaaagaattaggctataattgcctgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcagcaatagcatttgattttgccgaaaaataaaatatttaattaattttaggccattgtcgccaccagcggaagaaaaagaaggagaagaagaagcggatcaaagcaacaaaaatgtcgtctgattaagtgtacgaaaatgaataattaattgtatttgagaaatgatcgatctcaattgttgtgcttaatctctcagaaaaatcgattcagaaggcaagataaagtatttcgtgcatttgaaccggttttgctgcatatttagaatttttcgaaaattgaattttcgaatttttgttcgagtccgggtcaggggttcgaaatgggccgaaatagatataagaatcgaattcttcgacccagaaaacccataaaacaactttatttcgaaaaaaatttttgaaaattttctttatatcattgaaaacctaataaa

SEQ ID NO: 61878 - DNA, 829 bp, Heterodera glycines
  Genomic contig location: Contig_ID=SeqID_31547; Location=427..1255; Strand=-
  SCN-specific regions: Sequence locations=1-192,216-358,380-829
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaagtccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgatttttt

SEQ ID NO: 61879 - DNA, 912 bp, Heterodera glycines
  misc_feature (10)..(10): n is a, c, g, or t
  misc_feature (17)..(17): n is a, c, g, or t
  misc_feature (26)..(26): n is a, c, g, or t
  misc_feature (74)..(74): n is a, c, g, or t
  Genomic contig location: Contig_ID=SeqID_31549; Location=5..916; Strand=+
  SCN-specific regions: Sequence locations=1-245,267-290,328-401,430 -489,515-707,747-912
atgattagcnaacgtcnggaattttntgaattaattaacgattatacaattgaaatggccaaaccgataagatntaatgacaacactttacgagtaatatattgcaaaaaggacgagtacattaaggagcataaatgctccaatatcatgatttcgatatggtaggataataaaaaaatgggaaataaattgttttttaggaccaccgcccaggcgcggcttaaactttattcatatatggaacaaataaataattcagaaaattgcaaattaatttacacagacacaggtaataaaaaaataataacttttttatttcaatttttagacagtgtgttttttattcatcaaaaagaaatgtgtccgattaaggaagggagttttttagggtaatcatgagcaaaaaaaattttttttaatataattttagtgaaatgtcaaaagaatatgcggattcaaaaattttagaagttgtttgtgcaggtaaggaataaaaaataaataaaaataaatagcagttttaggacctaaacaatatgctttgaaattacaaaaagaaaatggagagatttggtataaaacaaaaattagaggaatgacgcaaaataagaacaacaaaattgattacaaagagttcaaggacatggttttgaattataaggaagaaaagaaaattcggtttacacactcaaacaaattcgggtaggtttttataatttttagaaaaaaataattaattttatttagaccgacgagggaaagttacgtgattagccgtaatgttacaaaggattataaaccaattcaaaagaaggggttagtttgactgtcttcattaccgaaataatattttaatttaggattattttggacgatgagaatttaactgttttgccttttggttgttggtga

SEQ ID NO: 61880 - DNA, 270 bp, Heterodera glycines
  Genomic contig location: Contig_ID=SeqID_31551; Location=79..348; Strand=-
  SCN-specific regions: Sequence locations=1-147,169-236,258-270
atgcggtgtacacaaacagaaaatggccagtttgatgaaccaattcaaaaagggaacaaagtgccaaaaggtaattaacggtgttacggaatgatctaattaaaatttcatttattgccaaggatttcattaatcacacatactttgttaaaaaagtcacaagaatgacagaagaattcaaaatgattccaagtgtagcgatgagtccgtaaatcagtgcgcatccaattagtgaccagctgggatggacatctttgaaggccaaataaa

SEQ ID NO: 61881 - DNA, 1065 bp, Heterodera glycines
  Genomic contig location: Contig_ID=SeqID_31551; Location=490..1554; Strand=+
  SCN-specific regions: Sequence locations=1-76,98-376,398-457,480 -878,920-1065
atgcttttcactggcattgaccgactgatcggaattgctttttctgaattgtgaaagataaatttagctcatttttaattatagtaatttttagtcacgataagttgaaaacgcgattgtatctggcaatgattactgtcatttctgtgtcgtttgggtgccttttcgctgttttgaattgccaacaagcaaatgaggacgatgatctaatggtcactggctcctatactgatgctttaaaggttattaatgaaaattctttcttaattctgatgcttttcataaatatttttgtcgaatattttaaatgcgctttttcagggcatgcctcggtttggaccaataattctttctattacttcaatgggttttatcatttatctctttcttggcattacaatacgtgtaaaagcatcaggtaaaacatattaaatatgatacactcagcactttttacttttctttctgtgcttttaaaattgattaaaaattccaaaaaatttataatcgcagtaaaaaagcaataggtaaaaatagttttgccatattttaccctttcattctatgaaaaagcgttaaaagtttttgccaattaatatttccattttctttcgttcaatcattggctgtaattagctaatttattctttttttaggtttgtcgtccgctgattcgttcaatcgtcgcacttttcgtgcccttttttgcattatcactgtgaatatcggcggttattttatcacaacaattgcttacttcctattagctccctcaattacttctccagtcactgagtttttctgcgctctaatggccgcaattcctatgaacattggcgcagtgtcaaacggacccattttatattttacgaggtgtcattttaattgaaaatgttttaataataatttttaatttttagtacggagtatcgacaagcatttcaaaaggaatttccatttgtgttcaaacaaactcccaaccaaaatcaagtcgtacctcggcaaaatgggccacctattcgtgtaatctcacaatcaagaataattgacagttgtcaaccataa

SEQ ID NO: 61882 - DNA, 2349 bp, Heterodera glycines
  Genomic contig location: Contig_ID=SeqID_6520; Location=176..2524; Strand=-
  SCN-specific regions: Sequence locations=1-431,454-759,796-925,947 -948,971-1336,1361-1710,1761-1968,1990-2086,2109-2241,2265-2349
  Gene Ontology: Mol. function=RNA helicase activity; Cellular component=bud neck; Biological process=cell growth
atggcggacaacgaagtgaaactgagtggccatagtttgacaggaccagtgaccagtttccaggagtcgacattcccaggtttgcatttggtgatttggggcacctttttggggtgatttgtccctcttttattggcactgaccaatagcaaaaccgaaaaataatatttgattttcaaaaattattgattttttgagccatgcccaacacatccacggcacaatgcggacgaggcatttttgtgtatggatgaattgggatatggataaattgtgtgggataagttggtttaatccccgatttctaaatttattcttgtctcaagttgaataaatgccaaaatttattgtgtttggtgattcgtaaaatgcggagaaaaaattttttacaaaaaattttcctaaattgcattgacacagtctcgtgtcatctaaaattttatacagaaaatactcatttttttttctttcagcaccaattgttgcccaactgtccagcgtgttctccgcgcccactgccatccaggcaatttcgtggcccgtcgcactggccggaaaggacttgatctccatcgcaaaaacgggcagtggcaaaacgctgggcttcactttgccaggtttcggatttcctttccccgattttttagtgctgataaatgtgccccgccggtggtaatcgttattcaaaaaatttcaagtttcatcctgttgtttggtttacaaaacaaccatcatttaaataaaataaattttcatccaaattcatggtatatgtttctgattttgtcaaaattggtggtcatgttcggtgatcagtcaaactcaaaaccaacccagacaacatgttcataaacaaacttttaggacaacaaatttttgtattcttcgaaaatgggagcgaagagagctatgggtttcattacccattatataaaaaatatattttcaatgaaactaagaaaaatgaagaattttgaattgatcataaaccggtcaaaatttcgccgagcaggttggcatttaatacaaccggttccatggcccgacctttccaaaaccagtcaaaccggattcttcaaaaagtggcggtccggttttgccgggcccgataaaaacatgtaccggacatggccagggttccgcatccacttacaattagcaggaactctctgtcccgggttttttgtgaaaaatactgggcacataagttttaattgacccaatttttctttctttgattaccatttcattttcagccattgtccacgtgctgaacaaccaacgaccgcagcagcagcgtcgtcctggcgaaggtccggctgttgttgtgctgttgccaacccgtgagctggcccaacaggtggagacggtggcccgtgaatatggccaactgatgcggctcaatgtggtcgcgtgctatggcggtgcatcaaagtggccccaaatgggtgcgctgaagcgcggtacgttcgacatttaagaaaaaatttgttgcttggtagtgcggaacccccccccccccccaaaaaaaaattattttgtttgaaatgtaattcttccgaagggagtcgggccaacataacccgaaacttcctgaaatttcgtcactaaactttccaaaatttaggcgtggacatctgcattgcaacgcccggtcgactcaacgatttcatcagttccaacgctgtgtcaatggaccggtgcagtttcctggtgctggacgaggcggaccgcatgttggacatgggttttgagccccaaattcggcaaatcatctcgaaaattcgggtttgttttttcgcgactatgaatagcaatttgaatgacaatttgtgttttgtaaatccattttttgagtcaaaattttgtaaatcctttttgggtccaacctactatggatcataattggattttggattaggcatcccctttccaatatcctacatggaaatttttcggattttacgggaaaaaatatgtatcattctagagaaaaatttgccatatattatatatatatcattcttggtgaaaaatcggagattttttcataacaccgcaaattctcatacagcggtggtcatccaccatttcttacccataaaaaatattccaaaaactttttaaaatggaatttagacggatcgccaaacactgatgttctcagccacatggccaaaggaagtgcgcaaattggccgccgactttcagcgtcagccggtccatttgactgttggctcgttggagctgagcgccaaccacaacatcaaacaaaatgttgaagtgcttaccgagcatcggaagccccaacggttgtccgaattgttgcagcagatccttgacaaaatg

SEQ ID NO: 61883 - DNA, 179 bp, Heterodera glycines
  Genomic contig location: Contig_ID=SeqID_6521; Location=297..475; Strand=-
  SCN-specific regions: Sequence locations=1-179
tttcagatcagtaaatcaaacttggacgacgatttaattcagttgaaatgcaactgaatacaagcaattatcattttttcaatggccagccaagcccagcgggggccacccaaagcaacaacaaaaatttctttagtggacaaccaaattacagcaacaataacagtaattggaacagt

SEQ ID NO: 61884 - DNA, 1705 bp, Heterodera glycines
  Genomic contig location: Contig_ID=SeqID_6522; Location=422..2126; Strand=+
  SCN-specific regions: Sequence locations=1-136,161-319,341-370,423 -524,547-1705
  Gene Ontology: Mol. function=acid phosphatase activity; Cellular component=integral to membrane; Biological process=regulation of cell cycle
atgggccaattgtaccgacttggccaatggattcgtcatcgttatgatggaggtgtgtatatataagagaaataaaaaaagaattcaaactaaaatcattaaaatttgatagaaatttcatggttgaaaaaggcagtttaaaaataaatattttaaaatacccaagcctggggaatccatgtttttcgtgccgaacctggacctggattttttttttcatattttacctggaccttgctttcctggataaaaacgcagaaaaatccaggtccaggaaatgtccaggttgcgcaaaattggcgtgaacatggaccttgtgaccaaggaaaaatccagacctggacccaggtccagcggtcaagccctaagcaattaaaaaaactttaaaactataaaaaataaaataaaatttcaaaaatattccaagttacccatgcttgattgaaggctttttatcgccggattacaatgttaatgagctctatgtgcggagttccgacttcaaccggacactgatgtccgcacaggcgctgctcgccggcctctatccgccgaggccggacagagcgttcgaaccgggcctgaaatggcagcccattccggtacacaccgaagcgcgagagaccgaccgagtaagcaatgccgaaaaagtgtgccgaaccggaacttatttgttagcgctatttttcggcaacccgaattttggcacagaaatatcgggtcggctcgcattatggcgggcgctgtgttcgtccttgcttcaaaaaaaaaaacttggaaatttaaaacgaaaatgtttttgaaaagactagaaaacccaaaaaaaaaatgacaaatttctcagagaaaggttttttttttcttgttttttctaaattttttggatttttttgggtcattcttagaaaggaaaaaaattcttcgaaaaatttcttggaaaattattaacatttggtaattttctcaattcgattctcatgcggagggaatgaactgctccgtttcgatgtatttgagccttgtcttgtcgaccattgcaattgaaccaccaggtgatctttgacggttcgaattgtgcgccaatgttggaggaggaacggcgagtgttcagcagtgccgaagtgaaagaaattgagcgccaaaatgccgactttttgcgcttccttgccatccagtcggggttcgaacaaattccgttaccatttcgcgaaacgcgctacgtgttcgacccgctgatttgcattgtaagagacgaacggaagaagatgaattggttcttggattagggttgtccccgtcgcgctgtgacccccaaatcccggactagacaaatccctccatttatatccaattccggaaaacgatacccccccccccccctcctcctaccattcaacattcgacttcgaaattttcgggacacaaaattcggaattcttggcccccaaaaagttcgaaagtcgtaactccattatatatttataaattcttcgactgattttgtgaagcccattaattaagttgaaaccacggcataataatttttgaaaaaagtatcgttttcctttttttcagaaatttaacggggagggcaaagaattgccaaaatgggcaaacgaatcagtaattgaacgcatttggcaactcaacgacctttcatccaactacctttacaagacaacaaaattggtccgttttcgagccg

SEQ ID NO: 61885 - DNA, 172 bp, Heterodera glycines
  misc_feature (15)..(15): n is a, c, g, or t
  Genomic contig location: Contig_ID=SeqID_6523; Location=1..172; Strand=+
  SCN-specific regions: Sequence locations=1-100,122-172
taattaattagtatntaataattagggctgccaaaaatatgtacaaaaaagtggtcaaaatatgtacataaatatgtaagaaaaatcccgaaatatgtgtacaaaaaaccccaaatatgtaccaaataattaagtaaaatttttttaatggttattattttggaaaaaaatt

SEQ ID NO: 61886 - DNA, 819 bp, Heterodera glycines
  Genomic contig location: Contig_ID=SeqID_31552; Location=189..1007; Strand=-
  SCN-specific regions: Sequence locations=1-506,528-659,686-768,811-819
caaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 61887 - DNA, 301 bp, Heterodera glycines
  Genomic contig location: Contig_ID=SeqID_31552; Location=1127..1427; Strand=-
  SCN-specific regions: Sequence locations=1-301
attaaagtacaggctatagggaagctattcccgaaggcttactgtgtccccataaatctgggcgcatcggttcggggggactgccccgaaaacaaaaaaatcgattttttcaagtgtccgtttggggtactcaaacaattatggggagcaaaaatccaacgcagaattaaattacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 61888 - DNA, 827 bp, Heterodera glycines
  Genomic contig location: Contig_ID=SeqID_31557; Location=47..873; Strand=-
  SCN-specific regions: Sequence locations=1-192,216-358,380-827
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaatcgatttttt

SEQ ID NO: 61889 - DNA, 438 bp, Heterodera glycines
  Genomic contig location: Contig_ID=SeqID_31558; Location=376..813; Strand=+
  SCN-specific regions: Sequence locations=1-438
aaaatggtctaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 61890 - DNA, 869 bp, Heterodera glycines
  Genomic contig location: Contig_ID=SeqID_31560; Location=58..926; Strand=-
  SCN-specific regions: Sequence locations=1-66,94-130,158-266,369 -424,691-869
atgggcctgggttttctggacaaaaatccaggttgccgaaaatggcatggacctggatctggatccagaaaaaatccaggcctggatccaggcccaggtcaagctctaaatattttacttttagaaagtgttattataaaaaataataaaaaaaattcaatgataataaacaagaaagtttctgaagaaaatgctgatcacaatgctaagaaaacaaataataatcagttaattataattaatttgtcagcaaaaaagaattctttaaaaaatgaattaattaaaaaagaagaaaatgaaatggaaaccccaaaaaaagaggaaataaaattaaagaaaaaagaaaaattaaaagaaaaatgcaaaaatgatttgttgaaagaatgggagcggattagcccagtgaatatatgtggtaagagcgaattttaatattttactttttttaattataaatttaatttcgtaattgaaatatttttttaattagcaattaattttacttaaatttaataattactttagttaaattttagtgattatttttaaaaattagtttttttcatgttttagtaatacattttttgatacttttactaaaactttttttaattttagaaattagtttgcttaaaattttcgtaattattttttaaaattttattattattaattcactttttaaaatttgtaatggtatttttattaatgcatcaagaaaatgcggtaaaaaatttttcaaacgagtttatctatcactattttatatgattttttaaaaaaagaaaaaatcatatttagcatttttggatgactcatttttatatgggaaatatgccgaaattttgtcctcgccccttgacggatga

SEQ ID NO: 61891 - DNA, 283 bp, Heterodera glycines
  Genomic contig location: Contig_ID=SeqID_31560; Location=1070..1352; Strand=-
  SCN-specific regions: Sequence locations=1-67,90-105,128-241
atgattgaaaagcaaaacaggtaaaaatgctatttgtgagcttttcatgtgataatctattcgcaacaaataatttaaaacataaaattcgttcctgacgataacaaaatataaaattatttaaaaacatacacataataaatcaaaattttcagttttatcaacaaaccgagaacagagaaaaaatattttgcaatttttgacattggaccatgtcaaaattttgttcaagaagcttgacattaaattttataacaaagattttttagaaaaaaataataaa

SEQ ID NO: 61892 - DNA, 2120 bp, Heterodera glycines; identical to SEQ ID NO: 6525
  Genomic contig location: Contig_ID=SeqID_6525; Location=1..2120; Strand=+
  SCN-specific regions: Sequence locations=1-487,509-601,623-943,981 -1272,1294-1307,1330-1532,1555-1734,1757-1794,1830-1941

SEQ ID NO: 61893 - DNA, 97 bp, Heterodera glycines
  misc_feature (35)..(35): n is a, c, g, or t
  Genomic contig location: Contig_ID=SeqID_6526; Location=1550..1646; Strand=-
  SCN-specific regions: Sequence locations=1-97
atgttgtgcagtctgcccttccgtggaccagcacntgctccatctgctccaggcccaccctgtggccaatcagctgctgttcctccagcaattgctg

SEQ ID NO: 61894 - DNA, 505 bp, Heterodera glycines
  Genomic contig location: Contig_ID=SeqID_31562; Location=1020..1524; Strand=-
  SCN-specific regions: Sequence locations=1-72,94-505
  Gene Ontology: Mol. function=transposase activity; Biological process= DNA transposition
atggctgaagccaaacgaattgggcgagccgacccccaggcgtcttcaacagcaccgaaggtattgctgtgcgtctggtggtgttcatcagggttggtccgctatgaacttgttccggctgggcaaaccatcaacgccgacatctaccagcaacaactgcagcgggttcatgaccaaattcgtcgtcctccattttctgcaaaattccgcggcggcgtactcctccatgacaacgcacgcctagatgttgcgttctcaacgcaacaaaaaattgagcaacttcgatgggcggttcttcctcatccaccatacagcccagacatcagcccgtgtgactactatctgtttcgatctatggagcacttcttgagagggaaagaatttgcagatcaaaacgaggtcgaaaatgcattggatgactttattggatcgaaaaatgatcagttttataaaaaggggattgaaatcttgcccgaacgatgggggaggatcattgatcaaaatg

SEQ ID NO: 61895 - DNA, 540 bp, Heterodera glycines
  Genomic contig location: Contig_ID=SeqID_31563; Location=230..769; Strand=+
  SCN-specific regions: Sequence locations=1-108,130-184,208-243,271-540
atggtaaattcaggcgatacattttatggaattcttgaactttttaacgttaacttgccaattagaaattttttgaatcgtaatggaaaaaaataggatttataaattagggaaaataaagaaataatccaataatgggttttcaatgagaatgggtgtcaaaatattgagtttttagattaaattcgttaattaaattaaacaattatcagcaggatattgtcaatgaggaattcggaaaattaagagaaatgaaagaagaaaacaaagacaatgaaaaggtcattggagaagaggagttgatgaatcaggcacggcctatttcacatttcacagcaattcttcggtttaatgacttgattaattaaaacaaaaacaaaaaaataggaattgatgccaaaagcgagtgcggcacacgattttttactaagttttaattgaaactgaatttttgcagtccatctcgcaaaaaaaaaaaacaaagtcaccaaatggaagacttgacatgaattggaataggccgcaagataggggacttta

SEQ ID NO: 61896 - DNA, 547 bp, Heterodera glycines
  Genomic contig location: Contig_ID=SeqID_31565; Location=395..941; Strand=+
  SCN-specific regions: Sequence locations=1-84,123-206,243-369,412-547
  Gene Ontology: Mol. function=long-chain-fatty-acid-CoA-ligase activity; Biological process=gametogenesis
atgtcagacagaaaggacagtgtgacaggagggaaacgaatagagcaggaacttgctgaggacggccgtcctgtttacatcgtcgtattgaccattttcttaaaagggtttttctttttgtatgacttgctcgtctttattccgttcaaattatttgctgatcctgaactgaaaaaggagcgctctcgtgaacaaaaggtttttgaacccatgtaaaaataaaaacaattggaattcaggccgttccgattgatgggaatccggcttcaccatggcgacacgtcgacaccattggcactgctctgtacaccgaactttttgaggactgtccgacgctcggcaaaatttgggacaaagcggcagagtgcgcaattggcctttatttaaaaattcttttctgtttaaattaaggttgcaccgtgggcacaattgcatgggaacgcgcgacattcttgaggtcatccaagaacgacagtcggacgggaaaaccttccagaaattggcacttggcaaatatagctggatggattacgaacatgttgatgaa

SEQ ID NO: 61897 - DNA, 1080 bp, Heterodera glycines
  Genomic contig location: Contig_ID=SeqID_31566; Location=23..1102; Strand=-
  SCN-specific regions: Sequence locations=1-192,214-671,695-1080
atggacttcacaactaccgacagtgcaacaaacacggatttgacaacggtggacaaggcaacggacgtggatttggcttatgaggacgccgcgacacaaaccgaccaattggacaaacagttgaaggagcaggaacaagtgatcagctttcttcgacagcaggtccgcaacagagacgcaatgatcactgcgcttcggcggcagttggaggaaaagatggcaccaccgatggagacaccgaccaccagcaaaagtgagtgaaactaaaatcccctttttatctttttcaaataattttctctttcttaattttagcaactccaacaggacgaccaaagatgaatgtcgatcatttgcagcgcacctcacgtcgcaaattggcagatcaaattgcggatgtaataagccgcgacagatcacgttccgccagccgggcgtccctcgaagggatcagtcgggaagttcggcacaaatttgctcattacacgccaaaaaagaagaagcaacaactgccaagacaaaacgattcagtcgacccagaggatgctcttctgatcctcgggcttgtcggtacacagaaggcttacagacgactaaaaggcactattcgtctgatcaatgcaaaacttgatgtgtttccgccactcaaaaaagtaaaaacatattttagcattttttatattatttaaaaattccattgattattgttaggtgcttgacatcaaacgccgtatctgtgggccattgcaatacgcaccaattgagaccaatgtgggtgttggatttgtgtgcactgatgttggggcagctttggaggcgcgtcttttgtctgccaaagacaatctgatcacctttggcggcgaaatctacatgaagctgagcggcgaccatggccagagttgtacgaagattaccatctcattcagccaggctgctcggtcaaattcaccatcaaacaatttcgtctgtgccgttttccccgcgaaggatagccgagaaaacttggagcgctatggaggcacactttgggaacaaattgacggaattggcacattggcggaaaagcgagtaaagtggtaa

SEQ ID NO: 61898 - DNA, 112 bp, Heterodera glycines
  Genomic contig location: Contig_ID=SeqID_31570; Location=99..210; Strand=-
  SCN-specific regions: Sequence locations=1-18,40-112
atgattatgaaaggaggtaaaaagggaaagaaaaaggcacccgttcaaagagtttgccggaaattcgctcgagtcgaaaacgcgaaagaatgccgtggaaatggacgaggag

SEQ ID NO: 61899 - DNA, 1146 bp, Heterodera glycines
  Genomic contig location: Contig_ID=SeqID_6527; Location=100..1245; Strand=+
  SCN-specific regions: Sequence locations=1-110,132-298,367-504,560 -601,901-902,978-998,1035-1121
atgtccttgagattgttttattgtccacaaatttattcccggtttaagtgcacatttattttcttattgcttttccttatatgtaaaatattcctcaaaaaatgggctaatttaaaatagcttaaagcattaaatatgtggacatgaaaaatggcataaattttttaaaaatttagcgcatttttttttcaaatcgcaaacaatgcttctcctcattttattcccatgcattttcccccaaattgcttctctcaatttcaattggtggcatcaacatcctcaatcgaggcatcagtcgataaaaaatagtaatttaattttattatttattattttaattttaattaaaattcaaaattaaaaattcattgtttatagccatccaaaaatgctgccccaagtatgaaggaacatcgactccaatattttgctgtgtcgacgaaatgttcgacaaggcaccggaatttccccaacagatgtgcaaggacgacaatgttgaaatggtaaaaaaaattatatttaattaaaaaataaataaattataaaaaatattaaaaaagttttcctaaatttgtgagatggtaacaaaaaaattaatttgtatttaataatatttgtttaaaaattattttagtatttaaaataagaaacaaaaaactcatagttttatttttcaaaattttttttttaaaatatttcttttaattaattttcctgaaaattttaaaaagttttttatgtaacttgtatacatatatcctagaaaaattaattgtaaaattgaatttgctcataaaatttaaataagaaattaaaaaaataatattttttattttgcaaaaatattttttttaattttttactttaataaatttctaaaaaaactaaaaataaataaatgattattaattaattcatttattgttttaatttcctacttatttatttaaaaatatattttgtaaaatttatttattataattaatttttgaaaaagcattaaaattatttatttatagtttttttaattttaagacaaccattttcaagacgataagttgtgcgcagactgaattccatcgtcagaccggccgagtacatccgccgacggacatttgccgtaattttaaataatttaaattaaaa

SEQ ID NO: 61900 - DNA, 1103 bp, Heterodera glycines
  Genomic contig location: Contig_ID=SeqID_6529; Location=394..1496; Strand=-
  SCN-specific regions: Sequence locations=1-78,100-139,186-273,295 -363,417-502,527-544,567-571,596-743,798-800,823-872,953-1103
gtttcgttggtgctgcattgaattcaattgttctgttgatcggactgcttaaagtggacactgcggataagccaagacaagtgggaaaaaattttgattttcaaatttaatcccacccaactcattgtgatcagctgagaaaattttgaaatatattttaaattaattgttttaatttatttaatcccatcccagatcattgtaatcagcatgactttggctgatttattgacttgcctattttacatgctgaccagaccatataagtttttgttttttaatttaaattttattggattgatattttattttccaaactaaattttaaaaccattccccttaatcttcacagtttttttatataaatgtcaaaaactaatttttctttcaaaaattacccctaattaatccccaactattttcggcacatgttgtttgttcatcaaccatatcaaaaaaggtttttggacatttttctgacctcgagactgggactcaattgtcttggacctgtctttagtaactttttcggaattttatcaataaaatttgaatttttcaaaaactttaccaattttaattttccaaatttttacacatcaatcggctgccggcctcactttgtcacccttattatgtgtgcattgtaactcctcaactgtgcagttgcctatgtcttctgtggattaacgtaaaacttttttggtcattatataattcggatttaaattttaaaaaccgtcaaaataattacaaaaatttaaaaaattaatttatttgaatgtaattaataaaatgccaacattttcaactaaaactgaatgcaaagagaaactgaaaaatcttaaacattcatgttttaaaaaatcgcctaaatttatttatttttttgatttttgaaaataaaaaattgaaaattgttgcatataaattttaatgaaaattattttttgtaatttcaggttgacaaattgattttcattggccgtcctctgcactattatcagctggtgaagcgcgatcgggttctcattctgattgcattgtcatggctttgtttgatcagtttggtgatcacactttactcattcatggagattaaa

SEQ ID NO: 61901 - DNA, 719 bp, Heterodera glycines
  Genomic contig location: Contig_ID=SeqID_31573; Location=181..899; Strand=+
  SCN-specific regions: Sequence locations=1-174,196-380,403-484,507-719
gaatgtatctgtgatattcaaccaattgcgtcggttggaatgtttttgaacggttacacgactcccctcttcggagtgtttgtcgaactgcacgactggagagacacccggccaattatgtgttgttcaggtgggaagaaagcactgtttaaacggacttacagcatgagaatcatttcaaactgaaagaaaatcaattctttaataagtagacctgctcatggatatattttttattttagaaaaggtcagttggccacttgctggtacattcttctgtccggatcggtgttcatgtgggtattcgttctttatgttcttatcccaattgctattgactttaattttctaaaacccaaaaatatacactgtacaacgggatttattttttaacgaattgaaaattccataaaaattaagatttcacataaatttggtagtttttgaaaaattggacagttttagacaagttattaattaatcactattttttaataagttttgattagcagaggcaacataaaataatccctgaaattttcaggaacaagcaaatctacttgcccattggatggtatgtctgttttggattaattgatattatcttcatttatttgtcaatgctcaaaattagtcttctttttttgcaaacttccgccccgttttcaccaattatttttttgaaaagttcaaaatggctacaaattcgtgctatttag

SEQ ID NO: 61902 - DNA, 591 bp, Heterodera glycines
  Genomic contig location: Contig_ID=SeqID_31574; Location=233..823; Strand=-
  SCN-specific regions: Sequence locations=1-332,355-591
  Gene Ontology: Mol. function=troponin C binding; Biological process =growth
atagattgaaaattaatgactgagcgtgccactaagtctggtttagcggctgaggcccaacaaaaaattcacagcaaatttgacttggaattatcgaaacaaatatttggatggatttctcaagtcactggtgaatcttttactgtcagtggcgaagtggaagaatttttgtctaccctcaaagatgggactgttttatgcaagtaagatgagcataatctaaaacaactaaggcgagatgaaaaatggataacttaatttttaaggctcgcaaatgcgctgtcgcccaattcgataaagaaaataaacaccagtaattttccattcaaacagatggaaaacatttcattctttttgggttttgctgaaaaatatgtgaacaaaagtaagatgtttaactaaaccatcaaattaatataattcaataaatcagaaatcatataagaattctttccagctttttataagtttctactttcctttatcaccaggtgaactgttccaaaccgttgatttattcgaagggcaagacccaaattctgtgctcatttgtctggctgcacttgctcgaaaatcggagaaatcatttgg

SEQ ID NO: 61903 - DNA, 60 bp, Heterodera glycines
  Genomic contig location: Contig_ID=SeqID_31575; Location=336..395; Strand=-
  SCN-specific regions: Sequence locations=1-60
agagcccgtgaacagctgcatcggatgcaagtaccgccgttgctgtacgcctaacagttg

SEQ ID NO: 61904 - DNA, 57 bp, Heterodera glycines
  Genomic contig location: Contig_ID=SeqID_31576; Location=25..81; Strand=+
  SCN-specific regions: Sequence locations=1-57
gagagcccatgaacagctgcatcggatgcaagtaccgccgttgctgtacccctaaca

SEQ ID NO: 61905 - DNA, 714 bp, Heterodera glycines
  Genomic contig location: Contig_ID=SeqID_31577; Location=323..1036; Strand=-
  SCN-specific regions: Sequence locations=1-38,80-372,397-464,549 -561,589-693
atgagccaatgcgttgcctagtactataatttcattcgttatttttaaatattttattttataattaaaaagtttatttgtattcataattgtgaccgtcccatttcagatatcgcacgatttaaatgaagatgagagacaatatgcgctgaattactgccaaatgcaaaagcaacattatttggcaccagaagaggacattccatgggacaattgggcgcgaaatgcgcatcagccgatcacttattattaccacgcggtatttttgttttatacactttcttattgctgtaacttaattagcttaactcatttacaacagttaccttaattattttcgaagtcatcaaaaaaattcacaccgaccgggaaaattgttagcaatttatgttttattttaagtttttttttagaaaaaattgtactaaatttataatgtcaaatgaatctttttctggtttgaattattaatttatccaactgttttatttaattattgtattcatttagtttttattctaattatttttttcaaaattaatttattttaaataattacctaatcaattttttccccatttggtgggtgcccgctatgctgcttttgcaagcgattctcttctacctgccaaattttatttggaacctccttaattcaaatagcggtaagtcctaaaaaaaattggccaattctttattaattttaaaaataaa

SEQ ID NO: 61906 - DNA, 1192 bp, Heterodera glycines
  misc_feature (1119)..(1119): n is a, c, g, or t
  Genomic contig location: Contig_ID=SeqID_31579; Location=1..1192; Strand=-
  SCN-specific regions: Sequence locations=1-655,678-736,758-1192
  Gene Ontology: Mol. function=acetylcholine receptor activity; Cellular component=nicotinic acetylcholine-gated receptor-channel complex; Biological process=synaptic transmission
aaggcggatgtttatgcgaatggcagcgttttttgggaaccgccggttcggtcctccgtttctttgtccaccgaccggtggtgttcttcaggtggtgtacaattcgatgtgtgccattgacatcaaatggtttccttacgatgagcaggaatgttacatgaaattcggttcgttcactttccccgcccctcggctcaaagtccattcgcaatttttaggctcatggacctacggcggatttgaacttgacatggtccacgtgggttttttcatttgccctttttgttgaaactgtcacgggcaaatgttgcagttggacaccgacgtggtggaacacgtcagccaggagaacggcaccgtttggaacgtggaattgggcgtggacatcagcgagtatcaggagtctgtggagttcgaattgctttctgtatgcttcgctattagcttacttactatgtgatatgatttgttgctttccattcttaaccaaaaggtcaccggaaggcgtcacgagaagcgttacccatgctgtgactacccgtgagtttcaaaaaggcattaggatcagcttaattggcaaagactgtcattggagatcaaaagtctgctgattgcaaatgccattaaatcagcagactgtgaacagaaggcgttgcctttcaaactttgctttgtttgtccccccttttcagagtgatcgacatcacttactttttgaaaattcgccggaaaaaagtaaattgtgcttttgttgtaacttaacatttggcgttgtgctgctttacagttgttctacactgtcaatctgatgatcccttgcgttggcattgccattctgacatcttttgtcttttaccttcccagccaatcgcacaacaaagtcatcactcatcattattaaccactccccctttattcccccccgcccatcgttcattagggtaacttagaaccgggactgactgggaaatcccgggttttctattcccggttccctttgaaagtgttccgccgttccccgcttttctgttctggccaatcacactcatcctcccctcatttgtcagatcaatttgtgcatcaatattctcgtctcacttaccgtgttcttccttctgntggtaatgtttttctctaatttcttcgcttttccgccttttttgatacttcctccttcttttggtctttggtc

SEQ ID NO: 61907 - DNA, 1163 bp, Heterodera glycines
  Genomic contig location: Contig_ID=SeqID_31581; Location=242..1404; Strand=-
  SCN-specific regions: Sequence locations=1-148,171-314,336-519,541 -1044,1066-1163
atggctaaaagaactttattacggaagcgagagacaaaaatgcacgccatacgcgtgagaacaagcggtaggagagacgaaccaaaatgcaaaggagacaaaagcccgatgagccaacaaaagtgagtttttcaccaatttttaacacaaaaattccatttttcaaatttcagacgatccacagccgaaccccaatgccgaaacgccaaagcaggacgaagcagggccgtcaacatctgctgcaccggccgaagaagcgatggagtcgccgccaccaactccaggaccagtgccgacgcccgagatggacgaggaaattttggaatttggcttttcgctgccgtcgacatatgtcacaccaatcggcgatttgaacaggacgaccaaagaaaaatgttgatcatttgcagcgcacctcacgccgcaaattggctaagtcctcaaacgtgcatcggaaatggaacatctctcatggccaaagacaatttgccaagctcttatgcattcaggccaaatcccaaaatttcacaaaagtacaaattttgagcaaatcactcccaaatttataaatttaggatcaaccactttcgccaaatgacttggacgcatttgaacgccaaattgaggagttccgtggttttctggcccaagaacaacggatgcgcgacttcctatctcagaaaccgaaggcccacttattgctcaatcatttcgtctcatttgctcggcaacactcttttctcggcttgctgttgttaaaatttctaaacaaaattaaaattggttctttctttaaaaagttataaacaaattaatagtgtcatatttaaatggtcctcaaaaaatgtaaggtcgtttaaatgcataaaattttcaaacttaaattcacaccgaccttgatcgaaaaatagcccaaagatttttttattattctgtgaaatttcagaaaattttattgaattttaaaaaagttagcgacaaaattagtgagtcaaaatttttctgaattttttggttataactttttgtaaatttttgctagattataaaaaattataatacaatggaggacatgtaaagatatcactcaataacaagaatgatttaatttgattatgtttaagctaaattatgatgtagcaaattttgtcaaatttaataaa

SEQ ID NO: 61908 - DNA, 770 bp, Heterodera glycines
  Genomic contig location: Contig_ID=SeqID_6530; Location=1023..1792; Strand=+
  SCN-specific regions: Sequence locations=1-99,121-241,269-337,365 -398,420-556,580-686,757-770
atgacaatggaaggtgctttgatcacgaatggaattctcagttcatgcttctcccaaattgaaagccatacaatacagaaggtagaattaagtttgcccccaaaaaacaagaaaacaatatgaaccaaacatatttgttcagctctcattcgatttgctcatgagtatctacaggacattcggctacatgtcaggtaaaatttacatggtttcaatgacactagcatcaattgtacccagctttttaaataaaattttaaaatattttcttggccattccgaagtggccaccatcattttgggccacgtgctcttgcctaataccgatttatacgagattttaaaaatatataaataataaaaagaatggacatttgcagtgtgccctttaaatctgaatccctattatacatataaatctatttttacttaaataatttttttccaatccctaagaattttctgaacggtctgtgcgaacacaagccatcccaggacttgtggaactacttcacactttcagccgttacataatcccatttgccaaatattaacctataataatataattaattgtttgttgttataatatgtgcaataatcttttatcattttttcattttgatctcgggcagcatacccaaaaaacttaaatatcaattagtctctttttcttaattatgttcatatatatatttgtatatttttaaatcaactattcaaatttcaacaaaaaatattattgttattattattggcaatttaagaca

SEQ ID NO: 61909 - DNA, 480 bp, Heterodera glycines
  Genomic contig location: Contig_ID=SeqID_6530; Location=2232..2711; Strand=+
  SCN-specific regions: Sequence locations=1-50,72-294,332-480
atggccagggcggcaaagtcggagaagtgtaaagaggaaggaacgtgagtgggccaaaaaagcggcaaaaataggggaggggtggtggcgcttgctgtgtatttatacaatccaaagtcctcccatggccccggctcggcttcatctcctccctacttttcctcaacttcccaatgcctttctccccatcttcaccaatttcgtgtattcatttcctattctttgcgcctttgaccacacaacttttgtgccaagaacaatcatttaattttgtcaaatattctgcgagaagccaattaaaatataattttgcattttttaaataattaatccctgtgaaatgatttatgtattagcattgtgaatacatgaatataattaatattcagcgaaaatcgattcaatttattttgttatacacgaatcaaaagaacagtagagcctggccttgaccctggatcctgtccaggccaaacatga

SEQ ID NO: 61910 - DNA, 1391 bp, Heterodera glycines
  Genomic contig location: Contig_ID=SeqID_6530; Location=2813..4203; Strand=+
  SCN-specific regions: Sequence locations=1-235,312-874,896-1221,1244 -1391
atgttcatagtttgcgccactataaaaacaaggattgttttttctttattactgctattattaattaattaccctcaatgttttgtgatgggccgacatcgaatcattgcggcagaggacatggaaacagtgctaaatcgcctgcgcccttctgtggaccgatttgatgccaattttcagcgcacatttaacgaatacggacgtgtggactccgtgcgtgaagtcagttcaaaaatttgttttatttttttacattgtaaattattttaaattatttaatttttaatttaattaataattttcttttctttctcccttatccatcagaagggatttctgaagatttttgaccccattttccaattgatttttttgggcaactgaatttcattttaataattttttgatacttggaattcttttttgaaaaaaaaaaagtttggacatggaatttcgattccgatttttaatataaacaacccctcatggccataggaactcaagaacacaaaaaagcagggttttcaacatttttgttacaactttttgcaaacttcacaaaattttggaatgttggcagaataatagaaagaacatttaggattatcccatgattcaagaattaaaaaacccaaatccccaagtgataagccaaatttatttggttttctgctgtttctttcagcttcttgaggacagtgtggtgccacggtttactgtggaggagcacggtcgtgttgattttgtggacgcttttcaacaattgcagttacgcattcaacaattttttgacaccaaaattcgcgcactccaccgtttggtgggcgccgctgaaaaggcggcacaaaaagtggacatggacaaagtgatgggtccaacgttgggcagtgagggacgctgccgggaccaaatgagggcattgaatgccagctcagtgcacaacccaagcatttggaagaaaagcaatggaaagacgaattcgggaatccatgttggcattttggggatgaaagtgcttggggacgataagcaattaggacatggaatattcaagactttttgagagattatttaagcattgattatgattttttgaactatcaatttttgtgcaagcacttggcatttggcacaaaacaggcattctcacacatattaatttaaaatttccatgccatatgcgccctgttttatgtcgaatcgggatattagccaatgaatatgaaatagattcacaaaaaattactttatttttttgttacattgttaatcaattattaaccaccgtatttactaattcctccgggctctttggggttgctgtattttagggaatacggtatcttagagaatgcttctaatacttttggaagataccattttcgtctaca

SEQ ID NO: 61911 - DNA, 1068 bp, Heterodera glycines
  Genomic contig location: Contig_ID=SeqID_6531; Location=1787..2854; Strand=-
  SCN-specific regions: Sequence locations=1-159,182-350,372-481,503 -597,619-689,711-1068
atgcagccaatgcggctttgtcgcgcagcgatgaggcacggaacaggaggaaagcggaccggaacagtcgcggatcaatgcgcggtggaagtggccgcagagtgcaagttgaagcagaaaagcgatgattgggtagtgaagcgtaactgctattccatgcggaagcccagattggaaaaactgagtcgggcgcaagcgcggaaagatgtgccaaaaaaggatgtccgtgccgtaatgaaggaagcaagcggagcaatgcgcggaaacgcgagagcgggcgcaggacggaggacagtgcggcggacagttgccattgcatgatagggcttaaaatgcataaatctgagtcacgtttctaatttaaactaattagagaatgtgtctagcaaactaagaattgtgaattttacccaggggaaagcagaatgccgaccaaaggttgggcaagagaattgttattattcttgttgacaaattcggcttcttctttgatgccctcctgctgttgctggtgttgcccgtttgattcaaacccagcggatttgaggcgttctgccaattggaatgggtccacctcatcttcctgttgtgttgtaaaaactgtttttcaaagaagttggaaactagaccactctaaaaattgattgatgcctagaaatctgattttttattagaaaatttcgagaattaagaattttatgttttttagagcccgtaggggaccgcgatccagtcgggattttcccggaatggatcccgacagaatagggatgatgtcaactccagggtcttgattcaaatctcggtaaaactgggatcttaatttcggtagtcctatcctgacttatgccaatccggacttttctaaattccggaatctactacttttttcgaccttggccttcatatccttggcgtatttacatgttttttaattgtacatacaaatcggacttcgttctgaaaatgatgttttgatatgctgattcgatgtcgttgcttcatcaacacaaagccaaccaccagcggtgtgccattcactgctacacaacgtaactgtataataaa

SEQ ID NO: 61912 - DNA, 765 bp, Heterodera glycines
  Genomic contig location: Contig_ID=SeqID_31582; Location=28..792; Strand=-
  SCN-specific regions: Sequence locations=1-90,120-765
atgaaaattgtcaacaggactgtggagacaatcaggacaacactttactatgcagttgaaaggcgcttttttggtctagcgaatttgaagtaaaaaaaatttaattaatttaaattaatgttatgtcttagggaatatgcgctagccacttttttggatgtgcgattcaaggacaaagtgctgatggaaaattccgcaacttttcgcgctcgagtcaatgtctggatcaaaaatgaagtgaaagaatgtcaagttgaaaatgacttagacgaactacaaaatgaatttgttcgtcctgtcatttcgccccaacccgaaaatccgccagctaaacgacgaatgtcattttttgaacgtctgaaacacattacaggcgcaaacacaacagaacagggtgattttgggtcatcaaccattattttaataacgaatttaaggcttccaaacatcgcaagacgatgacattgaaaaagaaaataaggaatttctcgcgctggaaattgcgaacccagaagcgaatccgttagatgaatggaagaaaattgctcctcgattttcaatccttgcaaaatttgcggaaaaatatctttcagcacctgccaccagtgtcccaagtgaacaaacattcaaagtcgcccgtgatgtttttgattatcgccgttccaaattatcacccgaaacggctgaacaacttattttttgaacaagtttcttcccccagatgaattacaattattgaaactattttcttgtgcatgtattaaa

SEQ ID NO: 61913 - DNA, 894 bp, Heterodera glycines
  Genomic contig location: Contig_ID=SeqID_31584; Location=389..1282; Strand=-
  SCN-specific regions: Sequence locations=1-227,257-527,550-561,592-894
atgccattttcgactaatggacggatttccgatcgaaaaaagggcacacttttgatggacattgaaaaagtgtcagaatttgcacgagaggaggttgggagcagtcggtacagcgaaaaagtgtacataaatggattgccatgggaaattgaagcagaaattacgaaagacactgatgagaagaaatatttgggattttacttatggtacgatgcaaaagaaggtccaattttaattactattttaaaaatatattctactgaaaaaggtgcaaattaactgttattaaatgctaattaactacgataagtaataatcattaagattcgaattggcgctgcttcgttcattctgccacttttcgaattatctcgcaaaaaaatgggacggagaattcgattgggacattttgtgatcatgtttttgacaaaaaatcaaataatttgggattccctaatttcgtttcgtttgcggtaagtgccaattcaaacaaatattttaatttgacattcgtggaccagccaatattgaagttcatttatttatttgcctggtgtaaagaaatcataacaaaataaattaatttctaaaacataaccaattgaccacgcataaacaaaaattaaattagatgatttaaattaaggaattgatggaccttaacaatggtttttacgacagggaagaagacaaagtgaaattgaccatcgatctcacaactgttgatgaaccaaaagtggacaaattcaatttggatcaaagcaattcgaaaggcacactctttatggaaattgaaaaagtgtcggaatttgcgcgtgaaataattgggagtcaacgtaaaagcgaaactgtgcacatcaaatgattgccatggaaaatattggcacaaataaa

SEQ ID NO: 61914 - DNA, 870 bp, Heterodera glycines
  Genomic contig location: Contig_ID=SeqID_31585; Location=369..1238; Strand=+
  SCN-specific regions: Sequence locations=1-230,252-870
atggaaggcacaactcatggaaaatatggcattcgcctctcatatttgtttaggtatttcttcgctgaacgaagcggcaagaaattgccacggttgcgcaatgaaaaatggaaactttcggaacgttgtgaaatcggtgagcgtaaaacggaaacaatgccaataattgccttttacaaatcactaataacgggattggatcattcagctcgaattattttctccctccactttatttgtttataataaaatccctaatacaacattttagggtttcttttttgcggggaattctccaaaattgaaaaaaatccctgaaactcgtcaaagttattaaccttttttcagatatcagttctttgaacgccgccattgacagtttggagcttttgttggccgagttggagccgaacaaattccaatccgaatttggacgcggaaaatacgacctaatcgcatcaatcatcgcccgactgcgcggagtgtacagcgatttgcagaaatatgtcaacgaagactttctcaaaagggtgtgccaaattaacatttttgaatttctttaggagatatgccattaaatgaatcactcatctttgcataataaaaaaatcataaatttctctgccaaatttcctgtttttttttttgcaggtgtccaccgaggacatcgcacggtcggtgtggcacgcgaaaagcattatgggctgtcgaactggcggggccggcactttgtcagtgctgtcggacaactctttcatttcggcttatgacgaattcgtatgaatttgtttttcatgcttttgtgcttctacttaacatccactaaaaggaacgctataaacaatcaacagcaaaagggcgaacttaata

SEQ ID NO: 61915 - DNA, 648 bp, Heterodera glycines
  Genomic contig location: Contig_ID=SeqID_31586; Location=673..1320; Strand=-
  SCN-specific regions: Sequence locations=1-167,189-195,219-316,345 -405,462-484,506-648
gattactttcaacactcacatgtccaccaattttgtccagcaccgactcgggcccatttctgtgcacttcgtcaatcagttgttgctggtcggcggcgaacagtttgttcagcgactgtttggccgcggtggatgaaagaccgtggagcagcgcgtcgatgagcacggacacagagttggaggaggagtcaactgagggggaaaattttaaaaaatccaaggggtgaccgaacaagcgccaaaaaccctaaatcccaggacaatcgctagtagagaagtgaaattaacgcaaaaaagatttattgttttaaaaaccaaaaaaaatagttaaaaattttaattatgtctgtctttcccgtccccatgtcgtccccacacaccccgattttttaaaatttactgtagaaaatttaaaaaaatattgggtttttttataataaaatttcagaaattttttattaccgatttttctaaatttaacgaactgctcccgctttgcccttcccttccgtcacacacctttgccattgtgcagcacagccaggcgcatcgcgttgctcttcttcatgcccttcagcgcatttgccaccaatttgcgcccgtcagcgctgtccaaatcggcgactgtccaaacggtgagccaacagg

SEQ ID NO: 61916 - DNA, 1097 bp, Heterodera glycines
  Genomic contig location: Contig_ID=SeqID_31591; Location=572..1668; Strand=+
  SCN-specific regions: Sequence locations=1-176,200-227,249-468,491 -1097
atgagcgacttcgagatcggaatgttgaaagcgatgcgccatgtcttcccgtcatgcgaacactcgggctgcagcttccacatggcgcaagcgttgttccgaaaggccaggagcatgggaatttttaatctgttggacgaatatgatgacgaagcactggttcaaataaaggtcgttcacaaaacatttaggtttttgtctttcattagctcatctgtgtttaattgtttcccaaatcagttctctctttggcactcattccagcagtttacgttcggcacgccttttcaacgattcaacgcggcaccgcttggaattcaaggatggcttgcgtattttggcagaacatacattggcaccattcaattcgagattgatcgcggggcggaggcatatgagccgcaggctgatgtaggacacttccttctgcgtcgcattcgaagcacaactcgtaaatgcgcctcttttaatgaaatttatgaaattttaattttagcgttcagtgtgtcccaaacgtcaataatgacaggtagtgggccaatacaattcggactgcattcgccacaaccatcaactccgacgattccattgtctgaagaaagcagcttacaacttcttcgacgctgggaacaagagatcgtccaacctccgcgcttcccaatctcgttttggaatgtgcacaccagggctcaaatggaaattgagcgaacaaacaacggcatggaagccgcgcatggacaatttgcagtataaaatttctccataggagtatttatttttgttaatttagcgtgaactcaatcatcatccgtcactgagtgatttcatagcagcattcatcaaggaaggacatcgacaaacaactggacattggacgagcagaacgtctccagaagagtcgaaaacgaccgcaacggtacatcatcaaggaacagagtgttgtgcgtatccttgacgaggctgactttgaatcggaagaaggattggcaaacgccttgcatctgctcggactcgtaatgcagggctttgtagaggggcttcacatccgtggaaatgatgagagtgatgaagaaactgctgatgccgatggaaattga

SEQ ID NO: 61917 - DNA, 696 bp, Heterodera glycines
  Genomic contig location: Contig_ID=SeqID_6532; Location=50..745; Strand=-
  SCN-specific regions: Sequence locations=1-131,153-530,570-666,688-696
atggcgtgccgatgtgtccggcactttgacgatgaaaaaatgggtggacaaaatgccggagggcaccgacccgaggaaattggacgaacattcgattggggaacagaagttctacgcgaacaaagaggtgaaaaaacaacaaccacaattattccgtatttttcccttaattattcccatgccattttggtagattttcgcccaaaattaccaatttgtcggtgattggccattttaacagcgcattaagggcaacaaaaaatttgtttgaccgctttaaatatttggcctaaaaaattgcaaaaaaaattgattttttccaccccacgcaatacaaaatatgggggggggggaggttcaactaaaagttttgcgaaatggtctacccatgtaaactgctaacgacctttttttaaaggcattttttgggcgcgcttttttcaaaaaaaaaattaaatgagattttgggctaattttttaagaaatatatgtttctgacgggccgctggtgccgataggcgccgccggggaaaattttaagaattattaataattttgttaataaaatagccaaaattttcagaagttttcccttcgccggcgacccccctcgcccacctcttttgggtgcaccccaaaatcacgccgggacaaaatcacgccgccaaaaatttaaaaaaaatttttcaaacttaa

SEQ ID NO: 61918 - DNA, 465 bp, Heterodera glycines
  Genomic contig location: Contig_ID=SeqID_31592; Location=500..964; Strand=+
  SCN-specific regions: Sequence locations=1-329,351-465
atgtcaacgattcgtcaactcaacgattcgtcaactcgacgattcgtcaactcagccaaaatgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcgacgattcgtcaactcagccaaaatgcgacgattcgtcaactcagccaaatgtcaacgattcgtcaactcaacgattcgtcaactcgacgattcgtcaacccagccaaaaatagttttaaaaagcagtttcaagagcttttaatggcgcttagcacaattatagcattcttttaggctaatttagaaacaagaacacataaaatcacgacccttccgatgaaatattctatcaaaaacttgcataaacaaatttta

SEQ ID NO: 61919 - DNA, 205 bp, Heterodera glycines
  Genomic contig location: Contig_ID=SeqID_31593; Location=1..205; Strand=-
  SCN-specific regions: Sequence locations=1-205
aatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgagtttcaaatatcgtaagattgtttgata

SEQ ID NO: 61920 - DNA, 815 bp, Heterodera glycines
  Genomic contig location: Contig_ID=SeqID_31597; Location=76..890; Strand=+
  SCN-specific regions: Sequence locations=1-77,99-476,500-815
attaaccaatggcatccgactgtaatccgtgccaatggctctgaagtgatggcattggccacaatgttaaagcagcacagcggaggcaaaattggcactaatatttgtggaaaaggcccggattcgaatgtggaaagtgctgcagcgattggacacgcaaaagtattaaaaaattaattaatggcaataaataaattaataccagcaaatgcaaaatttaattttagaatatgaaaattattgaatctaattgctttagtgtttttttgtaaagattaataattctattttttcagattgtacaaatcaaaatttccggggctcctaatggcatcaccaaattattaacgaagagcaaaaaaagattttaaaaaattgccagtttaatgattattgggttcaactctgaaattcattcaaaatttcccggggcccctaattgcatcaccaaattattagcaaacaaaaaaaaattcctttatcaaatttttcttaaaattaaaaaaatgtcatatttattgtttttttggggttcaattcatgtaaatttgatttaaattatgttttataattaaaaggatttggcattgtgtagcggaagtgttgtggcaatgactggcaaaactgactttttgattgacccatcatgtccatcattaatgacccaattggacaatggccacccactgatgaccaaagtcaccggcatcggatgtgccctctcggcgagtgtcgctgcctttttggcactggccaaatcggacgagcacaaacgacgcattgcctgtctaaccgcgttggctgtacgtacttaa

SEQ ID NO: 61921 - DNA, 494 bp, Heterodera glycines
  Genomic contig location: Contig_ID=SeqID_31598; Location=258..751; Strand=-
  SCN-specific regions: Sequence locations=1-221,243-494
atgaatatgtcaactcatcctggtaaaaaaaacattttcaatggccttactttgtaattcaccccatattcccaggaatgtacgaatttttgccaatgtacaccaattttgagccgaacagaacatacgaactgattggaacttataagcccatcatcaaaaccgacccgccacagttcgagacaaactttgtgattatgcacaaatccgagcaaacgcggcaagtgatgaaatggtaaaaacttagacaaaggtacttttctgttttgtcacaagccttagaattttttcatttagatttttaggggtaatttgaactgctgagaaatgcaatacaattatgattccgactccgtaatgtttgaatgtcctaaccaaatcgaaccatcaaattttttcactcagtaaaagacattttggcgtaaaatgctgtagcttcttcataaggtgctaggacctatccgccatcaggcatatgatgtgtagtaaataaa

SEQ ID NO: 61922 - DNA, 63 bp, Heterodera glycines
  Genomic contig location: Contig_ID=SeqID_31598; Location=1..63; Strand=-
  SCN-specific regions: Sequence locations=1-63
ggctttgctttgtgccgccgagcccgactgtatggtgccaattggacagatagggttaagccc

SEQ ID NO: 61923 - DNA, 80 bp, Heterodera glycines; identical to SEQ ID NO: 51817
  Genomic contig location: Contig_ID=SeqID_31600; Location=316..395; Strand=-
  SCN-specific regions: Sequence locations=69-80

SEQ ID NO: 61924 - DNA, 80 bp, Heterodera glycines; identical to SEQ ID NO: 51817
  Genomic contig location: Contig_ID=SeqID_31600; Location=929..1008; Strand=-
  SCN-specific regions: Sequence locations=69-80

SEQ ID NO: 61925 - DNA, 498 bp, Heterodera glycines
  Genomic contig location: Contig_ID=SeqID_6534; Location=390..887; Strand=+
  SCN-specific regions: Sequence locations=1-34,56-86,265-278,310-498
  Gene Ontology: Biological process=N-linked glycosylation
atggacaatccatcggaggaatacatggaggaaaatttggggaaagaaatggcacggagaatgggagaaaggcattggaaaaaatgggagaacggagaggaggaggaggaggaaaatgggaaggagccgggagaagaggagggaaaaacatatcggaagaaattggaggaagaagagcaaaaatggaagaaaccgggggaagcgaaggaatggaagaagccggaaaaggaagaggaaaaagtgaagaagctgggcgaagaagaaaaaagccatcggaagaagccgggagaggaagaggaggaaaaatggaagatggggcaagaggaaggaatccgtttccttgaagagtccgcggcatcgtcgtcaacagaacgttccgccggaagggaaaagaatttaaatccctttgaggacacaaaatttgacgaaagattccccattcacaatttgtgcggtccatggaattccggcagacagacgagcgattttgaatggtaa

SEQ ID NO: 61926 - DNA, 894 bp, Heterodera glycines
  Genomic contig location: Contig_ID=SeqID_6535; Location=1439..2332; Strand=+
  SCN-specific regions: Sequence locations=1-53,76-192,214-215,271 -369,436-460,483-612,634-826,849-894
atgaaaaagcaaaaggaggaaaggattacagcagaagatgaggaaaagcagatggaagaaggggagaaagaggatcattattattatcataatcaacaaaatgatggaacaaaaacaatggaaatggtaagagaaatgatgggaacagaaagagagtgggagaggaagaaagagacagtgggaaaagagacgaacatttaaagagtaaattgatcagagagagagagagagagagtggggtagagagagaaagacaaagagagagagagaaattgagatgcaaattttagagagaattgatcagagagtgtggaagagcgaaagatagaggagataatgagagacgcacacttaaagaataaattgatcagagagagtgggggtagagagaggaagatagagaagatatagggagtgagagagagagagagagaggcgcacatttcaaatatgatccttttttgtaattctaaattaatctcaagaacaacaacgcccatgccgcgattcggaagcgtggccaacccaaagggacggcggttctgccaaaaagtgccgtttcggcgacacttccgccaaagacggaggcattctcttcagctgaatttggcacaccctcagaaggaaaaaggcgccttttgtgcagaatgagcaacattcgtgaagagataatgacgaggatgggcagaaatcattcggaggagggcattttgatgggattgggaataatggagggggaggagggaatggcaatgccaacgaggaaagggggaggagagggacagggggaggaggggacgagcgcaagggacaggcccaaccccggcagagggggaaggcattgccaacagtgccaatgggaggacgaacggcgcggcagggcggtggaccaat

SEQ ID NO: 61927 - DNA, 535 bp, Heterodera glycines
  Genomic contig location: Contig_ID=SeqID_6536; Location=813..1347; Strand=-
  SCN-specific regions: Sequence locations=120-170,255-313,509-509
atgcccacagtgcaaaagaatttacaaaagtgcgcaaagattggaggggcaccagcgcatggtgcaccacaattttgtcgccaaaatgtcaccggcgaagcgatcgatcatttcgccgagtgagttcattggggacggatcaaattatcagactaaagtaacaaattcagaaaagattgccaaactgatgagttcgttttcatgtcacaaatgcaggcgacggttcgcaagtcgcggagaatgcgacgaacacggtaaaagagagcactgccaattgagtaccgacactgagccaaaatgcaacaaatatttagtcctttcgcacatccgctcggggagattgaagcaagaggaagcggaagacgaacaaccgcaggaagaggaggaggaaggaggggagagagcaccgcaagtgaagaggccgaagatggaggaggagggcgaagaggacgaagtggcggaacaacaccatcgggaagacggagtcagagaagtgggggaaaagacggacatcgccggaggagtggaggaagaa

SEQ ID NO: 61928 - DNA, 422 bp, Heterodera glycines
  Genomic contig location: Contig_ID=SeqID_31608; Location=81..502; Strand=+
  SCN-specific regions: Sequence locations=1-185,233-312,340-385,411-422
atgatgacgcgagtcaatcgaatgatgcaggattttatgagccgagacgagaaggccaaacaagtcccgatggtgagttattctctcaccaaattattttattttaaccccgaataatgtatttattgtgtctcttttattgttttttttggttttaaataatcccgttggcccttgggaaaggcataattaattatattatattgcaataaaaaaattttaacattttattcccattgacattttaaatttacagaacaagaggagggtttaatgtggggtgtgtgttcatttgttaattgtacggtgttgcatttcacaaaatttcaaaatagaaatcgttttcaaagcagttgttgaaaattcgcgattttaaaggcatcaataattttttattataagtattattagagtattacaaa

SEQ ID NO: 61929 - DNA, 833 bp, Heterodera glycines
  Genomic contig location: Contig_ID=SeqID_31608; Location=547..1379; Strand=-
  SCN-specific regions: Sequence locations=1-129,152-530,552-561,593 -624,646-811
atgtcacaaattttgaatgaaatttgcgatgaaaaatgcgctgacccacaaaatgtccaggccacgaaatgtccaagtcttgaaattgagttttttattattcggatgggcctaaggttaggcaaggggtaatataaaggctatattcgtattcagcgaccccgaaacccctaaaaaccccaaattagactcattttgtttttataaattttgaaaattttggacatttcgtgtgtttttactcttgtggacatttcgtggcatggacattttgtgggggcgccctccattttatttagagttccggtaaaaaatttttccatgcacgggaacgggaaaacgaaaaagaaagtttataattccaaattcttagagaatttttctatattttcaatttattgacaaattttttattgattaagtctcttttttgcggcgcacctcttacaaaatctttagtggtacaggagggtcaggtggtgccgataggggtcgccggggaaaaaatttgattttttttgtgaaatctgttaacagaatttgtccaaaaaatgaactatcatttaaattaatttataaaaaaattaaaaatctccaatttcagtagggaattgaacccaagcgacaaataatgaaagacagaattttacagggaacgggaactggaaaggtatatgaacagggtggaattcccgccttttttcccgttcccgtaaaaatctcgtcaggcaaaaaagaccgaaacgggattccctggttttcccgcaagaatgccgttcccgccggactggactttaattttattgcacaatttattttttctttgaattaaa

SEQ ID NO: 61930 - DNA, 869 bp, Heterodera glycines
  Genomic contig location: Contig_ID=SeqID_31609; Location=414..1282; Strand=+
  SCN-specific regions: Sequence locations=1-83,105-168,191-210,246 -250,275-331,354-661,754-808
cctcgttttttgatcgcccccagcttgacatcattgctccttcgaatacgatgacagttaaacaatggtttgttcctcctttatataattaccattaaataattacgtaaattttttatttttttgtacttgcaaatattattagaatcattttaaaagaatgctgttttttatttattctattcatttttagccgagatatttgcccacaaataaatgttttattatgtttattttaaatatttctttcactttgttattatatttcattatagacttatttatataaatgaattactttgtttaatgttttattatagctatttttatctaaaaaattagctccatatttttaatatgcaatttgttgcctaattttcttgttatttagaaaattgtgccgactattttgagtgaattctaattttattgcaatttcctccggtttttgtgataagcatatcggccatggtccgattgtatctttcaccgcttgacgactagtgatatggtagatgtctggtgtttgaatccccaaattttggctagagattcaaatgttatgttcagaaaatgagtgccacactcagtgacgagtatttttggtagaccgattaagctggtattatatttatttattgtgaatttcaatctctaacagataaaattatttattaagaatatattttaataaaaattttattatttgaatttttcagcaaagtatattatttatttttatttgatattaatgaaatcgtacaaaatttattgtgctcacgcggccagctttgactcatcatttttcatttaattatttacattaaatttgataatatctcttatttaaaatatttatattataatta

SEQ ID NO: 61931 - DNA, 1000 bp, Heterodera glycines
  Genomic contig location: Contig_ID=SeqID_31610; Location=20..1019; Strand=-
  SCN-specific regions: Sequence locations=1-247,272-862,884-902,924 -948,970-1000
atgtataaaattttatatttttctcctagtcgttcccgtcgcaagggcgccgatttggccaccggtgggcgcgacttggcaccccagcggggcgagtcccgtgccaacggcgtgtgtcccgtgccggacaccaacggaccgtccgcgtgcacatcgtctggacagaaaaaggcggtgcatatcccatcgttttcgcaagtatgaaaaaatacaaaattttcgcacaatttttcgacgtgggtacccgaaaaaaaaaattttttttttttttggttgctcttatttagtctatttttttgccattataattttccaaatttaaacaccgcggagaaaaatggcatttttgtgtcaaattcttaaaaaatccagggaacttagtcgtccaaaatggtgccaaatggcgcagccgaggaaaatttttgcaaattttcagttaaattaaaaaaaaaatccatttttcagtccggctctgctcaatcggcacgaaaagttgtccaatcggtggacaattgcgtggccgactctgttgacgaccaaatgttggacaaattgtgcacattacctaaggggttggaccgacacgaatggctggcatcgcatggtcaaagcattttgaaaattttctattttttacccaaaatttgttatttcccaacccggcatacaaaaaaaatgcaaattttaggggagggggtaaatggaatgcgtaaaaaaaattttcaaaatcctataacttaattttttcctatatttttagttttggctttgttcgaacatgtcaattgtatcagtgccactttgtctgaagtgtgcacttcgatcagctgctcaacaatgagttttccgggcaattcgttagttttttttttaaattttatatggataattaaagggtcgagaaaagcgaattcttctagaggatttttcaaacaccaaacccccctgaattttaacctttttaaaatccacaccttacccctaccccaaatcaaataaa

SEQ ID NO: 61932 - DNA, 678 bp, Heterodera glycines
  Genomic contig location: Contig_ID=SeqID_6539; Location=1638..2315; Strand=+
  SCN-specific regions: Sequence locations=1-61,87-380,406-574,611-678
atgacttgcggaaatggtcttccactgaagtgagaaaagccaaagataaatggaaaagaatgatcagtgatcagtgaatgaccgttttggtttggatttggctgtactaattgctaagtgattgtttcccgcccccaactccctgcaactgtatgagtcaactccgtcccggacagcttccaagacgccaaaatgttgtttttgaaagggttgcagtcaggggaagcggggacgggcggatcccaaggattttcatccccttccccattttcctatccccgcactgaatccccgccggggacggggatgaaaataaacctaaagatgggcttggcgaccaaaaaaaaacatcttttttagagtccggtaaaaaaaaatttccgggagcgggagcgggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaagggcaatcaatttattaaattaaaaatatagaaaaatttataaaggagaaatttgaaataaaaaaatcttatttttgagtcaaaaatcagaaaattttttcaaattgcttaa

SEQ ID NO: 61933 - DNA, 2199 bp, Heterodera glycines
  Genomic contig location: Contig_ID=SeqID_6540; Location=77..2275; Strand=-
  SCN-specific regions: Sequence locations=1-288,310-344,383-746,769 -810,850-977,999-1036,1058-1763,1785-2199
atgggattattggataagataatgcagaatgaaacaaaaaaatgtatcgggaagtattaatatattgtcagaggcgaacaattgccgagagatcagtcctctaaaattggtaaattttctataaatgccatttcattatgatttaatttggtaattttgcatggttttattctaagtgaatgggaatgagatgagagtagttgttcaacttttgtcggcgtctgtcctaattttgcaaaaaactcatttccgtttcccaaaaagacactcccctaagaatacattgcaatttttaaaatatatccataagatttgaatttttcgtatgctaagaattccaaaccaaaaaaattacataaaaattaacatttaaaaataatttcttttcccaattaatagtaaaattgctgaaaaacactaacgattatttgggctcaactgaacaattggatgagaacgtgataagggcgctcagaaaagcatatgcggaaaacgaaaaagtgatcaaagacgcgataattaatgataaaaaattggtggcacaaaaaagcaaaagcgatgacaaaaaaatggaagagagggcaacggaacattatgaaaagttgaaggcatttttcgatgatcccatcaaattttacaataaattggacgttaaagtctttcaaaaattcaggtaatcattaacacaaaatttagaatttaattaatcaattatgatattgcggttagcaatttagaataaaaccgttaaataggcacataaaatatggacccaaatcatgaataattaaaatttattagttttgaagcgaaaaaatgaatggcaaaatttcaacttttgcatatttttgacccaaaataccaattcataagaaaatgaaacttaaacatattcttttagaattttttaaaatgatttttaagaaaattttcctatatcaagagccaaaaggttaatttcgcggatgagagccgttcaaagaaaaattcaataaaccaaaaattcttaatcatttttaaataatttggccatttaaaaaattcattaattacacagagaggtgatgggtgtggtcaatgacaaagactcaaacgaagaattggccgagttggacaccgaacagtaccaacaatttctgctgttcctggagaaccctaatgagtacttggccaatgcaaactttgacgacactctcaaggacaccgtaatggaagtgttgaacaagaaaagtgaactgctcagcagtttgactcctgaacaaattgtgcagctaaaagaattcaaggacgcgttgaaaaatgaaacgaaattccaaggacaattggacagcgacattttcgccaagtacagaaaaacgctgccagcaagtgcaaaaaaagggatcaaagagcgtaccaatgaattttttgttgtaaggaaaaaaaaataaacattgttataaaaaaaaatcattaagaaacttgaaaagcggaaatgccaatgaattttgagttcgaattttaaatttttcagggcaccaaattgcgctttttattcgatgagcttaaaacggagcgtcaatttgatcagctgatgcgcttctttaagcatccgatccgattctatcagccacgaaacattgaacacaacgtttggaaggtagtcgaataaatttaaattttgactggatttcaatcacggacaaaccgtgatcatggacccccaaaaacggcgtgctccacctgatcagtgattttgcagcaaaaagggccaatttgaggggtttttgggttgattttaaaaatcttaaggaagagtgtgctagttttatttaaaaattttcattaatctgccccagcaaatttgtgactgacctttctttgcttccagccattccgctcgattctcaacaaaattgtagaccaaaaacagcaagacaaaatgttcgacgggctcaactatgagcagctgatggaactggcagcaaatccggccaaccgattcgcaccgagcgaaatggagggggacaggaagttgaagaagttcaaggaggcaccaggagttgacccggaggtgttaaatctctacacaaggcatttaaagcggaaccaaagttgcgctaatgtgaagccgttgattgaattggcattgtacggaatggaggaccggcagaaggccagcttggacttgaggggacgactcggtgaaaattgaataaa

SEQ ID NO: 61934 - DNA, 1652 bp, Heterodera glycines
  Genomic contig location: Contig_ID=SeqID_6541; Location=248..1899; Strand=-
  SCN-specific regions: Sequence locations=1-164,194-473,519-941,981 -1041,1063-1230,1252-1494,1516-1652
atgagagaatactttattttcctttgttcacagatccacgatttctttgatgacccggccatattttatcttcgtggcgacaaattggacaaaacaatgaaaaaagcacttagagaaacactgatagaaatgggattattggacaagataatgcagaatgaaacaaaaacatttatagaaaagtataaaaatattgtcaaagacgaacaattgaccaaagatcaggcctataaaattggtaaattttctataaatgccatttcattatgatttaatttggtaattttgcatggttttattctaagtgaatgggaatgagatgagagtagttgttcaacttttgtcggcgtctgtcctaattttgcaaaaaactcatttccgtttcccaaaaagacactcccctaagaatacattgcaatttttaaaatatatccagaagatttgaatttttcgtatgctaagaattccaaaccaaaaaaaaaatacataaaaattaacatttaaaaataatttattttcccaattaatagtaaaattgctgaaaaacactaacgattatttgggctcaactgaacaattggatgagaacgtgataagggtgctcagaaaagcatatgcggaaaacgaaaaagtgatcaaagacgcgataattaatgataaaaaattggtggcacaaaaaagcaaaagcgatgacaaaaaaatggaagagagggcaacggaacattatgaaaagttgaaggcatttttcgatgatcccatcaaattttacaataaattggacgttaaagtctttcaaaaattcaggtaatcattaacacaaaatttagaatttaattaatcaattatgatattgcggttagcaatttagaataaaaccggtaaataggcacataaaatatggacccaaatcatgaataattaaaatttattagttttgaagcgaaaaaatgaatggcaaaatttcaacttttgcatatttttgacccaaaataccaattcataagaaaattcttaatcatttttaaataatttggccatttaaaaaattcattaattacacagagaggtgatgggtgtggtcaatgacaaagactcaaacgaagaattggccgagttggacaccgaacagtaccaacaatttctgctgttcctggagaaccctaatgagtacttggccaatgcaaactttgacgacactctcaaggacaccgtaatggaagtgttgaacaagaaaagtgaactgttcagcagtttgactcctgaacaaattgtgcagctaaaagaattcaaggacgcgttggaaaatgaaacggaattccaaggacaattggacagcgacattttcgccaagtacagaaaaacgctgccagcaagtgcaaaaaaagggatcaaagagcgtaccaatgaattttttgttgtaaggaaaaaaaataaacattgttataaaaaaatcattaagaaacttgaaaatcggaaatgccaatgaattttgagttcgaattttaaattttcaggacaccaaattgcgctttttattcgatgagcttaaaacggagcgtcaatttgatcagctgatgcgcttctttaagcatccgatccgattctatcagccacggaacattgaagacaacgtttggaaggtggtcgaataa

SEQ ID NO: 61935 - DNA, 1184 bp, Heterodera glycines
  Genomic contig location: Contig_ID=SeqID_31612; Location=318..1501; Strand=-
  SCN-specific regions: Sequence locations=1-88,111-155,177-264,286 -377,400-640,664-923,981-1079,1101-1184
atgcctaaagaagtgatcaaagaaaaaaatgcgacgaatggagtggtgattgatcagcgggcgggaaagaaagagatcaatgttcaaaagaagccagaagccactgatcagagcaacggcctggacaaaccaaaagaagcattgactgatcagagcaacaaaaataacatcaacaatgaacagccaaaggcattggaaactgatcagacgaagcaaaacaaagagactaatgatcaaaggaccaaaacgatcgatcagaccaagccaaaggaagagattaatgttcaaaagaagccagaagttactgatcaaagcaacggcctggacaaaccaaaagaagcattgactgatcagagcaacaaaaaagagcatgacatcaacaaagaacaaattaatgctgagaagatgctaaaggacgtgatagctgatcatggaaagctaaaggcattggaaactgatcagatgaaaaaaaacgaagagatcgatggtcaaaagaccaaaatgatcggtcagacaaagccaaaggaagggattaatgatcaagaaaaaccgaaggcgaattcaactgattttatgaagccaaaggaagagactaatgatcagaaagagccaaaaacgatcggaactgatcagataaagccaaaggaagatgctgccaatacttcggtgaagtctaaagcagtgattattgatctgggcgatcccaaagagaataatgtcaacgatcggaagaagacaactacggatgataaagcgccaaaagtgatgccattcgcccaaactgagaaatcattgcacaaaatcaatgaccaaattgatcagcggatcaagccgagagaagaaaaccgggaccacattaagcaaagccgtgccaacactgagcatccattgcccggccaacggatcaagcccacaaaatgtacaaaaatatttttaaataattttaaataaattatttgcttttagtcagaaagccattcgatccgttatcaacagtggccgacactttggagcggacaatgcttggcgatgatgatcgtgatcagcgccaggaaaaatcacgattcgagactggtgtcgggaacgtgaacaagaatgggatcatccctgatcaaattgcacatttggagcgcatcatttcggccgtacagcgcgtgatgggcttgggaagtgagacaaaatga

SEQ ID NO: 61936 - DNA, 854 bp, Heterodera glycines
  Genomic contig location: Contig_ID=SeqID_31616; Location=174..1027; Strand=-
  SCN-specific regions: Sequence locations=1-77,107-136,159-456,501 -761,783-854
atgttgctggcgattgactacgcaaatacgctgaaacccatcgcggatttgcacttggcggaaagggtgagaatttgtaaaattcaaaaataaataaataaatattcatttcctaaaaagcggctcaatgaatgtttttccaaattccctcctaaaaatgccctcgttttcagctgagtttgctccgctccactgccatgccttttatggtttttgcggtggcgtgccaaagttcgtttgtccatcgacccgaccaaattctgctcccgaacggactgtttgtcgacgagcgtacgccgctgaaccttctggtgcctccgctcagtcattgccccgagtctttgcgctggcgcatcggcgcaattcgctcggaatggcttaacactttggtacaattcaacagttaataatcacattgctaattggttttggttatctgagggcaaaaaatccctcaaaaattgtttaataattatttcaattaaaataaatcttattttgcgctttcagcaaccgtcgctggaacagctgtcgctgacggaggtggaatatgtgacactgaaggcaatcgtcgcgttggacgcccacacgcccggcctcagcagtgaaacggtgcgtctgctgaacgtggcgcgcgacagtgtgcagaatgcgctgtttttgcatttggtaggaaattttgacaaaatttattttaccgtattttctaaaaaaagagccctggggcacttctacagtatctttaaaccccccccccccctctctctcaaaaaggaagggggcttttatttcagaggagagggagggggacttatattttaggaaatacggtataattaattacaataattaaa

SEQ ID NO: 61937 - DNA, 332 bp, Heterodera glycines
  Genomic contig location: Contig_ID=SeqID_31617; Location=375..706; Strand=+
  SCN-specific regions: Sequence locations=1-332
atggcttctttttctcccgtttttattgccattttaataatcatttacacttccgctgttggagcgcaatttggtcaatttggcagtttgctaaacggctttggaggtgccaatggcggcgccaatttgatgaacggaatggcggccaattcgcgcaactttgccaatatgggtagcagttttggcggcatgatcaatcagttcaaagggatgggacgaaacttcaaaaggcagttcggaggcaacccttcgcatcatcaccatggaaaatgatggcacccattcattcagtgttcattttgtggctaatatcacacatacatattaatata

SEQ ID NO: 61938 - DNA, 1129 bp, Heterodera glycines
  Genomic contig location: Contig_ID=SeqID_31620; Location=62..1190; Strand=-
  SCN-specific regions: Sequence locations=1-165,187-258,281-306,341 -345,371-414,436-898,923-1129
atgctcttcttgcaagcgatgctgttctacctgcccaactggttgtggaaccatctgaaccagcagagcggtaagtcctcgaaaataatcaaaatcgggcaattggaagatttcggtttccattttctcccggaggggtgtggggactgaatttgctcctaatttggcaaagagaaatgggcacaaatgttctcagttctcccattatttttaagtggtaattttgaaaattttcttactattttaagcagttttatgtgaagaatttgctaaattttttcaaatccctcctactgttattatgactaattagttcattaattatttaattgattaattattattcactcccttttcctctccccttttcacaggcatcgaattcaccaaattcatcgaggaggcaacgaagctgaagggcatgcccctggcaccgattgaggagcgccaggagcagatcaaccaactccgggaaaagctgagcgaagccgtgctgaatcgggacccgtaccggcggatcgtcggctgtcgatttgggcaatcgatgggcgcatatgtttcggtgggttttgatggcaacaaattaccattaaatataattatgaatttgccgcgttttaatgagtccaacaatcattcgatgtttattgtgtccacgcccgcgtagacaggggaagggggggggggattctcgaccccttaaacgaacaattaaaaatttttgccagaaaaatggcatttaaaaaaaattttcttataaaatgcattaaaatttcaaaaatttctgccggcgacacctattggcatttttgaaatgtttactcaaaatggcaaaaaaaaatcgtcactttttctcgaacagcggttactaattaatgtttttttttctcttcggcgctgaaaataacttataatttcttgaattttctgacatttctatgcccccttgtttaatctgttcttttttcccccggttcagctgctgtacgtcggcataaaggtgctctacctgggcaacgtggccatgcaattcttcgttctgaactctttcatcggccggaattaccaactctgggggtacgaagtgctcaaggcgctgttcaacgggcagaattggcaggtgaattaa

SEQ ID NO: 61939 - DNA, 2763 bp, Heterodera glycines
  Genomic contig location: Contig_ID=SeqID_814; Location=395..3157; Strand=+
  SCN-specific regions: Sequence locations=1-424,470-601,624-797,819 -1166,1188-1211,1245-1264,1286-1461,1514-1750,1772-1799,1853 -1860,1890-2010,2032-2172,2213-2763
  Gene Ontology: Cellular component=membrane
atcagtcccatcgcccgcttcgcgttcagtgatctggtgatcactgtgttgcgtttggatttctacaggacaggcgacccggaagcgatgtgcgcgagaggggggggggggtcaattttatgtaaagcaccgctttttgaatgcttggcaaattttggaccggaatgcacattttaagtttactgacagtgcctgaatttcaattagcaccgatttttggatacatgcaaaaatagggccgaaatgccattcttagtccggtatttaacgcgtttttaagttgtgattcggtttcaaaaataaaaaccatacaatttgaatgccaattatttttgaaccgttattacaaaggccaaaagacgatttaaacgtttataatctcactgatttatgagttttcaatattctaaccgtgcattatgagtttttttttaaattaatttccaaaataaaaattatttcttttttagcaaattttgcaaacactcattggacattttgctgaaatggggtgaactgccggcaaaaacccagcaatcgttgcggcatcgaatcgaagtgatgatttgtgccgaacaaataccatttaacaattgttagcccatttttgatcctttaaggagaaccatcctttcaatgaagacatcggcgcattgataactggtccgactttatctgtttaaaggagctctaaaaatgctaaaatcccaccgatttcataaattttccaaatcattttaaatgtacagaaaaatttaagcgaaattctgcggaaattaagttatcaatcacttgctttgggccagcttctttcctgtacatgctgctatctttttcaaatccgagctaaattcgcggatattttgaatttatcggggtccgatatttaattaatatttactcatctgacggcagttcattttgggttcaaattttcctttatctattgccaatgccattataaaaaaaatgccaaaattttctgttgacagccgtcaagttggaccccgaattgtgccagccccaaggactgctccatctgctcggctcgctgctcctctgtgttctcgttgacggcgactacgacgcgcgtttccgggtgctgctacggcacatttccgcactgcttggcatccactgggacttatttgaggaggtgccaaaagagactgatctaaacaaatttacaaatttccgaatttttccaattaatacatatacatagaaatatacaaaattaaattttctcaaaatgctgggcactcatctttctgcaagtttggcactttcttttttcagttcgagtcaacgctttgtgatcggctgatcgacgaatacaatgaaacagtgtgagaaggaatatttttaaaaaattttctatcaattaatctttaagctcacaaaatttcttttttgaatcatttttacagtgattgatttaattttttgcggggttttcgcttttattttattatattttaacaaataattttttcaaatttatttttattttcattactcagtgacaatcaaaaggtgcgcgagagcaaaagccgtctgaagaagcttaaacggtacgcaatgatcggcgcggcttcgggcctcggtggcattttgatcggtgatcagaaaataggaattttccttttttataattatatttttcaattttccaaggtgtcaccggtggtcttgcggcgccagtgattctgacgagcatttcggcgctcactgccaccacaattttgctgccagccgccgcttcggccgctatttttgggtccgcaattttgaattacaattaaaaaattaacttaaatatgttaattgatatttgaaattaatataaaatggaacaacaaaatttttggaattttttaatgttttaaaaaggtcaatttttaggggaggggggtgggagtgtttcttgggtttttttgtcatttaaatgagcttaagtttgcagacaaaacattaggccggtaaaataagggggtgggtgatctgccgttcattttgagttgtttgagcgtactgtattcttttcaactgtacagttctgtgtttggagctgctggcgccggcctcaccggctaccgtatgcagaaacgggtgggcgacattgaggaatttcgcatcgaacggctgacggagcaggacaatcaggtggagttaattatgaaataaataaaatattttaatataaaaaattggaactccaaatgctgaattttaaacctaaatccggcatttaggaacttcactgtgttctctgcgtgtcaggatggattgaggaccgggaggagagcgcttttcggcaccactggcgccacctttggatgagcaaggagcagtacacgctgcgatgggagagcaaagtgagttttatgtgggtgatcagtgatcagcagagattataatggttcgatcaacgctttttaagatagcaaaatgagtgatcatttggtagctaaaatgctgatcagtcattaaataagtgatcaggaaacaatgctggattcggccctcaaaacttcataacagactaaaagaccataaaaaacaactgctgactggcacttaagacgcagttgttctgatcattgtaattatgcactggacaggacaaatgagtaactgattgatcaaggataaaatcgatattcatttttttcattttatctctgatcaaaaattacaatagtataaactaaaagtcatcgccaactttcccaagcagtacttggaggaattgggccgcag

SEQ ID NO: 61940 - DNA, 2604 bp, Heterodera glycines
  misc_feature (98)..(98): n is a, c, g, or t
  Genomic contig location: Contig_ID=SeqID_815; Location=1..2604; Strand=+
  SCN-specific regions: Sequence locations=1-91,133-219,241-551,582 -628,650-682,718-1052,1074-1354,1376-1894,1917-2313,2335-2390,2422 -2434,2456-2604
  Gene Ontology: Cellular component=membrane
tctcctttgttgtttcctatgccatccaacgttcactgatggaaacaatgttggccagcctcgtgtccgccatcgcatggcctttggtgtgtaaaatntaaaaataaaattttttatttttttgaaaattttcactgccaggtgctgcttggttcctcctgtgtcatagacaacccgtggaatatttgcactcgacgtgctcgtcaggtaattaagtgccattttcgggcatttacggccaacaattgtatggaattttgttgcctaaccgaaaacggacattttgcattctgctccctaattaatacaccatcatcagtggaagaagaatgggtttaggtgaaaatgctgtaaaattatatactgggaattacagcttctagaaatctcattttacgatgcttaaagaaaattaattatcatacctgtgaactgattattagggatgcgatttttaggtacaaaaaatcgcgaaataggcacctaaaaaggcagaaaaaaatcgcaaaataggcattaaataggcacaaaaaagcccgaataggcacaaaataggcaaataaaattttttattaacgctttttaagtaacaaagcacgttaaaactttaaatatttcaattgtaaatgaaattattaaatgttttaaagttttttttcgaatatgaacaaatttttaaaccaaaaaatttttattaagaaaaaaatattaaatttagggataatttttttgaaaaattttacaattcttaggggggtattttctgaaattttttttgggtcatttcttaggggtgtattttttgtttttattgcatttttgttaaggattttttcaaaaaccctaaaataggcactttaggcacaaaaaccccgaaataggcaaagttaggcattataaaagtcatcgtagacaccccaaaccatgcggaaagggcttttttcgtgcttatctgtgcgtattaagtgcgcaaaaattttaggcatttgcctaaaaatcgcatccctactgattattaatttttggaatataaaaatgatttatttgatcacatgttttgttcatcaaaaattgaaaatataatttaatggaaaatttttatgttccgcaaaagccctactttttttgggccgcaaattttatgatataagcatccaatccactcgtttattgaatgcgcttaaacccattgctaatttctttcaggtgggtgaacacctcgccgaagtgttgctgacccggcagcacggtcggcgtccgatcactctgatcggcttttcgcttggcgcccgcgtgctttaccattgtgagtgataaaaaaataaataaagaatgttgtagagaaagggacaaactgatcatttttcagtgtttgtcttgaacctaatccaaacacacacattaaatttaggccttttggagatgagcaaacgcatgcctgaatcattgggtagaaataaatcaaataattttaatgaaatttcgttttgcccagcaggcattgttcaggatgtaattctgttgggtgcacctgtttcagcttcgcctcgtcaatggcgtcaactttgttcagtaaatttattttaattatcccattggattattgattgaaattatatttaattttactcacattaatgttatatttgaaatatctttcgtgcggctttttcgttggatataatttttcacaattttcatgttgtcgccggcagagtgatcaatggttactgtaaaagtgattggctgctgcgcttcctttaccgtaccatgagcgtccaatttatcatcgccggcacgggtccggtggacaatcgaacggagcgcaaaattgtcaacttcaacctgtcgcacattgtgcgtttgtcatttttttgcaaactttttgaaaattatataattttcttatcacatatttcataaaatttctaaaatttcccggcggcgcctatcttcaccgcccgactctattgtatcacattttgattttacccctttttggcgcaaaacgatgcaaattcttgtttttcaccctggcgctgaaaattttgaaaataacatttgagataacattttgttggccgaagagcaaaaaaaaaaagaagcttaaacacgggaaaatgagactcgaagacaattttttcactaataaataaaaacctaagaaaattctatgaaaaaaattgaaaaaatttaatgacgaattctaagaaatttcaaaaaataaaaaaaaaatcgctgaaaattttttttctcatagaattttaaagaaaatttttctaggattttttttcttgaaaatttcgaagtttgaatatttaaaaaaaatttattcccggctgtgttatgaatttggactgaaactaaagcggggtttttttcaaattgaaacattcaagttttttaaaaattaaatttgggacaattctttttatcattttaaatgaatatttctgaaaaggtcaaaggccatttggactacgcgaaaaagatgacgcaagtgctggaggccgtgggcgtccgttgcacgccgctttcgcgcgcgtcgtgcgccaatttgtccgaggacgcaccaatgcacgcagaagcagaggaagcgactga

SEQ ID NO: 61941 - DNA, 2500 bp, Heterodera glycines
  Genomic contig location: Contig_ID=SeqID_816; Location=671..3170; Strand=-
  SCN-specific regions: Sequence locations=1-79,113-142,165-231,257 -258,307-554,576-577,599-759,781-927,949-963,985-1104,1148-1226,1248 -1909,1974-2023,2045-2119,2142-2186,2208-2331,2353-2500
atgaaagcagcaacggctactcggccaatcaaagtgacaattttataaattagcaaaaactgcaccagcgacaatttacaaaaaaatataatattatattaataaaatttatggtttttatctttattcaagctgaaaatcctgctgaaaagtatgcagaaagaattttcaaattgctcgaaagagagggcagtgaagacaacgtctacacggcttatcaaatattggacattcttatttcattgaatttttccacggtaaaattgttatattttcaattttaaaaattatttgaatatttattttcaaatctgaatatgattattagggatgcaatttttaggctcaaaaaactgccaaaataggtagctcagagctctaaaaaaccctcaaaataggctctaaaaatgcaaaacaagcactaaaaacctcatttttagggctgtaaatgacaaaattttattataatagatcaaaccaatattgagataaataattcagttaaaaatcgtaaaattcttgtgaagaaatagataaataattttgaaggtgaatttttgagaaaatttcaattcttaggggtatattttttaaaattttcggctcgattcttaggagtgtattcttgaaaaataatacaatcgtaaaagtagctcaacaaccgccaaaaaaaaaaatgtttttcaagcatttcagatcatagagagctcagtaaaaaaaaattgactaaaacataaaaattgcatccttaataattctataataatttattactcagtaatattatttgtaatttcagtgtcgcctaattggtcaagtgcagcatcacaatgagagtctcattgagagcatccgaaagaaattgccaaatggtgggccaaaagagctcattttgtcgctgctttatgagagtgccatttacgacgcagcaagtctttataatgcaatgatggtaagttaaacaactatttttgtgaaattttattaaaaagatttaatttacctttaatgaataatgtgcggcagtttaaactaaaaattgatttctgctatttagagaccgattaaaaagattattaaatactttatatttttcgattaaggaaaatttttaaacataaattttttataagaaaaaataaataaagttggcaatcctttaaaattcttaggggggtaattattattattttcggatcatttctttgatttaagggaatcggaactgatgaagaagtcctgactgagattttaatctcacgaagcaatgcacagatccgtgccatccgcaaggttgtacattaagtacatgtcataaattagtcactataaatttcattttttgttatccataggcatacgtcgagctgtaccacgaggagttgaaaaagcacattgacggtgacacgagtggtgcttacaacttgcttctgaccaaattaattgctgcaaaccgaaatgaatctgctacagtaaacattgacaaagcatttcaggtggtattttgttttttaatactccgaccttagtggaggtcagtgattatggcgaaaatcattaaaaaccgagcttggacctgcttctgagtcctagtcaaaattcatttccacggctgaacatcatctaaaaaattttgcgaaccaaagtttgccgcctccgcctttttggggttttcaattactcttaataattttatataatagaaattccatttttgttttatttaggacgcaacgattttgtttgcagtgcacaaacatggagtcgacgaagaaacattttttacaaaattgacaattgaaagtcaaaaacaactgaacgagacattcagaagctatgatcgtttttatgatgataccattgaacaggtattttgatttgatgcgaaatgatagaatttgcttcgccgaaatttattttttttttaatttttacaaaaagaatattaaataattatgaaaatattaaaaaatgcatattttaaagacttgtattgttaagaaatttgctgcggaatttggtggtgatgttttgcaagcattaaatgccatcgtacaacacgcgcgcaatccggcacgatattttgcggaccgtttgagcaccgcaatcaaggaaattgatatttgaaaacaaagcattcataagattaatgaatttttgctttaattaaaacgagaatttgtgacatttttcagagccaaaatgaacgtgatctgattcgactggtgatcacccgtgcggagtctggcgacatgtccacagttggagccgagttcgaaagagtgaatggcgttccgctgacggtacagattgtttccgagactgaattggccacaaaactaatgttggccaacttggcaagcgcatacggcggcgatggtgactgggaataatttgaaagaagcaacgtaaaatgcggatgacgggcgatattttcacatggcaatttgaaaatgaaaaaagatgagtttcagttgtcgtctattcatgctttaataaa

SEQ ID NO: 61942 - DNA, 1103 bp, Heterodera glycines
  Genomic contig location: Contig_ID=SeqID_817; Location=353..1455; Strand=-
  SCN-specific regions: Sequence locations=1-262,284-471,495-622,644 -659,681-706,743-831,859-936,969-1082
atgaaattgaagtgcccacacacgttggcgaatgtaaatcgcagagacttgcggttttttgaatattgtagagagatttctgctctttccaatgggtctactcaaaattacctaaaaattttccaaagcacctaggaatttttttccaaaaattttccgatctgcacagtattttggggtgtccagatcactattaaggagtggtctgatcaagttggtgtaatatattttttggtcagcatcaaaagataacatagagtaattttttcagaatatttcctatatttaaaattgagttttgattaatggatttagtagaccttttggtctcatttgaaagcccattgaatatgctattgatcggtagaatatacttggcatttgctctttgttaaaagattttattagccaattattagcactgatgctaaacatatgaccatgactgtatcttagggaactaaaagcattgaaattattttaattagcaaatgtgttaagcaaagataaaaaggtttttctgagaatttcacgaattagttaagcagtaaccctaaaacaggcacggaaacttcaaaatagaaaattatatattatcaatttcaaaaaatgtgattttttcagttaatttataaggaaataatttaaaaatacgtttctttttaatgtggaaaaattgttaaagcgcattataaattagtcttactttcatttttatttttacttgtttagctggtcaacccgttgtccttgggggcctacataaggccaatttgtctttcaagccgaacgcttgatttgtcacatcgtcttggccaaatggcaggatgggggcaaattttgaatgaaaagaatgaagcatctgttcccaacaaactccagctcctcaccgtcccaattcaagaaacggaagaatgctccaggttgagtcaattgaaaaataaatttattatttaatataattattagcaatacttttagccgagagggactgaaaaaaatcagttttgaccagaaattccatatgtgcgctggagggcgatcccaaggcggattaccggtagttccacaaaaagaatcacaattatttaaatttaattaaa

SEQ ID NO: 61943 - DNA, 602 bp, Heterodera glycines
  Genomic contig location: Contig_ID=SeqID_818; Location=441..1042; Strand=-
  SCN-specific regions: Sequence locations=1-536,558-602
atgcatttaattattctgatttggctagttatccctcattttatccatgcaacgttttcggcagttcagcttaacaattgcttaagcaagtgcggtgtaatgcatgacccagtgcccgaaattgaagaaacccgagtgagtcagaagatattttattaggattttttgaatgcgcggcacgacctctcattcctccgattttttagtccatgggcggatcggggtctcccgctcattattcgccatggactgcgctgctgttcttcgaaacaaaatgcccgaataacgaacacattgtggaccgttgcactggattcgttgtttcctcgactcttctactcactgccgctcactgtgcctttttgaattacaccgacatgctcttgagatgcaattttgcagaggaaatgcatgaaaatttccactctcagtggtataaaaaaggaatttaaattttaatgagatacaataatcagggctaaacgctaaccaagctgatttctataaaaacaaatcccctaattagagtatttttattgctgaaggaaaccccgaaatagttgctaaaaagttgccaaaaattggaaaaacatgtcaataaa

SEQ ID NO: 61944 - DNA, 2094 bp, Heterodera glycines
  Genomic contig location: Contig_ID=SeqID_819; Location=3096..5189; Strand=+
  SCN-specific regions: Sequence locations=1-55,85-103,128-130,152 -366,390-393,416-539,567-747,797-909,1056-1331,1353-1821,1843 -1957,1980-2094
atggctgcctggatgttgcttggtgccaaggttgttctgtttgtagcggtcgtcgttgttgctgtggttgtcataaattatgcatccgaacagaaggcaaaagtaaaaaataaattattattattttgagaaaaacaaaattgaccaaaataaatagcacattaatgattgatccaaccttaaaacaccgactttatatttcaaaaataattttcgattatttgtgttaatatctgtgtataagctagtcaagttttcgactttaatttaagaaaattaaattggttccgcattcgatgggatattccgttcccatagcaaaaaactgataagcacttatttacattctcgttttccctaggtcacagagattatttttataattttttagagataattaaaaaggaaacacaaataaatatgaatatcatatgcctgtcgtagatcatttttatgacaataaaaaatttaatttcaataacttcagtaatgcaatttttattataagtatgcatttctattattgacacaaataatcgaaagttatttttaaaatttaaagtcagtgtcggattttcctagagcccttttaagacatttgctcgagttcctgaaacggaaattattattttggcaaaatccgttaaaataaatcaagtgcattttcaaggaaacctgtgccaaataatcctcaaaactggcacttattttgacaaaatctactacaattctcttaaatcttttagcataaaaataaaatgttttaaaaatagcaaaagttaaatttaaaaaataagtggcgtgttttttcggaatccaacgcaatttacataccaatgctagcaatctcaaagcttaattccctgtatttttcagtatgaaaagcagtaccagagtgaacaatgggcggaatgggaaagcgaaagtgatggaggaaacaatggaaaggagggaaagaagaagggaatgtttggaaaattcaaggacaatgtgaagggaaagaaggacaaagccaagaagaagatgaaggaaaaagccaaggaaaagaagaagaaactcgagaacagagtcttcgaagaagcagttgtgtacggagtgcgccgcggctttcgtcgtttcatgaaagaatgagagccaaaacttcactataatgcgtagggccgcaaccttgagtgacgaaaaatctcgaaatagccaactaaaatagagacaaaaagtgccaaaatggtgacaaagtagtgaaaaaatccgaaatagtgacgttatagtcacataattttcagccaaaattgagcaaaaattttttattcgctgaatagttgcaaatgaggtacatttcttttctaatcttttattagcaaatattggactttttaaatcaaaattttgtcaagaaaaaaaaatttggtagatgcattttttgagaaaattttccaaacaatttttaggtcgattattagtggttatttttgaatttttttaaagttgattcttataggtgtattttttggtttcattgcatttttgttaaggaattttccaaaaaatgtcgaaaatgacaaaacgccaaaatagtgatttatagtaacgaaaaatgacgttcaaatgaaaaaattttaactcaaaaatgcatttttgagctcctttcttcaaacaattgagcaaaaaaaaaagaagttttttttactaaaagttgcggccctaataatgaggcttatgtttttatgatacatttgatggattttttaaattttgtcagaaataaacctatctaaccctagagattgaattgcattcgataagattcttcttaaaataattttttctgcaaatattgatgctggtggttacagcacaagtgatgttcgagagtcccggcctcgactcgagaaaagtcttgggtttttttggtctcgaacagcactcacagcgggaaagggtcgtttcggcgccagccagagtttttgggggaagaagcatttcattgttggaagtgtggagaaatgtggcgacgatggaggaggagaagaagcgaatatttgggatggagacgaatcggacggcgatggggagaaggggacggaggaagaggag

SEQ ID NO: 61945 - DNA, 477 bp, Heterodera glycines
  Genomic contig location: Contig_ID=SeqID_6542; Location=2578..3054; Strand=+
  SCN-specific regions: Sequence locations=1-344,369-386,408-477
atgacggacgtgcccgaaacaaaggaccaactcatcaagctgatcaacgtgtgcgagaaggcgcgacgcggcgatgaaaaaggtgtggccatatcccatccgatcagtggtggccgaaaattcacaattttgtgctcgtgaaaatgctttatcccctctccccccatttcagttgatcaaattggaccccaatcttggcctggaggaccgtgtttcgttgtcattggcctacaaaggtgcgatgtcttcacgcttgcgcctaattaaggccattgtctccgccactggcagaagaaacgggacaaagcagcgaaaaaggggcgtcgtctgctgacaaatgagtgacggacaaaacaacaaaaacaatgatcagccgcataagaaagaaatgaattcattaagaatgatcgatcgatcataattcaaatcagtgatcaaatgcaattttatgaagaaaaacctctcaaatatatataa

SEQ ID NO: 61946 - DNA, 442 bp, Heterodera glycines
  Genomic contig location: Contig_ID=SeqID_6543; Location=214..655; Strand=-
  SCN-specific regions: Sequence locations=1-442
  Gene Ontology: Mol. function=protein kinase C inhibitor activity; Cellular component=cytoplasm; Biological process=signal transduction
ggcatatatatacataattatttacacaatctgttgaatatcgttgttgtatgcataatatcgtccatctgattggtcagtcagttcggcattttcttctcaggtcgtcttggtgtggctgccgccctccggtgtccacaattccatgttttccctcatcatgcgcaagttgatcgaggcgtcatcagctaatggcaccgtcagtgtggcaatctccgcctgggccaagtcaattgcctgaaaatccggggagaatttagccacattgaaagaaaaagcatgatggaaatcatcaaattggtcccactttttgggccaatttgcgcgcctcgtccaccgattttaagatttcgaagttgaacacggagaagctgagtgcaaggccaagacgagtcggattgatcgctgcaattttggaggtggcgatgtccatggcttcttg

SEQ ID NO: 61947 - DNA, 1266 bp, Heterodera glycines
  Genomic contig location: Contig_ID=SeqID_31624; Location=227..1492; Strand=+
  SCN-specific regions: Sequence locations=1-426,454-648,673-786,808 -903,926-1040,1062-1266
  Gene Ontology: Mol. function=glutamate/aspartate porter activity; Cellular component=integral to plasma membrane; Biological process =synaptic transmission
atcctctcctggcaaatttgctcctcgtcctcactctgattagcgtatttattggcattggcatcgccttttttgtcagacaattccaaccttctcaaaggtattgtgccattaggagaaaaaatcggaaacgcaccgccgggggtggtctaattaattaataaaatgaaaattctcgcgactaatccgccggcacttttcgaatgcagaaccatcgacatgatcggcttcccaggcgaactgttcatgaacttgctcaagtcgttgatcctgccgctgatcgccgccagcctcgtgtccggcctcagtcagttggacacgcgtcaatcgggccgtatcggcgcgttcgccgctttgtattacgccatcacaatggtcagagagaatcagtggccactgggccgaatgatcgaccgatcgctcactcattttcccctccctccctccacccattcttattattggttttaaggtgctcgccgttacggtcagtcagtcgatgtgaaaagagttaaatgaacggattaattgggccaaaataaaatagcccggggggagagactaaaggacctttgattttttggcagtgcttttaccctttcctcggggaacagaatcaaaaatttcggaagcaaaaagaagacattcagcacaaagagaaaaaagggaaaccaaaatcgaatgtgaaattttgtggacaaaaactaaacgcaaaagaatttctgaaaatgggacgaaatgaaccaaaaaaacgaattgcgtgccctttgccctggtcagactggcatttgccttgtgcttctcatccatcccggcgacccgagcatcaaagaacacttcgcttccgagaacgattcgcacccggcaaatgtgtccgcgttggagaaactgatggatttgctcaggtggagaagaaataaattggaaaaattgaaaatggactaacaaatacataagacaaaattagtgggcattattattcaattcgcttttcgaattaatttgccttttaatgccaatttctccccccccccccccacttttttcattttccccttttcgcccccatttagaaatatgttccccgacaacattgtccaggccactttccagcaaatggagaccgaatacgtcgaaattcgtccaccaacaaatgtcagcagcacaacagcaattgtacacgcggtgcacagacacatcgacggaatgaacactttgggtgggcaaagaaacggggggaaaagatggcatttttattccattata

SEQ ID NO: 61948 - DNA, 1881 bp, Heterodera glycines
  Genomic contig location: Contig_ID=SeqID_31626; Location=1..1881; Strand=-
  SCN-specific regions: Sequence locations=1-77,100-643,665-1298,1324 -1350,1373-1495,1517-1523,1547-1881
  Gene Ontology: Mol. function=calcium/calmodulin-dependent protein kinase activity; Cellular component=cytoplasm; Biological process =signal transduction
ttcggaatataaaacaaattacatgattcattaggtgctggaagcagtgtcatttatgcatgacaatggcgttgtgcatcgggatttgaagccagaaaagtatgtgcaatacttatgccttcttggacaaaaaaaaaatttcccgtcccgtggtacagtttgctctactacaaccatgaggacgactccaagatcatgatctccgatttcggcctctccaagacggaagagtcgggcatcatggccacagcgtgtgggacgcccggctacgtggcgcccgaggtgctccaacaacggccttacgggaaggcggtcgacgtttggtccattggtgcgtttttttgggttactgtgcgtgtgcttattgttagttcctcggctactgtattcatcggattcgattgggtattgtattcctcggactcggccggttgaacacggcacaattgagagcaccatgaaaattgaggacatgtaccggtattcgggaatgcatggcactttaatgtgtttggcgtaacactcgtgccgttctcagcccaccccaggaagagaccagaaaattggcaaaaccgtaattgggatcgaaatcctggaaaatcctgaccagcagaatgccgattgcatacggcgttccgaggcggccccaaaatttttcaaaaatcggaatttcggaccctggaaaaccagtaattcccgcacgcactgtccttgctaatgtacattcaaaaagtgatccaaccaactccttcatcccctcaggggtcatcgcgtacattttgctgtgcggctatcccccattttatgatgagaacgacgcaaatttgttcgcacagatcatcaagggagaatacgaatttggttagtagtagtgatatgcgtaaagatgtaaagcagatcatcagcgtgattgataagaacgatcagatcaattcactcacagattcgccatattgggacgaaatcagtgagtcggccaaggacttcattgcccatctgatgtgctgtgatccggaacaaagatacacatgcgagcgagcattggcccacccgtggtcagtgcaatttaatgcatacatggctcattttaggggggtaattagcggtggagccccgaattttgaattaaaacccggaccacaggaccagtggtcttcgagatggaccaggacaagacaaaaatcttgttttcacacaactcctgctggcagagcaattgaatttctctaaaacagggcccaggatcccttggataacccaattctcgaatttattttgaattctcgtctcaattctaaatggttttttgttgttgctgttgcaggatcagtggtaacaccgcacgcacaaaagacattcacatcactgtggtcactcatctgaagaagagtctggccaaacggaagtggcgaaaggcaagtgaagaagcatcagtggatgaatagcacttgacaatttgttaaatgggatttgtcatttaaaaaaagtgccgaaggcattcaaatccccagatgttttggggatttttgggccggcccaaccaagggtttcggcccgaatcccgacatttttcccaacccgcggcaaacctggacccgatttaaaacattcggtggaatgagttccgcgcatgagaatcccgaatcccggttgaaaatgtgtccgtcccacggtcccatcttaaatgcgtgccaacatcccataatttcactgaaatcccgactcccgaaaccaactcattcatatccgctttaatccggtgccggtttcaacggaataaaaattagcaaaaacaaaaaagtgttaattaaaataattcgcttcgctttccattttcaaggcgtacaacgcggccgcggccattcaccacttgcaaatgct

SEQ ID NO: 61949 - DNA, 546 bp, Heterodera glycines
  Genomic contig location: Contig_ID=SeqID_31628; Location=366..911; Strand=+
  SCN-specific regions: Sequence locations=1-346,368-546
atgtcttccaaaagcaaatatctccagtattttaattgcgacacaattccaagcggcaatttatggtgttgccgttctgaaaattgcagctacaaatttgaatcaaagaaattgtctgggtatccaatggcttcacttcgttctcacttaaaaaatcaccatcaaccaaaattgaaagaattggaagaaaaagataaggctgcagaaagcctcaaaaataatgaagcgaacccgagacaaccgacgttaaaacgaatttttgcgacttcaagtccagtgattaaaaaaatagcgagggctgaatctgctacctcgtcgcaattaacctcgaaaaaaccttttgtacgaatttaattttaaatgaatttacataacattttcagctcaatggacacccgacggagaaatgactaagaaaattgacaaggcaattaacgatttggtatgtactgctggattgccgttctcttttgtggaagaacctgggctaaaaaatttattaagaatattggttcctcactataaaactaggtattaatttgataa

SEQ ID NO: 61950 - DNA, 274 bp, Heterodera glycines
  Genomic contig location: Contig_ID=SeqID_31629; Location=588..861; Strand=+
  SCN-specific regions: Sequence locations=1-274
atggcaccacgtgatgactctattaacaataacaataatggtcagccagtcattcaatttgatcaacaaattcgccaggaccctggactaaatgccgtttttgactttgttcgggaacagggcgcacgggtaatttgtcacaacaaattaattttttcattttttgattaattttgtttagcatggcattttcaacacacccgccgaaatcgtcaatgttcttcagcaaatggcacagcatcgactgaatgagcgcagagcggggaataattga

SEQ ID NO: 61951 - DNA, 88 bp, Heterodera glycines
  Genomic contig location: Contig_ID=SeqID_31630; Location=1006..1093; Strand=+
  SCN-specific regions: Sequence locations=1-88
atgctgatcaaaaaaggtagcaacaccaagttgatcagatcactccttcatggtgatctgatcagcccattttggctgggaacgtggg

SEQ ID NO: 61952 - DNA, 351 bp, Heterodera glycines; identical to SEQ ID NO: 53910
  Genomic contig location: Contig_ID=SeqID_31631; Location=502..852; Strand=+
  SCN-specific regions: Sequence locations=1-20,51-351

SEQ ID NO: 61953 - DNA, 311 bp, Heterodera glycines
  Genomic contig location: Contig_ID=SeqID_31631; Location=968..1278; Strand=-
  SCN-specific regions: Sequence locations=26-238,260-282
ggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaa

SEQ ID NO: 61954 - DNA, 2253 bp, Heterodera glycines
  Genomic contig location: Contig_ID=SeqID_6544; Location=963..3215; Strand=+
  SCN-specific regions: Sequence locations=1-75,105-217,240-348,371 -454,484-519,548-700,727-870,897-1040,1072-1483,1546-1705,1744 -1895,1939-1947,1970-2108,2130-2253
  Gene Ontology: Mol. function=protein binding
atgccaacaaaaacggacagcagcgacgatgagtcagatgaagaaaattcagcagcaggtgggtaaataactaaataatggttaaaaataaatttaaaaatgctatttttttagcattagctttttgtcacaaaactttaaattctttttatgtataataatgacttttgaaaattaaaaacaaaaaagcttatttgtcaagggtgtattattttcgttcaattgttttgaattattttcgagccaattttctgcagaatgttcgacttaaatcatggtgtttggttgtattattaagccgaaatcctccagaaattgacattttttcaacaagattttggggttctaaaatatgaacattttttaatgcgattcaaaaactttaaatagtattttttcaataaaattgaattgttttattttgccagcaatttttctgagaatttttggcttcaaaatattcttatttttttaatattttttgattttgacgtcggtacagctaggagccgacggaagaaattttaaaaattctaaaaatattttagtaggagattttgccaataaaaagcaaatttttaggatttttataaatctattttaaaattctcaaaaattaaacattttttggcaaaatctaacaaatcgtatcaatgtcttcaaaattttcccgccggtgcccccattaccgtcgtttctgaaattttttaatatttaaaagatgcattacggaaattacggcactttttgacccccgtaatactaataacggatttcagtaatttaaattccagttacgcccacccctgctgatgttaagaaccattttgaaacatttatgattgtggatttctttaggacagaattcccaaaaaatatttttatttattttttttgcctgatttttttaaatttacaaatatcatgattatcattttagcagaatcaccagggaataaatggatgaagctaatgttgagcacgggaaagtacgcggatgtgcactttttggtgggggacggagacgcaaaaatggtgagttttaaattgcctaattataatccttttaattgtgaaatcgcccccgacacttcggggaagagattagcgaagatcagggacggaagatgggtcaaaaatgggggttattgttagttaattaattttctttaaagttttaatccttttaagcgcgtgccagcccataagctcattttggaagaggcttccgacgtatttaaggcaatgttccgttttgatgccaaaaaggaaaaagcggagaatggtaaaaatatagtaactaaaataactaagatttaattgtcaattagactctgctaattgcccagctgatgtggagattcccgatgttgaagcagcagcattcaaagtgatgttgagcttcatttatgctggtgatttgagcgaattgaacggagacaatgcaatggcagtgctttacaccggtgaatttattttaaggaaattaaatatttataaattaaatgtttgaaattaaatttaatgagtaatatttttttattagccaaaaaatacatcatccctggcctggtcgaacgatctttgcaaattcccatctccgaattgcgcaatgttttctttgcgtatgcccaggctcgtcttttcgactttgaggtgggagataaataatttaatgataatgaatttaagatgatttaaatgcaataattatttatatatttatattttttataaattttaggactattgcaatgattgtttggattatattgatgggaatgcggacgctttgctcaaatcggatggatttttgcaaattgaccaaaaattgttatgcgaaattttgggacgccaattacaaatccgtgaagaattttcaatttgggaagcagtaatttttttaatttaaaaaagttacaatttcattttaaataacttcctatttaattcgaatttattttcggcactccgttgggccaacgaaaagtgccgtgaaaatggcattgaatgttcagcagagaatcgccgtcaaatgcttggcccggcacttttcaaaattcgctttcctctcttctcacaagaggatttctcggagaaaattggtaaaaataagtcaaaatttcaaatgcattatttgatgactagggatgtcaaaaatatgtacaaaaattggtcaaaatatgcacataaatatgtaaaaaaaaatcccgaaatatgtataaaaacccaaaatatgtaccaaatatttaa

SEQ ID NO: 61955 - DNA, 89 bp, Heterodera glycines
  Genomic contig location: Contig_ID=SeqID_31637; Location=532..620; Strand=+
  SCN-specific regions: Sequence locations=1-89
atgcgaacagagcccggagaaaggaccggagtgttcgcaacgggcggaagagaaaacccactcaaagtttggaatttggaagagcaaaa

SEQ ID NO: 61956 - DNA, 953 bp, Heterodera glycines
  Genomic contig location: Contig_ID=SeqID_31640; Location=258..1210; Strand=-
  SCN-specific regions: Sequence locations=1-175,216-425,448-790,812-953
atgccaaaaagaaaaatgccgaccgaattaaatgtcgaaattgtggcggcacttccctttgatattcgctgggcaaatgtgcgaatttcttttgcatttgaccattttttgtacaaaaaacaagcccaatggatcagaaatgaattgatcagacaaaaaattgtggaagaaaatgtatttttcaattaatttttaatttatttaaacatttttttgggatttagaggcgacggcttggacaggcaaaacgtcggattaaattaatgtcgttccgtctgtttgaaaaccgcttgcgcaacatgagggatcgtaagttttccagtgctttttctttttttacagtacacttttaccgtatttttggttatttactgtttacagtatcattcgactgtaatttgccattactattatgacaaagaaataattttccatattttcagtcatcgcctctcacttccgtctcgacaattgttttggcttgactgaaaaccagtttcgcggggaacttactccggagattttcgaaattcaatttgacgccatttttgagacgattgaccgcaacaatctccaggacatttcctgggcacaaaaatgtaaaaaaaaatgcccattaatgagcgataatgtggataattaagtcatccaaacgcttgccaatttctgtgagggctatgtggacgaatatttggcggcaaatcagtagcaaattttaagatggtttgatgtgaccttgttgacatgaaaatgctaaaaaacgatttttttttaattttcagtgttgttgttattttaaaattaaaatttagcattttcttagtggtgtaaatgcagactaacggtgcaaaaccgtcgctctgatcataaatttctcaaattgtttgctaatcgacccacaatacctttcttctgttcctttaacgttgcgctgcttataaatgacaaataaa

SEQ ID NO: 61957 - DNA, 800 bp, Heterodera glycines
  Genomic contig location: Contig_ID=SeqID_31641; Location=92..891; Strand=+
  SCN-specific regions: Sequence locations=1-120,143-800
atggacaagggccgttggattaatgtgtcgaaggttactaattgggtttttaaaattgttatgtggggcgagggaggttcagctaatgtcctggatttctgagatcgggaaaatcgcgaattccagttttcttcaaaaatctttcgagaaatcctcccgttgaatattttacccgagccaaacatcggttatgctgctctctctctactgcactcaaactttaaaaatttaagttgatttactgatgggcaggcaccgcactgaaaatttagcaaatttatatttctataagaattttaataactacaatcaattcttttcagcccattcctttcactggacaagccgaatactgccacaactttcggcctctttcacttgttcacaacatcgagcacactttccgcgtcatcactgtgtttgttgatgggcaggaggaggcgagtgaaacgtttactggccgtctcactatgaatgcggtaagcttcaattgaccgtaattgctgcttaaacattgaatcattttcttgacttgtttagtgagtgaggaaggcccaacaaatgctgtgtcagtgtgtggagaaatgaaaaagctccgtcctcttcacatattgttgtgttgttgctgttgttttgctgttggacatacttatttaacttatttgttctttttctgataaaaccgtgtagactttctttttctttttttgcaggttaaaaagacatttgaagtgcaaaatgaggcggcattagcctatttacctagttggtttttcacattgatttgtcattttgcttga

SEQ ID NO: 61958 - DNA, 722 bp, Heterodera glycines
  Genomic contig location: Contig_ID=SeqID_6546; Location=162..883; Strand=+
  SCN-specific regions: Sequence locations=1-265,287-287,311-661,683-722
atgataaattcggatgattggccaacaattttagcgacaaattcaatgaattttgttgaaaaagtgagagaattttccaatttacaaattattgcccttttcagtacaaaacttttgtcgcaattaattgtcttggtcaaaacggagctttcgtccgcaatttttgccaatttgtcgaaggtcgaattcgtcttcagatgacttatgacattggccacagaggggcgacgacgaattggcacatttacccggcactattccaagaaacatgccaaatcacacacaaattggagcaaattccagcaaaatttcggtagaatttgcaaaaaggctgacaatttaaatgggaaattgaattatattttaattgcccattttccttccagctcaaattaccaccaatgcaaagtttggctgattggctctgatcagtcgctgaatggtactgaccagcggatgatcaatgggcagctgcgcaacttcgactgggccataaaaagggacttcctcaaattcaacggcaaactgtcgaacaaagcctggggtgttgacattgacgaggaatgccaacggatgaacgtcactttgaagtccgtttttgtggaagacttggcacaattgttgagcagcagcaattagcacggaaagggaagcacaaccgaaagaaagacagaacaaagccttttctaattggctaattaataataccacgaaatgtcaca

SEQ ID NO: 61959 - DNA, 867 bp, Heterodera glycines
  Genomic contig location: Contig_ID=SeqID_6546; Location=1731..2597; Strand=+
  SCN-specific regions: Sequence locations=1-560,612-660,691-716,766-867
atgcgtcacgtgttgatgctcaaatggtcacgaccgcaatcaaaagttttccaaccgctgattgactggtgtgtgaactttttttaaatttaaaccccactgaaattacaggctattaatcaattacgttggacagcccaggcccaatggcacatggtatcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaacgaccctggggcccaaaaacgagggcccaaaaacgggggcccaaacgcgggggcccaaaactgcgcccccgactcgttaaagtctttacaaatcacagtttctgatgaatgcaattctttatgccgtcagaacatttacaagcgcttaattttgaca

SEQ ID NO: 61960 - DNA, 396 bp, Heterodera glycines
  Genomic contig location: Contig_ID=SeqID_6546; Location=3053..3448; Strand=+
  SCN-specific regions: Sequence locations=1-238,262-396
aaaggttgcgggttggttgcgggtgtttcccgcacgagcccgtgcctatgggaggggtgcagccctttgaagttgccgccccatcaaaaatccacgatggggggggggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttatgatgattttttgatcctgaaattaaaaattctttttgaaaattagc

SEQ ID NO: 61961 - DNA, 545 bp, Heterodera glycines
  Genomic contig location: Contig_ID=SeqID_6546; Location=2346..2890; Strand=-
  SCN-specific regions: Sequence locations=1-228,250-545
atggcacgaaacaagaagatgactgaagcccagtggcagcagctgctcaatgaaattatttcggaaattcccgaagaagtggccaattccgactacgtaaaaatgttacggagcagaacctattcttcgctgaacagtctgttggaaaacgatgacgaatggtcttggtcttcttctctcttttcttggaaaaacaaaaaatagtccgctcaaacaattaaatctcaattaattttaattttttactaaactaacaaattttcatttggtaattcactcttttattcttttattgtcaaaattaagcgcttgtaaatgttctgacggcataaagaattgcattcatcagaaactgtgatttgtaaagactttaacgagtcgggggcgcagttttgggcccccgcgtttgggcccccgtttttgggccctcgtttttgggccccagggtcgtttgggccccagggtcgtttgggccccaagtacagaaaaatgaaaaatcacagtaaaaacaactttttaaatttcagcataaaaatgtaaaataa

SEQ ID NO: 61962 - DNA, 879 bp, Heterodera glycines
  Genomic contig location: Contig_ID=SeqID_6546; Location=4835..5713; Strand=+
  SCN-specific regions: Sequence locations=1-83,126-128,433-654,677-879
atgcccagtggagaagggccgaggaatgtccataaatttgactttggattcaaggaacaccagcggatagggtaagtgtttttaataaaataaaattaaaatagaaaaaactaaaataaaaaaaacaataaataaatttaaaagaaatacattaaatttatttaatgaagcaaaaattctttaaaaattaaatttaaaaaatcaaaaaaaaaataataaagtaaaaaataattaattaaaaaatattaaataaataaaaaatatagtttaaaaaatcaaaataaattaaataataattaaagtaaagaaaaaaagaaataattatttttcattaagcaaagcagcaaaaaaaaaacagaaaaaaaatttaaaaaataaattaaataataaagaaaaaataaatggaaataataataataataattttattaaggattacaaatgcggataaattatgtctgttttacgcgctcgtagcctcgaaattttatctggaattgcatgtggacagcttcaggagatttatgaaaaatattgtgagacagagggatgcagctattgagcttttacataattgtggaattgatattaacgaatatagctatggtgtggagcaattaccgaatgttcagaaatattgggtgggtttaaatgaaaaaatgcaaaattaataaatttttcaggatgagatttaccccggaaagtaccgggttgtggcatttgagaagtcagctgatccgcggaaatcgatccgtgttttgtggaagggccagatggggcgagagaaggtcgtaccgatatttttggagaatggtcattgggatggtctgaagaatttcgtctgcttttttaatcgagggaggaagttttgtattgact

SEQ ID NO: 61963 - DNA, 226 bp, Heterodera glycines
  Genomic contig location: Contig_ID=SeqID_31645; Location=1185..1410; Strand=+
  SCN-specific regions: Sequence locations=1-35,62-113,136-226
atgtccgttcagcaagtacaacaaccaattccggtgccaacaacaccagcaacaacaacaattgaacataaagtgctcaaggaactcaaagtttgttgcattttaagagtaattgttacatttttacacaatttattaatttcagcatttccaatgtttaaattcgggacaaaaacgccttgaaaagcagattttgaactcaaaattcagatttttaagaatataa

SEQ ID NO: 61964 - DNA, 379 bp, Heterodera glycines
  Genomic contig location: Contig_ID=SeqID_31646; Location=387..765; Strand=+
  SCN-specific regions: Sequence locations=1-252,274-379
atgcctcaagcatttggggaggcgatatacagtatgaatgaaggcacgccggtaaaagacaagcacaggaacaacgatacggtgaaaaagctggaggcagtcgagtgggcgcaaaagaactcgatacatgcagcagcaaagaagttcaaagtggaaaattttttatttaaaatggatttttggatgattttttctgcaaattttcgtgatttaaaccggttcaaaaaccggtttaaacgctttgccgcgcagtttttgatggtttagctgttttcagctcctaagaaaacacataaaagtatttttatgcaatagtgagtctgagacctatgatggatattttccgacgacaggtatgtaactttattataaagcaaaa

SEQ ID NO: 61965 - DNA, 1435 bp, Heterodera glycines
  Genomic contig location: Contig_ID=SeqID_31649; Location=248..1682; Strand=+
  SCN-specific regions: Sequence locations=1-36,58-136,158-475,507 -533,555-1435
atgagaaataggatacccattcaagctttgcaaccatcatatgtgggagaacatgcacttgatctggcttttcaaccatcgaatttcggagcatcaacatctgatcagtcttttcaaccgaatttgggagaacatgcacgtgatctggcttttcaaccatcgaatttgggagcatcaacatctgatcagtcttttcaaccgaatttgggagaacatgcacgtgatctggctttacaaccatcgaatttgggagaatcaacagctaatcaagcttttcaacaattgaatatgagaaataagatacccattcaagctttgcaaccatcaaatttcggagaacggacatctgatctggctttaaaactttcgaatttgggagatatggcatttcctcaggcatttcaaacactgaatttggaacaaccggcgttgatgccttttgtaagttagtccagtggttttattcgggaaaatctaaatttttttttatcaatttaaatttaaatcctattttagcgcaaaaaacaaattcaacaagcaaaaatgctttacttaagtcgggcacaacagcaattagctgccaaattcgaaaaaatgcgaagcaattttttggcaatatacggcgaattgcccaaattctcgggccaaccaaaatcgcttttgggtatgccggcacatcttcagcaacagtacaaatcgcatccgtacattgccaaactgctcgaatatccgcagccagcccaaccaacagacattttcatgcaaaacttaccaaaaatgccatcagtaccgcaaaatcatcaatgcaatctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttgagcatcagccaacatttacggcagaagcaattccatttaagcaactgacacaaacaatacaatctgagcaccagccaacaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttga

SEQ ID NO: 61966 - DNA, 432 bp, Heterodera glycines
  Genomic contig location: Contig_ID=SeqID_31650; Location=297..728; Strand=+
  SCN-specific regions: Sequence locations=1-170,255-432
atgaatgttatttattaatgaatgaatttttgactggtacataaagcgattctatgcaaacgctcttttttgatgattcacttctattggcttcgccattctgtgcgatgaaagcgtaaaattatggtgatgttctgctgataattataatattgcgatagaaaagcgtcatttatattcattttattttattaaaaggattatagtttaatttgtaaaaaatgataattcttaattaatttaaataataaaatggtaattaatgatggaaattttaacgatcaattgatattggaacaaaggccactcattaacaatatttagttttatggatttcaaaataagaagtaccagtggcggttttctagtgccaccgttagtggtattaacctggtaaaatttgcattggtaagaatgggaattcgagcataa

SEQ ID NO: 61967 - DNA, 2655 bp, Heterodera glycines
  Genomic contig location: Contig_ID=SeqID_6547; Location=1155..3809; Strand=+
  SCN-specific regions: Sequence locations=1-177,212-285,308-346,368 -498,527-600,630-771,796-902,924-1436,1458-1535,1557-1630,1659 -1682,1704-2342,2364-2392,2414-2456,2480-2525,2547-2578,2600 -2620,2642-2655
atggccgataattttggatggaaagtgggaaaagtgttcaaaaggcgcaatttgaataagcaattggctgaaagatgtgttggcacagacggtacgaagggatggcacgcgctaatgatcgaacagaaggaaaacgggcaaaatggtctgatccttaagtcctcttttgggtgagtgatttaattttaaattaaaaacaaatttaattttagaaatgatttatccgtggaaatgggccccgaattttttattcaaggctccgactttttggacattaacatcacaaagggtacagttcgacaacaaattaaatttaatgatcgagtcattagtgttaatgagttcctcttccgctgaattggccgagttccaaaatgctcttccgttcggtgtttttttgaatgatttcgacggcgcagcgcttggaattatcgcatttgaaattcattgtgccattggaacaaatgacgtgaacagttgcaaaacgatggtaaagtgaaatttaaaaaataaatttgaaaattttgaatgaaaaaaatggttggctacgggggaatagaacctatggctacaaaacaactaagatttgaatgtattaagaatttttttttaataaaaattttaattttgtaggctaccgaagaaaaaagtcgaaaattgaccactcggggaattcgaacttccacaaccactcgggcaactccgccaaaaacaaagctgaaaattgtaactccattcaaaactgaaacaccacgcgttgtaatcgttttcattttttaaaaatttaaaaataatgctttttctagtctgaaattgaaaaatcaccgaaactgaccaccctggaaacccatacaaaaacaaacccaaatgtcggaacttcatctgccgtaatcatttccctcaaattaaattaaatttttttagccgaatctgttcactccacgtgattctactgtgaagcatttcggcacaaattgcgtccaaattgattttccagctgaaattgcccaattttcgctgaacgtttccgccgcactattcggcattgcctgtaaacaatacttaaaaaagtacgaaattggacaattgccaaaaaattacgacgaaaaaatggaaataaaagacaaaatggaagcgtgtggaaaagtgccgacagagacaaattgcaaaaagttaaaaaaatggaaattaaaattaaattaacccctaattaaggtcatatgagctgattggatgttatgaaagcaaaagtcagcagaaaattgccaacgaggaaattgccgaagtttgccgaaaacacctcgcaaatgccaagttttcggatgggtttcgaattcggaactgtgccagtcgtaaaccagggacgaaagtgatcgttgtcgaatcaattttggaattttcactcaccgagaaaaagtgaatttaaataagtgttgaaaattttttaatttttttatcaaagttataccatcacccgaaatgcttcaattgatgacgtaaaggaatttgaagctgcaacaaaatcaactcaattatttttcatcgaatttggccaccaaattgggcaaagtgcgctccgtggggaaagcggcggcacgtatttgtcattggacgatttggacaaaaaggcaaaaattatataaaaataatttaaaattgttgtttctttaaatttagaatgaaacaattggccacattttgggctcaatcgctgaacaatcaattgatgggggttgggcgaaatcaattcattttattccgccgtctgacagatttctgaaagcatttttccaaatttggaacccgacgttttcaaggcgaatcaacaacgaaacgagctggatgccatatcaaaacgacccgaacaatgtaagagttgggaaagaaaacagaaaaaggttaaatattactagacgattccgactagttgcgatttgctgggcaaagattgtgatgcgacacgcgaaattctacggaaaattcggaaagttttggagtgctgctccccctctaatgctgctggcccatgtatttgtaaacttccgaagcccgacctggtaaattaataatttaagctaattgtactgtcattttctgttagagtgaatttgcggtgcctccgggtacaaatccgtctcagcaacaaaagtcacgcttcagcagtaacagccaatcggacgacccattggattggtgggacgatattttatatacgaaagaggatgcgcaacaaagatacgactattttatggaaggtgattactgtatgagaaaaaaacattgcttaattggctaattaattaattatgttggttctaatttaagtgtgcgcaccgtgtttcccaccaaaaacgaaggggaaacggagaaggaaaagacaggcaaagccaaatttgagcaaatggaccaaatttccaattgcgatccgtttcagcaaatcatgtagtatatatgtagaatgaatttataaattttttaacaacattcagtgggcgacccgactccgcaacaatatgttgaagctgttgaacaagggataaaattaatcatgtgggatcattttatcaatcattaaaccgataaatagtgagataaatagatactttagataaacttttgtccaatattccttgctttctgttaaaaagccgaaaa

SEQ ID NO: 61968 - DNA, 864 bp, Heterodera glycines
  misc_feature (696)..(696): n is a, c, g, or t
  Genomic contig location: Contig_ID=SeqID_6547; Location=4463..5326; Strand=+
  SCN-specific regions: Sequence locations=1-115,137-266,305-449,528 -664,702-864
  Gene Ontology: Biological process=body morphogenesis (sensu Nematoda)
atgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgttgaaaacaaatgccaaaagggaggatatcccaacccaaaccattgcaaccaatgcctttgcccggtgggatacggtggagaaacatgcgaaatggtcgaaaatggtaaaaaaaaaattaaaatgataaaaattattaatatttcagatggaaattgccaaactgacagggcaaatgaaattgaagcagattggcaaattcgaacgttgaagccaaaagtgagctgcacaaaaaaggatgagtcatgtggatgccattggcaaataaaggcaacatttatatgaaatattaaaaataaaattaaaaaaacgaaaacaaacaaataaaattaatataatattactaaaaattaatttaaagaaaaaaaacatatttacagccacaagatggcaaaaaggtgatcatcaaattgaaatggctgcatgaaaaggtgctcacctgtgatgacccttgcggcacttatcgagtcgaaataaaataccgaaaagacaaaagggcgcggggtaatttaatttaattaaataataattatttanattttgtaaaggtgcatttatttgctgttccaagcaaattgataaagatgaaacaaagaattggattgaggcggatgcacccggcgaggacattctcatttcggcttatcccaatcagactaattttgaaacatttacggaaattgttcgaattgacttacgaaacaa

SEQ ID NO: 61969 - DNA, 834 bp, Heterodera glycines
  Genomic contig location: Contig_ID=SeqID_6548; Location=97..930; Strand=+
  SCN-specific regions: Sequence locations=1-390,417-529,551-568,644 -666,690-834
acggcgccaaaattttgccagcgagcgattgtccggacggtgtgaattggaagccggagagatcacccggaaaggttaatatgtgcaatcatcccgataccggcaagcttgttgaatgctgcacgaaggggcacaaatgtccattacgggccaactcagcattcggctgtaaactaattgttggtatggtaaaaaccaaaggggttttagaccgagtacaacttttcactaatcatttacaataagaatttataattcgcatccataatgtactatagactcagtaccctattgctttaacaaatatgttaattctctgggaaattattaaatttttgatcaaaaaaagattttagctttggccatactcttttagacagttttggcacactttgggaaaattttataaaaattttgcgaaatttgggtatggcctagtctcagagagggtatgaataagtaaaatctgaaatgttgaaagaaaattattaagctaaacggccaataccgcgagatcagaggcgtaaacgaaagcaaagtcttctttttcgaatgttttgtaagtgacattaaataatttaattaattaattgtaaaaaaatgcattgtcaattaattaaaaattaattgattaattggttaaatttatttttaaagaggcgagaaggagagatgaaaagcttttggggttattggaaggacaaaagcaaagacccaattcgcattgacgaaatgcaatgcatgagctacgaacaagccggcatcataaatccgccagacaaaacagtgattgattacccattgcgcttcaaaagtgccaacacaaacgaataa

SEQ ID NO: 61970 - DNA, 115 bp, Heterodera glycines
  Genomic contig location: Contig_ID=SeqID_31652; Location=104..218; Strand=-
  SCN-specific regions: Sequence locations=1-115
tttgaatacatcgaccaacttgacagtgagaacaaacacgaggaggcctattgcctgttggccaagcagagcctgaacaccggcttaaatcagcaggaaattctgtggcgacttg

SEQ ID NO: 61971 - DNA, 507 bp, Heterodera glycines
  Genomic contig location: Contig_ID=SeqID_31655; Location=769..1275; Strand=-
  SCN-specific regions: Sequence locations=1-128,313-412
atggcgattaaaagtgctccaacagtgatcagaagaggtaccacggtgattagaagaggtccatcagtgattagaagaggtccaactatgattagaagaggtacaacagtgactagaagaggtacaacataaattcaaattaaaaattgtatgaattataaatttattaaatttaaaaataaatcctccatttattaattgaaaataacgttgaaaattaaaaattgattatttaataaattttagatgaaatttacaaattcaaaaaataaataattaaattctttaatgtaaaaaattttttaaaataatctacaacaaatcttcagattagtttaaaacattgaagataacgaaaaaatgcattaaaaataatatacaccgcccgggtccgaacctcccttatgaaatgtataataattgaatagttatttaaattgaaatgaaaaaaattttacaattaaattttaaaataatagctgaaattctttaattaaatataataaa

SEQ ID NO: 61972 - DNA, 1215 bp, Heterodera glycines
  misc_feature (1197)..(1197): n is a, c, g, or t
  Genomic contig location: Contig_ID=SeqID_31656; Location=68..1282; Strand=-
  SCN-specific regions: Sequence locations=1-181,229-289,336-370,392 -510,532-644,666-797,831-965,1051-1215
atgtttatacaacatacatattcgtctccattcaatattaatcaatgcaaattcgtaagataatccctccatcacccactccaatttattctcgaacattggcagattggaaatctcaaatataaacataaatgttgtgaattgatatatttgttaaaatccattttcggcccacaaattcataaaaaaattttttttaaaattaatttgtaaaaataatttttttatgcacgactttattttgcgcattgttcgcccttcgacaatcatttttattatcgcggtgatgaaaataaataattaagtatatttaattaaattaaatttaaattttagttgatttttctgttgccattcctcttttatgtaacattcaatgcaacaaaatcaatttattggcaaaaaattgagctaaattccatgtttctgaactccaacgacagaaaaatgtctgagccaaaaaatgggaatgaaattccgagcaaaattgacagattgccaaatttggacgacatgaacattaatttagaatggcataaattgttgataaattcgtcaaaaatttttaaattgccagaaattagaacagctgttggtgaacaattcaagaaaattgaaaccatttctgtaaatccggtaataaacaaaaatattttctataatattttgcttattttcataattttgggtccattttacgtgggttctcaattgttagcatgaaaaagccaggaaaaataagctttaaaagcaaaagcagaattttttcaataaatcgtcatcgattgaattttaagaaaaaattattacattcattttattagtgtgaatttccggtttttttaacatcggattaaattttcgaaccttctttttcatatagagctctattatttctgcggaccgaatagacaaatttgatgaccctaatgcggaaaatgtagattatgtgatcataatccaggtaattaatatttaaatttgttttttgaaataaaatcaattaaaaaaatatataaatattattcaaatttactaaaaataaattaaggtccatgatcgggtgaaatatttgaaatcgctaattaaaagcttgtcaaatgcgtatttaattggacgagttttattggtatttagcagcgattttcaatcagaagaaataagtgctgtgatacgaagcattggattttgcagggntatttaataaataataaa

SEQ ID NO: 61973 - DNA, 199 bp, Heterodera glycines
  Genomic contig location: Contig_ID=SeqID_31657; Location=88..286; Strand=+
  SCN-specific regions: Sequence locations=1-53,76-155
tgcatcatttcgggcaccaccagcggctgatcagaagaatcaaagaagtgttaaaatgcgaaaggaattatttaatcgaagaattaataaatataaaccttgaaaatgtcacaataattaattacttattaatatgttgacgcaaaattttgtggataaatttgtaatatttgaaaaaattcataaatattatttaatt

SEQ ID NO: 61974 - DNA, 438 bp, Heterodera glycines; identical to SEQ ID NO: 61170
  Genomic contig location: Contig_ID=SeqID_31659; Location=405..842; Strand=-
  SCN-specific regions: Sequence locations=1-1,24-160,190-325,355-438

SEQ ID NO: 61975 - DNA, 122 bp, Heterodera glycines
  Genomic contig location: Contig_ID=SeqID_31661; Location=284..405; Strand=-
  SCN-specific regions: Sequence locations=1-122
atgggtccacggggtgatcaagcccgggattgccttcccacactcgctggtcacacaataagtggctttattctcgggacgactgagctccgttcgcttgaaaaggcaaacgttaaatacaa

SEQ ID NO: 61976 - DNA, 1468 bp, Heterodera glycines
  Genomic contig location: Contig_ID=SeqID_6549; Location=188..1655; Strand=-
  SCN-specific regions: Sequence locations=1-260,311-330,391-430,470 -511,562-658,713-1468
atgcggcgcagttcggtcagtgacttctccgacttttatgacgaattcttgaaggacatgcgtatgagcaacaataaattcttggcggaagggataaaccaagtggtggatgatgctaaactgatgggcaccaacaattcgggggaaaatcatggtcatgatgagctaaatgacttagtcaacgacggagaaggtacggtacaaccgtgattggtcgattccaaaaaagtgcaaaaaccaaaaatctgatttttcctatgattttttatcaattttttaaattaagaatatgttagaatttaattaaattgatgcttaaatacacattcgtttaaaaagtttttttagatttagaataaaaataaatttaaattacataatattaatataggcgccattgaaactttaattttaagtaatctagttaatgattttattaatattaggtaaattttaattatttttattagagaaccaaaaaaacttttagaagaatgtgtatttaagcatcaatttaattaaattttagcatgtttataatttaaaaatgataaaaaaaatcataggaaaaagcagatttttgatttttgctctttttaggaatcgacatagcaccggtacaactaacgaacctcgcgaactatgagtttccaaatcgcattttaaaatcacttttaatctttttattcagttatttaattttgttttacgacaagctatctgatagagaattatttgctgattttttttaaaaaaggtatttttgcctctatcatccctttaaaattttttattacttttttaacgatttttcgaaaatccagcattgggtagtactgtgcatttgtgcatagcacagtttttcagcatgatgcaaatttgtgcagtaaaacgccgtgcagaacacagggactaattataattaatgaccaccggatttagaaaaattctgcttgaaaattaatttttgatttcggagggagcgtggagggctaataaataaacggagggcgactgacccgggggcaactgatacgcggagcggaaggcggggagcaaaagtagtgtaccctcctgggccgtgtccctgcacgtgcatagactttaattaatgaattaagaattaagtttaaataattgaaattttgagagctgaaagcactgcttgaaatgcgcacccgcctgctgtttgctgcgggccctgggcgagtctttctgcgcgcaatttccgtgctcagcaagcagatgactgcgaatgagatacgtaaattcaccaaatattttgaatggtttcccgcgtgcagagtgcgtgagaatgcggacacaattgaggcgaacggaaatggcgtgaaaccgccggcggcggcggatgacataaaatttgacgtggaacaagcgaagatggatgacgtggcggatttcgagcagttcatgcatgaagtcaaaaaggaattgctgaaggacagcg

SEQ ID NO: 61977 - DNA, 3600 bp, Heterodera glycines
  Genomic contig location: Contig_ID=SeqID_6549; Location=2323..5922; Strand=+
  SCN-specific regions: Sequence locations=1-383,405-895,917-964,986 -1289,1311-1594,1616-1814,1836-2750,2773-3062,3084-3181,3225-3600
gtgtgccggtatcccaggtgtattcgcgtatcttgacgatggattaatcgctacaaaaacgcttgatcaacacatcacggcactgtacactctttttggacgcataaaagaatatggtcttcgcatccaactggacaaatgcaaatttttgcagcccgaacttttgttccttgggcatattgtgtcagcaaatggcattcgtcctgacccatcgcgttcggacgcaattcggaaaatgcccgcaccgatcgacaaaagcacgctccgatcattcttgggagctttgaattattatggcagatttgtgaaatgcatgcgtgaattgcgtgcaccgctcgacaaactcctccaaaaggacgtagtttggaattggacgtccgaacagcaaaatgcttttgaaaaagcaaaggaaacgatgacgtccgaccttctgctgacccattacgacccggcacgcccaatcgtcgtatcagcagacgcctccaaggatggaatcggcgccacattaagccacacattccccgacaaaaaggaaaaagtggtagaacacgcagcatgcacattgacagcagcgcaacaaaattacagccaaattgagaaagaggcactggccattgtgtttgccgttcaaaaatttcaccgcatggtgtacggccgaaaatttattttacaaacggaccacaagcctttattggctatttttggctctaaaaagggcatcccgatttatgccgcgagccgcctgcaacgctggtcaatgattttggcgaattacgactttgaaattcgctacgtcaacaccacatcatttggccaagccgacgttttgtcccggctcattgctaattatccgcgtccagaggaagacatcctgatagcaaacatctgtgctgatacagattgcttcataaattctgttttcgaaaatagaatggatcaaatcccagtgacaaccaccgaaattacagcagcaatggcaaatgatcaaccactccaaatggttcttcaatttttaagaaacggatggccaaccaaagtcgccgatccggaaattagtccatattttccaaaacgggacaaaattttggaggtcgacaattgcctattgtatgagggtcgagtgatcatcccaacttcgcttcgcagtcgcatcctaaaggcattgcacatcgcacatccaggcattgtgcgcatgaaagcacttgctcgtcgccacgtgtattggccgggaatggactcagtgatcgaaaaagttgtgagcacttgcgaagagtgtcaattgggccagaaaaaccccaccaaagcacctctttcgccatggccaacgacggacaaagtctttcagcgtgtccacatcgattttgcaggcccctgctcagatggtcaccaatatttaattctggtcgactcattttcaaagtggccagaagtttaccgaatgaacacaatttctgcctatgccacagtatttgtgctccgatcaatcatttttttggctggctcggaatcccagaagaaattttttccgacaatgggacccaatttcgatccgccgaattcgccacattttgtaaagaatttggtattaagcacattttcacaccgccatttcacccacaatcgaatggccaagtcgagcgcttcgttgacaccttcaagcgttcgatgaagaaaatgtcaaaaagcgaaaaggattgtatcgaaaagatgctattctcctacagaaccactccacacgtcgccttgaatggattttcgcccgatcaattatttttcggcagaaaattgcgcacaaaattgtcgctagtccacccgaaaggagaaaaagacgaaaattttgatcgaaactcattcaaaaagggtcaaaacaattacaccgacaaaatggctctaaattttgatcggaagcatgggacaaaaatgatcaatttctttccaaatgatcatgtcctactgataaatatcggaacaacaagacggagtggctgcaaggaaaagttgttgagaggcttcacaaatcgcccacatatcgtgtttatgtgcctgttctgcgtcaactcgttcatcggcacgcgaatcagctaaggcgacgccatcttttggaagaagaagccgaaaaggaggcacctcaaatcgaagagccaccgccggttgtcgaaccgcctcatccgccccaacaaaatcagccggccaattcaccattggttatccgccgatcaacccgagttaaaaagccgcgccaattttattctccaggatgaaaaatttaggcttaaaccttcgggtttcgaatttaagaggggaggtgttagagaaggaagtaattattgattaggtgtatgaccccacgccacttcgccatcttccccctcccattcccctcattcagttttgtgattgtgcccaccaatttgacctctccaatttattctctgcattattttatttatttctccggcaaataaacttatttaatttgttatcttcggacataacagatatttattttttctttaggccttatgtctcggctagacaaagtggtcatcaacctaatattttgcaacaatttgtcgtttaatttgatcaacagtccacaatttcgagcattatgtaagccatggaatgagcaactgaaagatgaatcacactaccgcaaaattttgcccgttgcaagtgaactagtcaagggaaagataaaagaggagttacgaaaatgtgaagcattttcttgtacatctgacatttggagtgggccaaatgaaggatttataaggtagctgaaattttactatttttgaaattttaccatttctgatcaaatgttaagtctaacaatcgaaggagttacgaaccaatgggagcgtgtgagacacattctcgcaattaaaccctttcccggcactcacactggacgtcgcgttgctgaaattttgtccgaaattattgaccagtgggaatgtcgagacaaaattcacgcttttgcaacggatggaggaacaaacatgaaaaaagttggttatgagctaacgagttgtaaatattcgtttgttttttgcaggcatttgtggaagagaacgaaaacgggcgaattttgcctttttatcgatcaaaatgtgcggcgcatttattggaccgtgctgtcaaaaacagttttggcaatcgagagggtgaaatatcgggacttttttgtatgaaatctaaatttctttaaaatttttcttaataattaagcaaattgtcgtcggattgttggaagggttaaacactcgattaaagcatttacagaattgaacgaagcacaaataaaggagggacttccgcagcacaaactgcttcaggtaagctgaaatttcggagtaaaagcaccagtttactgtaaatttaggaaatggcagttcgatggaattcttctctgatcatgataaggcggctttctgagcaaagggctgctattgaccgaatcgcatttgaacagaggaaatttgaattgactttgcaagatggcgagtggcgactgcttaatgcattggagatgctcttggcacctttggaagaagcatcactttatttttgcaaatcaccgctttcaactcaaat

SEQ ID NO: 61978 - DNA, 1609 bp, Heterodera glycines
  Genomic contig location: Contig_ID=SeqID_6549; Location=6298..7906; Strand=-
  SCN-specific regions: Sequence locations=1-735,758-776,800-902,925 -1027,1050-1229,1265-1609
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaatgccatccgcccattggagcgtgttcaggaagacagggaagccatcacaaaaatactggaccatcttgaagttgaggcccaaccaacggccgtctttcgactcggacgatacgacccgcagcgaacaacaccacgcccgctcaaggtggtcatgccaacgcccacacaccaacatgtggcactcggaggatggaagcgcgagcgtgttcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacgaatgaccagactcccattgttgcaccaaaccagaaggaggccagcgaagacatgtccaaaccgccggaagtttttgaccaaacaatcatcgtttgttatgaagcattaaaatcattgccaccaaccgacaaaatttctcaccaaattcaatcactcaaagaacaataccctcatcttttcaataaatagttctttcagacctccaaacaaacatttcctcaaaaaaatacatttattccagtacttcacatttctcaccaaaatttttcctcaaaaaaaaaaaaattttttttttctctctctttttttaaactcttaaaaaaatttcttttcgttggaggtctgactatatttttctccaaattcaattgtcttatttcactgctatcggactttatactttccaatcaaatttcacaatgttttcttcagtttgttttcttttatcactacttcacatttaacctcatttccaccaaaagtgtaagtggcatatgcccttcttttggtatttttatttttgaataaataaataaataaataaaaattttttatctatcaaatttttgaatcttttttatgattttttttccatatctgtcagagattgccttttttcattttccgtcctccagctctgtgggaaacttttgttactttaattacctagcctcattttaggcttttttggttggccgatgaggtgaaattttaggcattttgagttttttgttatggggaaaaaacagttttatttagtaattttttgatcaaagcgggatcgggagttcaaaattttccgggacgggagtcccgaacgggattcccgtaaaaatcccgatcccgttcaaatcccgtccatttttaacgtgagtcccgggcgggagcgggagtaatccgaaaatttaattaaaactcacaaaaatatttttaatgcacaaattttgagcggcaatacgtttattaaagaaaaaataaaaaagcaaaattttaaatcaataaaatcgaattttcggaattgatttgttcaaaaaaatgagcatttcagcatgttcagccttcaattttgatcgacgatagtcaaacacatcacgcgcaacactga

SEQ ID NO: 61979 - DNA, 74 bp, Heterodera glycines
  Genomic contig location: Contig_ID=SeqID_31662; Location=1..74; Strand=+
  SCN-specific regions: Sequence locations=1-74
gccgcgattgtgcgcgtaaaatctttgcgagtgagcacggcattgccggcttctacaagggcgggctcagcaat

SEQ ID NO: 61980 - DNA, 1178 bp, Heterodera glycines
  Genomic contig location: Contig_ID=SeqID_31663; Location=83..1260; Strand=+
  SCN-specific regions: Sequence locations=1-1178
atggcattgctttccgatcgtttcgacattttagtggacaaacattttgatggcaaaagcgaattgacaatttggagaacaatcgcaattcacccgggcattgaaatgccaaaactttttgtcgaaggcaaatttgtggcatttccgatgccggaccgtccgcttcccaacaaaatcctctttcataatcttgagattcggtcagtcttaacttttgtgcacattaaagcattttaatatttcttcaggtacattgatcattccgtcattgaatttctccatgccaacaagcaaatttgggacagaagtggcaccaatttggaagtgtttgtgtgttcaaacaacaaggaagatgagcagccaatttggaatgtttgggcccgtaaaatttggccaatttttgctaccaacgttcgacatttatgcattcctaatggtgctcatttggacaatttgcgtcgtctgatttcaccgacaattctcactgatcttgaccaactgaattcaatcgatgccggtcttctgttcccagatggaattgctgacgatggaccaaatgcaactgccgggcaagcgttgaccaaatggttacacacaccgagcaaaaatggacaaccgaacgaattgtatcgcgatgcttgtttgaatccacggaatctcgaatgggtcaacaatttcaaagaggtgtctcgccatgttttcgtcaaattgttttttttaccaatttttgtgtttagaaatttcgccatgccaccacttctgtcagttacacaattcaactttatactattgtggaaccaacgccaactgaacaatttgaattggtgaatggacggaccaatgagaagctgacactgaaacacagcaaagagtccattggatcagtgtataattggctgttgcaacggtgcccaattattggggagatggcgacgacggcggcagttaagtggaaaaaccgcgaaaattcgggtgccaatttgaacaatatcagatttgatctccggacttgcaattatttgtgtgccaatttgaacaatatccgatttgatttgtgggatggaattcattgcattgggtgagcagcaacagcaatttttgattgccgtaaagtaaaaaagtaaaatacttttaggccattgtcgtcaccagcagtggaagaagaagaattggattaa

SEQ ID NO: 61981 - DNA, 563 bp, Heterodera glycines
  Genomic contig location: Contig_ID=SeqID_31666; Location=441..1003; Strand=+
  SCN-specific regions: Sequence locations=1-52,74-170,195-442,465-563
atgtcggactccagtatggatgctatccgtgagttgcaacgagcgttgcgcgaacaacagagaacaatcttctttttgcgaagtcaaatggtggaccaccgtgcggtcatactccaaaatgttgcgcgcacggaagccctggagggctacgcggcgaacgtaattttcaaaccaaattttgaaatgaattttaatcagtcatatagttattaaagtataaatttaatttggaaacatttcagagtcgcgggggcagattccgcccccgctattctccaatggtttcgctggagatgactcatcttggacgacggctcgaagagcgagagcagcgctgtcgtgctcaggctgaaacggtggatgccccagctgcaacagagagcgctgaggagggaacatcttcgagcagtgctccttctaatggtccgttttaagacaaatatttttctaatttttaaaattttcaagtccaaggaacttccggtccgagtactggaatggtacctgtcaacgctgagttgccttcaaattgtgtgttttaagtaattattttaaattattta

SEQ ID NO: 61982 - DNA, 360 bp, Heterodera glycines
  Genomic contig location: Contig_ID=SeqID_31669; Location=298..657; Strand=+
  SCN-specific regions: Sequence locations=1-289,334-360
atgacacatgtgtttttcgatcccgagtcggtcgattggtcatcttttatcactccccagcatggaagaggacagaaacaatattttgtcggaagcaagtatcaacggggattcggtttcctcggtaatgtggcacgtttcttgacccctattgcgaggaatattgcctcgagtgcaggacatgaggggctcgccgctgggcagagagttctgagtgacatcgtccagggtcgtgatttaagggatgccgtcagggaacattcaagacaggggttgactaaccttaccgattaatattattttaatcattaaaaatattttagttatataaatgataaatcgaaatttattaatgctcta

SEQ ID NO: 61983 - DNA, 177 bp, Heterodera glycines
  Genomic contig location: Contig_ID=SeqID_31671; Location=1638..1814; Strand=+
  SCN-specific regions: Sequence locations=1-177
atggtcaccatttgtggcataatccgggaagagatggagctgatcagatggcttagtcagcgagtgacctgcatgatggaacatgcaaattttgttcccgattatcctcgctcattgttcaaaggagtgataaataagcaatttgtgcacgatttaattaaagacgaaaagggcatc

SEQ ID NO: 61984 - DNA, 1356 bp, Heterodera glycines
  Genomic contig location: Contig_ID=SeqID_6551; Location=1545..2900; Strand=-
  SCN-specific regions: Sequence locations=1-93,128-156,179-235,281 -289,327-477,511-1213,1236-1241,1264-1275,1299-1322,1344-1356
atgaaatttcagaacaataattctactgcttgtctcattaattatgcttcttgtcattatgattttgatggagtgagagaattaaatatttaaagaaattacctgtattttcttcaaaatgaaataagttattatataaatattgaaaaaattcgatttttctgaaaaataactatttaaattcgaggtggtggggattctaatagagtgggaggggggtggcttatacctgaggaaatatattataatttcttttatttaaaatcaataatgataatatcaatttagcataaaaatggctttttaatataaattttctgtccattgcatgagggccaaaagaagttgttcagctgttgctcgggaagaacgccaacaaaacgatcctgacaaagaagcaccaaatccgccatttttagagatatacattgatttaagaattttaagaaattttggaaagtttatcccttaattagaaaatttatatgcatatttttcttttatgtgcatattttgcgacttcagtgtcatttgtaactgttttcagttcgtctcttttttggcattgattttttgtcggagaaatataatttaaaatttcagttctttgtggtcagtagggtcaatcaactacgtttggtcaactctgtctcagcaatattcaaaaggcataactttttttgttgaccaaacctaacaaacttggtatcattttacagctttaaatgtttagaagatatttctaagctatttctaagtaatgaaacagttcacaaacatctatcgcttgaaaacctcaaaaaagcataattttctaaaattttttatctctatattttttttttgcagttcgacatttctgtaattattattcggctaaaaaagcctgttatgagctttcgaataatatcaatattgttagattctgttaacaatttaaaaagttatattgactcaaagtttgctcagacggagttggcccgttccgctttggatggttttaaaaatgcaccaaaactttaattttcttacattaactttattttattgtagttcaattataaatttttttcttctttttttcaacaaattccaattacaatattcacattaattcgtcaaattgagtaattagcagaatcttcttaagctgactataattttcgaaatttgtaactaaaaatttagcggctgaaattccaaaatttggacattttaggacaaatctgttagcaagtccacgcaaaattttcaaaattgacacaaattagcaattttttggacaatagttaattagcggcaactcattttaatattagtcaatagaataattaataacacatcatattcaataaa

SEQ ID NO: 61985 - DNA, 658 bp, Heterodera glycines
  Genomic contig location: Contig_ID=SeqID_31673; Location=151..808; Strand=-
  SCN-specific regions: Sequence locations=1-70,92-442,469-506,625-658
atgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgatttttttttttgcgtaaatacacttggtttttccaatttttagcacatatttttgcattttttaacacatatttaggccttttttttggtttttagcacatattttgggttttttagcacatattttattacatatttcaggatttttagcacataaaaatcccagccctagtaatagtacactatgtattcgtggttaatattttcgtcagtaagcattttcgtcagtgaacgatttcgtcagtgattttcgtcagcggataatttcgtcagtgaacattttcgtcagtgtactatttttatttattttgctgttttccatttttttcgtcagtgttccaattcgtcagtgaacattttcgtcagtggatgcataaaattaaaaatttttcatttttatcaacttctttaatacagtatttatcgctttttgcgtatggtaactctagataaaataagtgattatttgtactttaataaa

SEQ ID NO: 61986 - DNA, 498 bp, Heterodera glycines
  Genomic contig location: Contig_ID=SeqID_31674; Location=1..498; Strand=-
  SCN-specific regions: Sequence locations=1-498
  Gene Ontology: Mol. function=phosphorylase kinase activity; Cellular component=phosphorylase kinase complex; Biological process=glycogen catabolism
ttcaggcgttcgacttgaccaacttatggtcctcgttcagaagacaattttgttctgtcaaggttatttgcgactgtgtgattagtgggattgagtgatttagatccggttactggtctttttgtcaacaatcccgaacaatacccttgtgagttgcccactgaatgtcgaaatgtttaacgttttcctagcgcatgcgtgggtccgtgacaatgtttacgcggtccaagcggtttgggcaatgcatcgggcgtaccaaaaacgggcagagtttgacgaagatttggtcaaagcgcacgaattgggtctcaatctgtgtgaaatgtatgcagtcgctggtgacttataacgataatgtttcggggatgaaatgttctgacataagttggaatgtatgctgagacaggccgacaaagtggagttgtttaaaaggcaacagaagaaatcggactgtctgcacgctaaatattcggcgaaaaacaaggcgactgttgttgc

SEQ ID NO: 61987 - DNA, 428 bp, Heterodera glycines
  Genomic contig location: Contig_ID=SeqID_31678; Location=112..539; Strand=-
  SCN-specific regions: Sequence locations=1-66,88-235,319-428
aaatgtccgagttcaatctggtggacccggcctggaattgacggattcaaacccgacgtactcgcacttttccgggtgtatgatcaacgatacttccaaggacgattgacccaaagctgcgtcatcattaaccggagcaacaagcttttacggtattttccctttttgattgggacattaacgtaattgcaaaagtgacgattttgagacaattaaattttcattttttaccgccaaaaaaattattatttttttggctttaattttatgaaaattattattttctcaaataatatttgtgaaaaaaatatatttatagttgcgttggcgtcacttataattcaacagaaacaagactcatgacgattcgattgtgtgtgccaattctcaaatttcgcacaaggcgaaacagaatcgagacacttctc

SEQ ID NO: 61988 - DNA, 569 bp, Heterodera glycines
  Genomic contig location: Contig_ID=SeqID_6553; Location=1901..2469; Strand=-
  SCN-specific regions: Sequence locations=1-530,552-569
atgaacatcaaatacggtcattttaatgcgtaattcttaacaaatttttagacaccaactaaaaaaaaacatttggcgttgaatccaaaactttaaatacctttttacatgctaaaagttgttctaaatcgaaaactgctccgagaaaacgggaatcccgttcccgtttctctttttatcttgacaaggttttaacgggaacgggaaaaaagggaatcccgttcgggaatcccgtcccgctttttttcattttcccgcttccggaatttcttttacccaactctattctaaataaacatatgaaaaagttaatccggcccctcatgataaaatttatttataaaagatataaagtaattacgttcatttgtcaggtgtttacctggtgaatggcgataaaatgctttttgcacatttggaaaaacaatggggcgacgaggtcaaaatggacaaattggtggacgcagtttcaaagatttaatctcgattgtcactgatgacacacacacacacactattgcctttttggctttttctgattgtttgttctttatctcaatatcaataaa

SEQ ID NO: 61989 - DNA, 1577 bp, Heterodera glycines
  Genomic contig location: Contig_ID=SeqID_6554; Location=1735..3311; Strand=-
  SCN-specific regions: Sequence locations=1-196,218-451,495-891,926 -970,993-995,1041-1577
tcctccttcgatttctgccgtttccatgccctgcatttcctgctgttgctgggtttgaatttggctgcgatgacgaggactgtcgttcccttcgtcttttagtaaaattccattccgaaaagacggaaattgcaccgaattactcgccgactcatccaccggtaaatctaaggagaaaagccaacggatttaattgtaagcaacgaacagaaagcagtgcctgaacagctcatcgaagtggttgacggagacactgcgacatcgacacgggacaatttgaggtcgtagggagagggggcaggccccgccggaagaatgaggcgaagatggaccttgaaaagaacaaattcggggaaaggacaaaaaaacgtagtgcgacattttcggaccgacatttgcggaccgacatttgcgggacttttgcggaccactatttctgggttgaactgtcaaaaaaaaaacaaaaaacaaaaaaaaataatttttcaaaaattgagtgactaagtagttttatttgtgatttttaccaagttgaacatcgcccttcaagagtaatcgatcaactttttgcaatcaacatcgaaagaacccattttttaaagaagtttagtttccatagataaatatagtatgtagttgctcatttttaattttgggcccatagttttaataacatcaaattacggacaatttttgataaaaagataaactattttagtttttgtttgttaatttaattggtttgacatgccggaaaaaattaagctctcggttaactaaagcgtggaagtgaaacaagataaaaaattttcttggtataaaattcttgaactgacttttatatttaatttagctaattttttcgccaatttcacagtttaattataagttagaaattctataaaaaagaaagaaatagttatgtcaaataagacttctctccaattgagacagatcgctttgcatcagcttaccttcactaatttcaatttgggaatattaaatttattaaaatttcttattatttttttctttatttagacagttcaaccgagaaatagtggtccacaaaagtcggtccgcaaatgtcggtccgcaaaagtcggtccgcaaaagtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggctaaccaaaaaaatataataaatttcagggttttgatcagtatttggataaaagtcaggaaattaaaaatggatattaa

SEQ ID NO: 61990 - DNA, 1473 bp, Heterodera glycines
  Genomic contig location: Contig_ID=SeqID_31682; Location=1..1473; Strand=+
  SCN-specific regions: Sequence locations=1-1473
  Gene Ontology: Cellular component=nucleus
agttggcatgtcgtcttgctgtgaagacatttttagctcgcgagttaagctgcggcgactcatcatatcaattggtgttgatcttcgaactttttgcatggcaaatggaaaagcaaagtgccgacaaatggtaatggacacactgggacggcactcagacaatgaaagagcattctcgacgaagaggtgtaaattgctttttgcgtatttaaacaattcttaatgttaataaacccaaacttatttcagtcggatttgctgctgaaggacggcgtttcctcggagagtctttctccggcagagtcttccgcttctcttctgccgcgttatgtgcgcgtgaacaccgtcagaatggccttcacacaagcagttgaactgcttgaacgggacgggtggtgcctttgtcgtttgaagaagcgcattacgccaagcaaatatcgaagattggtgtcaacattggagtcgcctaaaatttacgtggacccgcacatttacgacttgttgatattcccacggggggtggatttgcacaacaacaaattggtcaccgatggaattttggtcctccaagacaaagtatcccactaaaatgttggcacttttcatttgtctgttttccctaggcaagttgtctctccgcctttgtgcttcagcctgagcccggcgcatcggcgatggatgtttgcgcagcgcccggcatgaaaacgactcatttggctgccttaatgcacaaccgcgggtcactttttgatgcacttaagtggacacatttgtttcacattttcagaacgatatgggctttcgatcgcgatcagaaaagggtggcagtgctacgacaaatggtcaagcgaagtggcgcagggattgtgacggcgcaatgtgcggatttcttacgggtcaatttgcttgacgggcgatataaaaaggtattgcatcgatttttacaaagacaggaattttacgccctttttaggtgagatttgttgttgtggatccgccatgttccggctcgggaatggcaaagcggagcgagcatttggacgaatttgaagagcccgatgagcagcgtataaaggcactggccaaccttcaggtaaagccaactgcaaattgggattttgcttttcaatttcgacccgtttcctgagggttcgcgcctcacctcatacttttctttctttttgggtaatgcttcttcggcacgccttccgtctcccctctctgcagcgtctcgtctactccacttgctctgtgcattgggccgaaaatgagggagtcatttcggagattttgtcctcttcaccactcagtgagcatttctcgctggtcgaccctttgcctcaatggcgccaccggggacaattgggccaaagtgggaacgccgaactccgcaaatgtttgagggcgtcaccaaagagggatttgaccaacggattttttgttgcattgtttcaacggagaaattcataaaca

SEQ ID NO: 61991 - DNA, 104 bp, Heterodera glycines
  Genomic contig location: Contig_ID=SeqID_31682; Location=1643..1746; Strand=+
  SCN-specific regions: Sequence locations=1-104
gtgacaaggtgatatgttgtcaaagtgtctccgctcgtcaatttttggctgctttaattgtgcgctccaaaatgtgtcttctgctggcgttttaatgaattcgg

SEQ ID NO: 61992 - DNA, 920 bp, Heterodera glycines
  Genomic contig location: Contig_ID=SeqID_31683; Location=192..1111; Strand=-
  SCN-specific regions: Sequence locations=1-20,42-275,297-552,574 -807,829-920
atgccaaaacaaaacgaaatcgttttaaaatattcctttctggacttgacttggtttcttgatatcgaagctcttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgcgataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 61993 - DNA, 465 bp, Heterodera glycines
  Genomic contig location: Contig_ID=SeqID_31684; Location=115..579; Strand=-
  SCN-specific regions: Sequence locations=1-74,96-145,167-465
atccgaattccgtcgacaatcggcgtctgtacgttctgaaaaagtccgagtcgccacaatgggaggatttgggctgggcctggggaaaacgttcacttccaaattcggaaaagtcggcacagagcagcgcaaattgggacgatttgggctgggcgtggggaaagcgatcgtcggccggcggaggaggcgaagcgatgaggagggcaaaagcgcacgggactgacccaattttggtgagacctttgggggagggagggcaaagcaccgggaagggggacgaaataaaaagggggagggcattcagatgaatgacacgcgggggggcacttattaaacccattaaaagaagagggacaaaaagccatcgcaacaatttcagtcggtagtcgccaatcgggttgttcgttcgatgagcaaacagagcccggactggcacgacttgggctgggctttgggacggaggaa

SEQ ID NO: 61994 - DNA, 496 bp, Heterodera glycines
  Genomic contig location: Contig_ID=SeqID_31685; Location=536..1031; Strand=+
  SCN-specific regions: Sequence locations=1-105,128-305,344-352,374-496
tctgataaaagttccttccgtgcttttctctgatgagcagaaaccaaaccaagcaccccaaagtgaataattaaatgcacaaaacaaatggattaataaggatgcaattaattatttataaataattcgggcagccaaatggacaaaaacggggggggggggggggaattagacaaattaagcaaaaagcgactgatatttgcatggactgacaaatgagtgcggtaaatgggcgagaaaggaatgacggatggatgataataaacaaattggcattcactgaaacattccattcattcgtcagcatttaaaaatgtttttatttaatttaatttataattaacaggcgcaatttattatttgattttattaagaacaaaacaaaaaaacatgctgagtaaagcgcgcatcattgtggaacagagcagttcaaaatttttgtcattttatttataaaatgccacttatgtttctacctctttttaggcaactcctt

SEQ ID NO: 61995 - DNA, 810 bp, Heterodera glycines
  Genomic contig location: Contig_ID=SeqID_31686; Location=399..1208; Strand=+
  SCN-specific regions: Sequence locations=1-810
atgctctatttgaatgcccactttctaatcactgttgtacctcttttaatcacttttgtacctcttctaatcactgttgtacctcttctaatctctgttgtacctcttctaatcgctgttgtacctcttctaatcactgttgaacctcttctaatcactcttctaatcgctgttgtacctctcctaatcactgttgtacctctttttatcacagttgtacctcttctaatcactcttctaatcgctgttgtacctcttctatttactgttgtacctcttctaatcactgttgtacctcttctaatcactgttgtacctcttttaatcactcttctaatcactgttgtacctctcctaatcactgttgtacctctttttatcacagttgtacctcttctaatcgctgttgtacctcttctaatcactgttgtacctcttctaatcgctgttgaacctcttctaatcactgttgtacctcttctaatcgctgttgaacctcttctaatcgctgttgtacctcttctaatcactgttgaacctcttttaatcactcttctaatcactgttgtacctcttctaatcactgttgtacctcttctaatcgctgttgtacctcttctaatcactgttgtacctcttctaatcgctgttgtacctcttctaatcactgttgaacctcttctaatcgctgttgaacctcttctaatcgctgttgtacctcttctaatcactgttgaacctcttttaatcactcttctaatcactgttgtacctcttctaatcactgttgtacctcttctaatcgctgtt

SEQ ID NO: 61996 - DNA, 438 bp, Heterodera glycines
  Genomic contig location: Contig_ID=SeqID_31688; Location=750..1187; Strand=+
  SCN-specific regions: Sequence locations=1-222,244-438
atgactgccaattatttgggcacattttgcggtggcggcggtggcaccactgagacgacaacggcacaactcaaagtgctgaagaaaaagtggcggaagaagaagaaaaacaaaagtgccagcggtggtgccaaaaagagcggcaaaaacaaaaatattggcattttgtcctcgtcatcgtcgtcggtggagcagcagccggaagagaacggcaccgtcacaacgccacagcagcaacgacacatggcggcagcatcatttgaaatgacagtgactgctaccacggctggtaacactgctgatacggtagtgggggtgcccaaaacgacaccgccagtgttggcaacgtctgagagtgtgccatcgtcgtctgccgcctcggcaacaaaagcgtccgctcccgcaggtggcgatgcctcttttgaacgtgccgacaaa

SEQ ID NO: 61997 - DNA, 427 bp, Heterodera glycines
  Genomic contig location: Contig_ID=SeqID_31689; Location=42..468; Strand=-
  SCN-specific regions: Sequence locations=1-427
atgatgaatcgtaaaaaaattgaaaatcttcaaaaatgtcgtaagcgcaagtttttggataacaatgacagtgaaaacgaaacgctatctgctgatcaccgtgaacaaaatgagaacaacaacgaccgcgacgatgattttgaagaacacgccatcgtaaacttcgaacttggagaaacgaaaagaggaggtgtctgcatttggtttaatggtgagaaaaaattttttcaagaaatattttcgtttttaagggttccgatttacgcacaaacaaaatgagttgtggagatgcagtgtgcgtgactgccctgcacgcgtgacaatcaccgacaaaagcgacaatggaatggccggatatttcggacaaaaagtccataatcacctcccagagccacaaaaacaacgggtttcggacaatcattgctaa

SEQ ID NO: 61998 - DNA, 810 bp, Heterodera glycines
  Genomic contig location: Contig_ID=SeqID_31691; Location=856..1665; Strand=+
  SCN-specific regions: Sequence locations=1-810
atgccgaaaggacgatcatcacattggcttatgtgctggaagaaccaaccgggaaaccaatcccggccctccggtgaacccgaacggaaggagaacaaccacgcgatgctgatcagtgggatggaccaacccactcacgttactacatcacgagacgagccgaacagtcgagacatatccgagacgaatgccggggagcaacgggctttcaccgcttttggaagccgagtcccggcccagcaaatgatccgaagagtgaccgcagcagcagaagaaggcgaagacgaatgccaaacaacattgttgtttgatccaggaagccaccttgactgcgccgagactgagctaattcaacatctcggaccgcaacccatcgacaagcggccgcttacagttcaagtgttcggaggaaagaagcagcggattcggtcagcaacttatcgcctacgactcaaacggaccgacggcaaatgggagagcattgaggtgtctgaagtacctcagatctgtacgctaatcagaacagaactcatcgagtcgggagcaacacccgatagcgacccgcgaaccatcacacagacaacgcaacctcaaataatgatcggcattcgaaagttctgggattacgtggtcggatttcggaaaatcgagagtggcgcgcatgtgattgacaccgtgtttggacaagttttgtgcggcgaaggcacccaagcgagcagcggggcaactcccgcggcatcaatcctaacaaccatgcaatgcggaaatatccaccaaactcgaacaaataaacaacaacaaatcggagaa

SEQ ID NO: 61999 - DNA, 1389 bp, Heterodera glycines
  Genomic contig location: Contig_ID=SeqID_6556; Location=732..2120; Strand=+
  SCN-specific regions: Sequence locations=1-257,287-1389
atgctcaagctgttcccgcgcggccactctgtttcatcgtcgctgctaattgcgctgctggaggacggagacgaacaaagtgataattcatccgctgttgatggtgggtttaattgccgggaaggactgtcccctctttcgttgtcctctttttctgacaccgatgattctccggacgagttcatcgtctgattgtgcccctcttgcgtcgttctgctgctgcctcttccgacatgtcccccaactcggcgctgtctcccgccccctcctcttcttcctctgcttcgctgttggcgtcgtactgctcgccctcccttcccttccatttgctcagtttcagaggtcacatcgtttcccatcgccactgtttccaaagtgatgggtccgcctctgctccgtcttgccatgcctcctccccctctcctgcggctcccaattgttgttgctctgccggtggtgctcaatctcagcgccggtgcgtcgttgtcatcattgattttgtcggcagatgccgttgtttggagtgatgaaagacgccctccgccaccacgcggatgacccgccctccgccctctacgaacaggcgaaaaaagcactcttcttccactgctggcccctggtgggtcatccgccgcctctgccagtccaattgcggacgacagggatgacaattcagaagatgatgagccaatgctgctgttgctgtcgtctctcgctggccttctcgccgttcgttttgctgtggtggttgtgttgcagttactcgtcggccttcccgttgtcctttcttcaatgaccgacgaatgctttcttccgttcagaaactcattttgtgttgttgcagtgcttttcggcaacagcgatttcttccttgtgcttttcctcaattggagctgttgagttgtgtcaacggatcgtcgaatgccgacgagtcgtcgcgggcgttccattccattcggcacgggccgtttccgttcgccggaaggcggcttgaactcgtcgagctcatcactcacagtctctgctgatgagtcagtgcttatgaagtcgttggaattgtccagtgtttccacttaatttcattaattttttatttttgtaaacaagttttgtagaccttaaaaattagcgataatttgaagaaaaaacactttgccaaaattttgtttttttgagcaaaaaatttatttgaatttttttgttcttttttcgctgctggtggtggtttacctatatacgactgctcgccctggacctggatccaaaactgggttttcctggatccagcaggtccaagccatttttggcaacctggatttcctggaatatatttagaattggtttttcaagcgaccattgttttatttcaagttatcaaaaaatgattaa

SEQ ID NO: 62000 - DNA, 549 bp, Heterodera glycines
  Genomic contig location: Contig_ID=SeqID_31692; Location=283..831; Strand=+
  SCN-specific regions: Sequence locations=1-19,41-287,313-549
atgaaaaattcaggttgtcgaaaaacagtctggacctggacctggatgaaaaaaaatctaggccaggatctcggtcaaggtgagctcaactttttacagaaattttaaatcagatgaaaatttcaactgaaaagctatgctaaaaaatgaagttataaaatgaaaatcgaattgcaatcggattttaattggaaaaacaaaaacctcaaaaaatcgactttcaactttttctgaattttttcatcacttttattttataaaacacaaatatgtattaatgttatgccatataatttattttaaattaattttctattctcaagtttcgcgtttcatttcttattatttggattatgtccttggatttcaggacgtccttaggcataaacttgcagccttcggatggataaagatcggatttaagaaaattatgattttgaacatggataatttccactgacaataattcttggtacatggtgctgttttacataactgaaattcagtaccgatttttacaaaaatttcctctcaggcatatttctccta

SEQ ID NO: 62001 - DNA, 777 bp, Heterodera glycines
  misc_feature (527)..(527): n is a, c, g, or t
  Genomic contig location: Contig_ID=SeqID_31693; Location=501..1277; Strand=-
  SCN-specific regions: Sequence locations=1-310,340-494,532-604,633-777
atgagtgaattaagcggacaacaatttccccaaaatgttggcatttctgttcaaccaaaagcccgagtggaagtcgaagaacaaaattcacagcaaaatgatgttgttgtaagtgaatgaaaatggacgggaatttgctgacgaaacgaatttcagaaaattagattttctgcagtttctacaatcaattaaatagaattattacatttgtattttaatttgtctgactcttttcaattttattcgtttatgccattcccgaagttgtccctttgtccgggagccgagattagtccgggaattgattggcttttaattttttttgtattttaattttaaggcacaaaaacaaaacttttcggccgaccaattggacaaattggaacgcaaatttggcataacgaaatacccaagtgctgcttcgcgtgtacagttggccatggaaactggaattatggagaagcaagtccaagtagggggcactaatttcattgaaaaaaatattaaaaatttatttttaattattntaaacaacaattttcatttaggaatggttccaagaacgacaattacaacggaaacgaaaaacaatgtgggctttggctaaatattttttttaattttttaattttcaacgaatttaagccttgaacatttttttttcaaaaatttagggaccaacaaaacccacaattgccacacatttatgacaaaattatggctgttgtgcaaaaaactgttgatgacgaagtaattgcactacaaaatgatgacgat

SEQ ID NO: 62002 - DNA, 932 bp, Heterodera glycines
  Genomic contig location: Contig_ID=SeqID_31694; Location=49..980; Strand=-
  SCN-specific regions: Sequence locations=1-282,316-328,364-546,636 -653,700-707,729-932
ttatttacgtggctgttgaagcaatgtattattgtactcgtaagtctgtgaatttatttaactatggacaaagtgacgagattttacgggtgaaaaaaaattcagtccaaattaccaatgttttaaaacaataaatttgtcaaaaactttaaaaaatttaaaggttgggcgttgctaaaagaatattgtaatagagatcggaattttgaaaaatgccgaaaaatgaagaggattggaaaatgatggacaggaaacaagcggaaaaattgaaaaattgctggatttcttttccagtaattttccaccaaaaatgcaacaacattaagccattaatatatttaaaaatattatatatgttttttagactttgtctatgagtcgggacagaatctttgccctccgacggatccgccgctcacttattacgcttcggtgcacttgtgctgcaaggaggactcggaatttggcacggcattaatttacaggacgttcgcaacggaaccgccaacaacttttccgcaggggtgccggggtaagaaatttgaaaaattaaatcaaattaaaaaaattataaatttaaattaattttaagaaaattaaaaaaataaaattaaacaataaatttacattcaatttatgataacttcataaattaattttggccaattaaaatttattgtaaaacttttttaaggatgaggatgaaattttagtcttttaaattatttttaatcactaaaaagttttccatgaaaactttttaattctttcccattttttgaaaaataaatttcaaatccatttattaattacattaaaatgtttctgtgaatttagctgctttgcatgaagcagcaattggccaatatgtttgcaaaagtggcgaggacgcgtacagcaattgggacgccacttttgctgatgtgatcccc

SEQ ID NO: 62003 - DNA, 905 bp, Heterodera glycines
  Genomic contig location: Contig_ID=SeqID_31698; Location=45..949; Strand=+
  SCN-specific regions: Sequence locations=1-182,223-630,654-748,795-905
atggaaattgaaaaagggtcggaatttgcgggagagtctgtcgggagaagcagattcagtgatgccgtgtatataaatggatttccatgggaaattgaagcagaaataagaaaaaagaccgaagacactgatgagaagaaatatttggggttttacttattgtgcgatgcaaaagaaggtacaattttaataaatattaaaaatataatcattattaaaataggaggaccatggaactgcgttttttctgcaacctttcgaattgtgtcagaaaagaccgaagcggagaattccattgggacattgtgtgactgtgttattaaccagtcacgtttctgttggggattcggatttttcattacttttgctgtgagtaataatttaacatatttacttaattgatataattatggttaatcaaggaattgatgggctcgaacaagagcttttacaacaaagcagaggacaaattggcattggccattgatgtcataactgttgatgagccaaaaattgagaaattcgtttccgatcccaacaaatccaacggcacactttcaatggaaattgaaaaagtgtcggaatttgcgcgtgaaataattggaagtgaacgtaaaagtgaaactgtgcacatcaaaggattgccatggaaaatatgggcaggaattattacgaaaaatggaagcactgacaaaaatgagaaatggttgggcattttctttttgtgcgatgctccaaaagaaggtgcaaaattactaataattaatatatatattaacaacaattaattaattgatattgagcagaaaattggagttgcaaatgttcggcaaactttcgaattgtctctctaaagagcggagtgtcggattttaaattagaattaaatgacgatgtttttgaca

SEQ ID NO: 62004 - DNA, 503 bp, Heterodera glycines
  Genomic contig location: Contig_ID=SeqID_31699; Location=468..970; Strand=-
  SCN-specific regions: Sequence locations=1-107,134-217,239-263,292-503
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaa

SEQ ID NO: 62005 - DNA, 733 bp, Heterodera glycines
  Genomic contig location: Contig_ID=SeqID_6559; Location=6..738; Strand=+
  SCN-specific regions: Sequence locations=1-206,229-237,259-290,314 -561,585-733
atgccaattgtcacgccgggacacattgaacaaaatgccgctttcaatgtgaaccgatcaaccgcaacaatcattcggcgagaaatgcaaaacggtgccatttaaagggaaataaactaattagtgaattaaaaagtggtgtcatcattaattgaatatttttagcaattaaaattgtacgaaattggccaaatctgagcatttcattgaatgaaaaatggaaaagcttaataaaggctaaacagttcaatgaaaaggtgatcatcaataatagttatttaaattggttatcaaatttcaaaattttcccacagttttcccatttcattcgcattatttgcaaagccttcgcattggccgacttttacgacttttgtggctacgtggagacgcgaatccgtctccaattgattattaatgtcgtgccattcgatcgcgttcgattggcacatgcgaaaaaagttgcggaaaaggagcaagaaaattttggcgaaaggaataacaaaaagtgatgcgtttgctttttggcaatttaataattagtcactccaatttcggggaaaggtcctaatttgataattaagaaacaaattaccttgtaggaaactatcacaactagggcttatatttttagttttttcactatttttttcctgtgcttcctatggtctgaaacgcatgaaaaactttttttgggtttttgttaagctagtttttattttttcacctaaaa

SEQ ID NO: 62006 - DNA, 941 bp, Heterodera glycines
  Genomic contig location: Contig_ID=SeqID_6560; Location=890..1830; Strand=-
  SCN-specific regions: Sequence locations=1-250,272-675,700-941
  Gene Ontology: Mol. function=fucosyltransferase activity; Cellular component=membrane fraction; Biological process=carbohydrate metabolism
atgctggaaaacagtgagagtttttgaaatagttcagtgtcgaaatttctctatgtcgaaaacgtagtgtcgaaattacttagtgtcgaaaatactcagtgtcgaatttaccagccaccgactgatcggagggggacacagaagtgattagcaaaagagtggtaattggtgtccaattcaagatcgaaacgcgcgttcgccagaagagcaaattagtcttgcaaattgtgtccaaatgcggcgcctcctcagccagggacattctcacagcgcaattgggccaactggtgcccgtcgatgtgtttggtgcgtgcagtgggaaggagtgtgatgaacagtgctacaggcaggaaatgggtaattaagcaattggttactaccccaattaacgacaattaacaaatattgaaaaaactaataattacccatttaaatcatcttttagcatcgcatttcttctatttggcatttgaaaattcggtgtgccctcaatatgtgactgagaagttttggaacgctttccgcgcactgactgtgccggtggtgctgcgccgggcggtgctccgcggaatgggcgtgccggacgacgcttacatcgcagccgacgacttttgcagtgcgcaagaattggcacaacatttgttgacactccgacatgacactgaccgatacatgcagtgaattttttaattacattttgtcaatccgccgagggaacaattggcctaattaattggtcaattaacagattcttcaattggacacggaagtacagcaaaaagaagagaaagtcgctactttctccaatttgccaactctgtaaaatcgcacaaaaatatccaaggccaaaatatgcaatcgacaagagaaatttttggactgaagcacaatgtaaatacaattttgttgaaaaagatctcttcaactgttcacaaaataaa

SEQ ID NO: 62007 - DNA, 558 bp, Heterodera glycines
  Genomic contig location: Contig_ID=SeqID_31702; Location=427..984; Strand=+
  SCN-specific regions: Sequence locations=1-20,89-107,155-172,379 -420,455-489
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactcc

SEQ ID NO: 62008 - DNA, 425 bp, Heterodera glycines
  Genomic contig location: Contig_ID=SeqID_31705; Location=137..561; Strand=-
  SCN-specific regions: Sequence locations=1-91,113-425
atgataaatgctagtccgtatagtattgctgttcataaggacaataaccaccctttttcgaacattcctaagagcggacgatttcgtaaaaatcttttctcttttctgatccgtgatggtgattatcgtctttcgtgggatttttttaaacatgcttcaagacgaattcactgcccggttaccaaattttaccgatacattaacggactggtacaaattgtatctacggataagaaaaaaccgcgtattttcatctatttctatcaggaaggggaaggaaaatttcgagctccttcttcttatcaagggtggcttatgaggtgtgaaatagactttgacgagattattacgacttatttggtcaaaggtagattgtcgtcgtttgctcaaataatcattgaatcgtttatttgtctatttgaaag

SEQ ID NO: 62009 - DNA, 360 bp, Heterodera glycines
  Genomic contig location: Contig_ID=SeqID_31705; Location=749..1108; Strand=-
  SCN-specific regions: Sequence locations=1-257,280-287,316-360
atgtttcagttctatctaagccctctgtaccgtgttaaactacggtccaaaacgattgtaaatttgttcagtattcgtgaatggctagtttcgccggtcatcctaattgtttatggcttctttagcattgtcgaccggtaggtttcgggtttaaggtgtaataaattaatattttcagtgaaatgcaagaagcgtggaaacttctcaacataggcctcccttcgctaaaggatatatgcaccaaaagcatttctgagaatgagaaagctttggaagaatttcgatcgttcccatttgtttttaaaaaattatttacacgtttttaataaaaaaatgattatgttttaaacttctaataaa

SEQ ID NO: 62010 - DNA, 807 bp, Heterodera glycines
  Genomic contig location: Contig_ID=SeqID_31706; Location=7..813; Strand=+
  SCN-specific regions: Sequence locations=1-583,606-807
agtcctcaacccaccaacatttcaatcactgggcactcaacccaccaacattctcaatcactgggactcaacccaccaacatttcaatcactgggactcaacccaccaacatttcaatcactggtactcaacccaagagcattacaatcactggcactcaacccaccaacatttcaatcactggtactcaacccaccagcattacaatcactgggactcaacccaccaacatttcaatcactgggactcaacccaccaacatttcaatcactgggactcaacccaccaacatttcaatcactggcactcaacccaccaacatttcaatcactgggactcaacccaccagcattacaatcactgggactcaacccaacagcattccaatcactgggactcaacccaccaacatttcaatcactgggactcaacccaccaacatttcaatcactgggactcaacccaccaacatttcaatcactgggactcaacccaccagcattacaatcactgggactcaacccaccaacatttcaatcactgggactcaacccaccagcatttcaatcactggaactcaaccccaccagcattccaatcactggggactcaacccaccagcatttcaatcactggggactcaacccaccaacatttcaatcactggcactcaacccaccagaattcaatcactgggactcaaaccaccaacatttcaatcactggaactcaacccaaaatattttcaatcactgggactccacccaccagaattcaatcagtgcgactcaaccccacagcatttaa

SEQ ID NO: 62011 - DNA, 430 bp, Heterodera glycines
  Genomic contig location: Contig_ID=SeqID_31708; Location=983..1412; Strand=+
  SCN-specific regions: Sequence locations=1-102,330-430
atggcacgacaaatatttggcggacatggaaaaggtgttgggacagaagcgagctcagccgcgaaatctattgacagagcaaaagtataaaagtctaatggaaaaagtgaaggtaaagaaagaaaagggaaaagcaaaaaaaggaaataaataaaaatataaataatttagagacaaaaaattaataaagcataaaaacaaaatgaaaatttaaaaggcaaaaaatagaattgaaaaagggacaaaaaataaataattagaataatcaaaaggaaataaataaaggaatttaaatattaatcaaaaaataataaaaacaataaaattaattaaaattttagttggccgaaagcattcgaagaatgaatggccaagtgccgaagaagcatttaaatggaataatgaaaaagtacagaatttggaaaaataa

SEQ ID NO: 62012 - DNA, 149 bp, Heterodera glycines
  Genomic contig location: Contig_ID=SeqID_31710; Location=1007..1155; Strand=+
  SCN-specific regions: Sequence locations=1-149
gtgcatattcgatattcagttattgcaaattgttactcaaaatggcctcttttctccgttttttggcctgccgtcacttttctatgtcgtccgttttgcgcaaagaggcggaacaacttaccaatgaacacatcgacaaaattcggcag

SEQ ID NO: 62013 - DNA, 729 bp, Heterodera glycines
  Genomic contig location: Contig_ID=SeqID_31711; Location=49..777; Strand=-
  SCN-specific regions: Sequence locations=1-729
atgattatggactggaatggtctagaacatgtcggtatgtctgatctcaattcagataagcaaaacgtgagacaaagaatgattgataaaatatcattcaatggggataggtatcaaacggaattgttatgggatgaagaattggctgctcaattgccaacaaattatgatatggcttttagacagttaatgtcaaatttgggcagacttagaaaaacaccggatttgcttcgacaaatccatgaaatcaaaatggaacaagtcgaaaccgggtttattgaagaatgtgagccattacctattgaagaaaggtatttggttggaaataaagttcattatttaccacatcacccagtggtaaaggaaacgagtgaacatactaaggttcgaattgtgtataatgcgtccgctagatgcagaggaggtctcaccctcagccaagtgttagaaaagggagaaaatgactataacgatttggcaggtatattaattcgaattcgaattaagccaatgctgttgacttgtgacatcgctaaggcatttcatcaaattttggtacatccaaaagacagagatgcgatgcgatttttgtgggtcagagacccatatgtagaagattctcccctcgtggagtatcggtttacgagagtcacgtttggagtcatttgttcgccagctcatctctctttgacaatcaaacttcatttgtccaaatacaaggacaaaaaa

SEQ ID NO: 62014 - DNA, 377 bp, Heterodera glycines
  Genomic contig location: Contig_ID=SeqID_6563; Location=2056..2432; Strand=+
  SCN-specific regions: Sequence locations=1-1,23-179,201-377
atggaccaaatgtgagaaaagcggaaatttttttttgtttttgaaaatttaatttgttttgttttagcggcggcactttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtcgccattcaatttttga

SEQ ID NO: 62015 - DNA, 507 bp, Heterodera glycines
  Genomic contig location: Contig_ID=SeqID_6564; Location=178..684; Strand=+
  SCN-specific regions: Sequence locations=1-249,271-507
atggcattccgaggccccaaaaattttcggaaatcggaattccgaggcccaaaaatttttcggaagtcggaaatcggaattccgtgccatccctggtatacactagcaggattagggctcgtttcggcgccaagccaaaaacttgaaaaatcaaacgaaccagaaatgttcgtatctgatttacctcacagttcgaccgacacgatttagccttcacgtttgggccccgcatgtttttttagctacaacttttttctttgccaaccaaatccaacactgttggtatcattcgatagcccttcagatgctctattagcctgcaaaatttcaataaatttcgtcagttttgaacaaatttatggccagaaaggttagaaaatttggttttttgaattcttctggccataacgtttttgaacttaaacaaaattttgaaaaatttttaggctaattgatgacaatcaggtctatcgaatgataccaacaaaatgctgatttggttgacaa

SEQ ID NO: 62016 - DNA, 639 bp, Heterodera glycines
  Genomic contig location: Contig_ID=SeqID_6564; Location=443..1081; Strand=-
  SCN-specific regions: Sequence locations=1-79,113-639
atggtcaacttttgtgttatctatcgagcatttctcgtgttcggctcacaatcagtgatcattcttttgttcatcagggtaattaattaattaattaattgagcaattagtttttgattgttggcactttttcactctccagggccttttggaaggtcatttcaatgcaaaaacaatggacgactatttggagaatggcaagcaaattgagaccaattcgtacttgttgaccactcatttgtcacttcgaaagatgaccattcaattgctgacagtgggagaacattttggatacaaattttaatgtgaagaattaagaaactgacgaaactcataattttgactgttaaatttaatatgagttatctccgggttttttttactgtaacttttttatttgtcaaccaaatcagcattttgttggtatcattcgatagacctgattgtcatcaattagcctaaaaatttttcaaaattttgtttaagttcaaaaacgttatggccagaagaattcaaaaaaccaaattttctaacctttctggccataaatttgttcaaaactgacgaaatttattgaaattttgcaggctaatagagcatctgaagggctatcgaatgataccaacagtgttggatttg

SEQ ID NO: 62017 - DNA, 533 bp, Heterodera glycines
  Genomic contig location: Contig_ID=SeqID_31712; Location=351..883; Strand=+
  SCN-specific regions: Sequence locations=1-533
tgtttatcaattgggcactaatagagcatttttattgtattatccctctattcagtgatttatcaattaaggcactaatagagcatttttattgtattatccctctattcagtgatttatcaattaaggcactaatagagtatttttattgtattatccctctattcagtgatttatcaattaaggcactaatagagcatttttattgtattatccctctattcagtgatttatcaattaaggcactaatagagtatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattgggcactaa

SEQ ID NO: 62018 - DNA, 155 bp, Heterodera glycines
  Genomic contig location: Contig_ID=SeqID_31713; Location=234..388; Strand=-
  SCN-specific regions: Sequence locations=1-155
atgattgcgcgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 62019 - DNA, 316 bp, Heterodera glycines
  Genomic contig location: Contig_ID=SeqID_31714; Location=537..852; Strand=+
  SCN-specific regions: Sequence locations=1-60,114-212,234-316
atggattttcaaaactactccatggtcaatttggtgaggaaatttgagcataatttccggatttaaataatttaatttttcaaatttaatattatataaaattataaatttaaggcatttaatcgtttcggtgttggcacctttttaatggaattgtttttgtcaaattcgtgccgttggctcattacgcttcctggcttaatgtttaattctgcacttttgtacacaaccatacgcgaaaagttaaatttaaattatcccgagcccgatacccgggcccggttttttgaaaatcaaatacccggtacccgacccg

SEQ ID NO: 62020 - DNA, 1174 bp, Heterodera glycines
  Genomic contig location: Contig_ID=SeqID_31715; Location=33..1206; Strand=-
  SCN-specific regions: Sequence locations=1-110,132-153,200-300,357 -460,508-758,780-889,925-1174
atgggctcgcccattacccagccaaagaatcggctttttcatcgtgcaattttgctggacggaagtgccatgtcgccatgggccatggcacacactgcgcagactcagttcatgaggctggccgaggagttgaaggtgtacaaattgggagacataaataattttaaattaaattaattaaatcaattaatgtaaaattgtcccaatgttattgttttgttaagtgtttccacatccatcgttcatcttccagcagttttttggacgaatctttacaagttcttcgttgtattcaggcacaaattttaattatttaaaaacattttttatttttaaataatatatatatatattaaggagcacagtgaacagaatgtgagcacagctgcgcgccatgttgcttcagcatcgccaacatttttgagcgcatttgcaccaattgttgacggacaggtgggccaatatttaaaatttctaattttatttaattaattataaaattaaaaacagattgtgccaaatcatccgcgtgtgctgttcaacccccaatacggcacattgttccgtgaaattgaccttatggtcggcactgtgcttaatccggcacaccatctgttggcgaaggatgacctggagaatggcatcagtgtggagaagagggacaaaatattgaggtgaatgaacgaaatggttttgggcatactgtcagtacacagtatatttgactggcacttaaaatttttaccatggataagtgatatattgtatatatgtattatgacgggctattctttcaagaactttggtgcgaaatattttcgactttcatcgcaccgaaatttttcaagccattctcaacaaatatacggattgggaaaatcccaaggtgaaattatttaaaaaatagttttttttttataaaatccgtttttttaaggaccatccaaaatctgtaaggaatggactaatggcagcacttggcgatttgctttttacaagtgcatttataaatatactttcttttttttctttctctctttttcaatatttttaattccttttttaaattcatttttcagctcctctcattgaaactttgagggcccattcgcttgccgatgccaatttgggcggttcagaggagaagaaatcatcagccaacacatttttgtag

SEQ ID NO: 62021 - DNA, 375 bp, Heterodera glycines
  Genomic contig location: Contig_ID=SeqID_31716; Location=263..637; Strand=+
  SCN-specific regions: Sequence locations=1-84,108-134,176-375
atgtgcactgtaatgcttcttgccggtgacgagccttataaaagatatttgggggtgagttgaaaagcaaagccaaaaacacacaatatgattttgtttttaattttagcacatagcccgatgcaaaggtttagtaatttaaaaaaggggaattttaaaattttcacacaaaaattcttgaaattctaggcgtggacaacttattggaagggtaagtgcattaaaataaaattattcattaatgcacaaatgttgagcattttttcattcaaaaatttgaattaagttggaccgatgtgtgtaacgggacaaaagcttctaagttttacgatgtttgttaaacatatttaattaaattttgagaaattaatttaa

SEQ ID NO: 62022 - DNA, 247 bp, Heterodera glycines
  Genomic contig location: Contig_ID=SeqID_31717; Location=463..709; Strand=+
  SCN-specific regions: Sequence locations=1-217,239-247
atggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaata

SEQ ID NO: 62023 - DNA, 456 bp, Heterodera glycines
  Genomic contig location: Contig_ID=SeqID_31717; Location=967..1422; Strand=-
  SCN-specific regions: Sequence locations=1-124,146-456
ggactgcccacaaacgagcaaggagaaaaagaaacctttaaggaaaacgagaggcgaaggagagaaccaacagaccgaccggagagaaaaaggccggacgaagaacaaactgcaaacgaaaaccacggacgcaacgccagcacaaaggaagacgaaaagaaaggccaaagagcgccgacaccagccgacacgggccggaaaagcccaggacccgccgccaaaaagcgacaacgaaccaagagcacaaaaaccgacacaagcgcacacaaaaaagccggccctctccattgaaaaggactcacttaacgtgagagaccgcttacgcttgaagtttttaaaatatatcgaaattctagacttttgcattactcacccattttttgcgaaattaattcataagtattttttcagattcagctccgaaacgcaccaaatgttacttatgaagttaaatag

SEQ ID NO: 62024 - DNA, 498 bp, Heterodera glycines
  Genomic contig location: Contig_ID=SeqID_31718; Location=516..1013; Strand=+
  SCN-specific regions: Sequence locations=1-107,134-263,292-410,446-498
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaa

SEQ ID NO: 62025 - DNA, 77 bp, Heterodera glycines
  Genomic contig location: Contig_ID=SeqID_31718; Location=1..77; Strand=+
  SCN-specific regions: Sequence locations=1-77
aagcatcagagagccttatttaacttttaattaacatttggtgcgtttcagagcacgttctaaaaaatatttatgaa

SEQ ID NO: 62026 - DNA, 72 bp, Heterodera glycines
  Genomic contig location: Contig_ID=SeqID_31719; Location=290..361; Strand=-
  SCN-specific regions: Sequence locations=1-72
atgaccaatcagttcgctcttccgcctctcaattggcttatccttttcgcgagttttctgtcggcaaaggcg

SEQ ID NO: 62027 - DNA, 2325 bp, Heterodera glycines
  Genomic contig location: Contig_ID=SeqID_820; Location=285..2609; Strand=-
  SCN-specific regions: Sequence locations=21-61,102-181,203-405,448 -471,494-494,517-714,748-892,929-989,1011-1031,1061-1091,1129 -1960,1984-2325
atgatgatgatgatgatgattggatggataatgaaaatttgggtaatcacactacaaatcttcaatcacccaacagatcaatcaatcaatcagtcatcaattgtccactggtatgaggcagatcacgctgatccggctttggctgagctgattcatcaaatgtatatggcttgcaatcgcatttttctttgttgtcgccctttttgtcgttgtcgccgttgccttccgtcaagcatttgcagcagggctgcacgcaattacggattacggattgcggattacggaaattacggggttttgggagttacggattacggattacgggttacggatttttgggatttttccgtaatttgatccgtaattttacttttggattattttttcgagacgatttcttgtaagattatttttataaaaaacaaattattctattttttatttaaagggctacccgtatttcgatttatttaagaattaaaatagatttataatttcttatttgttgttgttaaggttatttgggtagttcgcctagaaaatagaggcatcacttttttgtcacacctatttttcacgcattttatgaaaattcataaaaccttagccaggtaaggggaggaattccccccccccccttcccccgcccgaaatgaaaaattaaaaattttacaggaaaaattgggacttttaaattttttttgtcgatttttcttaataaaatcattaaaatttaaaaaaaaatttgcccgacggcacctatcggcaccgcctgaccacgatttactcgattttaccttattttttaaatgttgactccaaaatggcaaaaattagtcttttttggctaaaaatggttaaaattcctgtttttgctcttcggcgctgaacttttttaaataacactaaataaattttaccaaaaaaattcttcggattcccccccccccccccccccgtaatttttttctggctattaaaatgttgaaataattatatacatatacataaatccgattataatgatcagactttcaaaaaattttcaaaaatcaacccataaattcaaaaagaatgatttgatcagacacaaaattataaattatttgtaaaatttaaataaaaaatgaagaaactccatcaagaaaatcagttttttgatttttattaatcactatttaaaaatttttttctaaaattctgacaaaaattgatttttaaaaattacggattacggattgcggattacgggaaattacggggtttttggacccccgtaattacggattacggatttccgtaactgagaaaatcgccgtaattacggattacggatttccgtaattgcaaatccagttgcgtgcagccctgctttgcaccgacattgtttcccgtttctttttataataaaatcgagggatgttgctgtacaaaaaaacagcttgtcattgtatcgttcgcactgcttcacacaatctttccacccttcgtcttcggacgttatatggggcaattgttctacactaggaggatcaggacaactttcgttgcgggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttaatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatccacgtcgactgatagcacaaccagcagcacaatcagcagcagaagcagacgacgacggtgtgccgaaaatggtgatgatgatgaagcggcacggcaagtgatcggaaaattggcatacattttagttctctgtttaaaaaaaaatggcaaatgaaatgattaaa

SEQ ID NO: 62028 - DNA, 893 bp, Heterodera glycines
  Genomic contig location: Contig_ID=SeqID_820; Location=207..1099; Strand=+
  SCN-specific regions: Sequence locations=1-68,92-420,444-893
  Gene Ontology: Mol. function=DNA binding; Cellular component=nucleus; Biological process=sex differentiation
tggataaattttttggattttttttttgccaaaaatggcgcctgaatatatttggcccctcaatcagcaaaactgttttttaatcatttcatttgccatttttttttaaacagagaactaaaatgtatgccaattttccgatcacttgccgtgccgcttcatcatcatcaccattttcggcacaccgtcgtcgtctgcttctgctgctgattgtgctgctggttgtgctatcagtcgacgtggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcattaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatccctcatggatgttgcccatgggatgtttaaaggcatcttaaataaagcatcatcatcatcatcaacatcccgcaacgaaagttgtcctgatcctcctagtgtagaacaattg

SEQ ID NO: 62029 - DNA, 600 bp, Heterodera glycines
  Genomic contig location: Contig_ID=SeqID_820; Location=3105..3704; Strand=+
  SCN-specific regions: Sequence locations=1-234,262-290,312-457,524 -533,568-600
atgtttgatagaaatatatttttgtccgaatccaagtaattttttgaatttttttttaaaccaaaaaaattaaacgaacatttgtggcagatgaaaatgaaaatcaaaaaatgccggaaaaggtgttgggcggcgaacgaagttggcactgttttttgcgctgcatttcatatttattgttgactttttgcaacttataggctgataaattgaaaaactgatcaaagatggaagaaaatgaatattttttaaaaattttactgtattattcccataaattaggcttactaaattctggtccaatttcttcaactaattgacaaattatggtgtttttctgttacttatgcttcacatttaccattacgctttgttgatttaattattcttaaattaattgccgattaatggactaattcattcaataatttttggtccaggcctccatctgcaagtctggccgagtggtctaaggcgctgcgttcaggtcgcagtcctcttcggagggcgcaggttcgaatcctgcggcttgcagttaactttttaacaattttaaattaacaaaaagaattttgctaaaaaaatattaaatatacaaaa

SEQ ID NO: 62030 - DNA, 698 bp, Heterodera glycines
  Genomic contig location: Contig_ID=SeqID_820; Location=5558..6255; Strand=+
  SCN-specific regions: Sequence locations=1-181,205-288,310-569,592 -648,672-698
atggcatttttcctcaagggttgtcactggcattttggcacaacgccccgcggcgcacttcacacaaaacacacatcacatattgccgcaccgtgccatttaagtgtgcctgctgaagtgccgtgccagagcacattgttttcccgcaaaattagggtgccgaagatggtcccctccagcagggctcacaaattttgccctggggcaataggggatcaaattctttgccctggcgttgcgggcggcggactggcggcattcatttcatttcccgcaataatccctgccggggggaaaagggtcaaaatgccaatgccaatgatggctcacaccgaaaatggactcattggcgttgtgtcggtgccgatgccgtccttgtccgtcgttgtcagtttgatggtgtgccctgaggcactttttgtggtgcatttagaagatggaatgaatgactaatgccacccgcccccccccacctctcatccccgcggggggtgccatttgggggctatcatttttgctttgggatagttaaatgagcaaattggttttgacttttttaaagcattttgccaaatttggcatgaaaaaattaatagcatttatcaagcaatttttgaaaatttagtgaaattctatttatggtgctccatatttttttaaattttttaaatctaaacacgtgaagaacaatttttata

SEQ ID NO: 62031 - DNA, 154 bp, Heterodera glycines
  Genomic contig location: Contig_ID=SeqID_820; Location=7069..7222; Strand=+
  SCN-specific regions: Sequence locations=1-154
atgccgttgctgccggacacttcggcaccgatcattttcctccattttccgtccacactgattttgctgtgctcaacttgtgccgtcaccgggggccacgcgctgctgctcaacggagaatacccgtggacatatgacaacgatttgttcggcg

SEQ ID NO: 62032 - DNA, 1380 bp, Heterodera glycines
  Genomic contig location: Contig_ID=SeqID_822; Location=1190..2569; Strand=+
  SCN-specific regions: Sequence locations=1-72,94-171,193-314,436 -815,844-998,1027-1200,1236-1380
atgggccaatttccactgctgacattggccaccaaaaacgccacgacggcggacaccactggtggtggtggcggtgagaagagggaggagcagaagcagcaacaaccggtgctgaacattgctggcgggccggcacatccgtacacataccaaatgcaacaaattgtgggcattaattaattaattaataatgcgaaaattaccaaattaatcaattttgggcgcgctataactaaacgaaaatattattgaattaagataatgtattgttagtgaaacacttaccaaatgcaaccatattgtaggcattactctcaattaaagaaatcattaatcaattactaattaattttaattaatgagacaattagcaaattaataaaattaagggctcctttcattaaaccaaacattaattaattaacgttagttaatgcaacaattaccaaataatacaagcacaaacccaacaaattgtatcaaatcggattaatttagtaacatttgtgccaattaggtggtccattttggcgatgtgcggcggggcgaacgcggctctgaacacaccatagaccgtgtccgatttccggctgaagtaataccatgtttataaaaaaatttacagaattttttttttcgaaatacggattttcctagccccgaaaaaattgggattctaaatttattaaaatttatgtgttagctgcaaattttggcattcaattccgacctgtatgacaacttcacacaagcacaatcgcagccacggggtctgcttggcatcgccatcatcattgatgtcagttattttttgcatttttttttaatttttaaaaatttttacgaattttaaagcaatttaaaatgataaaaaaaagtttttggctaaacaaattcaaaagttcatgccctaatttgtatcagataagttcattttttattcagattttactggaaaacacttggaaattttcggtcacaatttcgggatttagtcctaaaaatacaaattattattttgaaatttattgcccattaaatcgacccaaaaacgaaattttttccacttattgaaatccgttaggggtagagtttcaaaaacaaattttaccctaagattggagacaggacaaacgcggaattgcacagattgtcccaggcgaccaagcacatcaaacatcgaagtgggaaatctatttgaattttaaaatttcatttttttaaattttaaaattccaaaccttcattttttaatttttagaccaaatggtccgcattaaacgcttccaaccggctgccctggtgccgtccactgaacattatgtgacctatgatgggtcaatgacctatccgggatgtttcgagacggtcacatggtag

SEQ ID NO: 62033 - DNA, 2882 bp, Heterodera glycines
  Genomic contig location: Contig_ID=SeqID_6566; Location=1575..4456; Strand=+
  SCN-specific regions: Sequence locations=1-213,235-324,348-474,496 -2255,2277-2323,2345-2689,2711-2882
cagcaacaacttgtgcatcagcgtcatgatgtgacgcttccgccaataacattgcccaagttctcgggggaaccccgagagtggcctttgttttggaagctctttgagacttccgttgaaagtcttcagattgaagactttaaaaagcatatttatttgctgggatgcctcccagagaagtcaattgctcggagagcaattgacttgtatccaccatcagatgaaaattatccaagggtagttgaaattctgaaaaagcggtctggggatgaaaaaacgatggtagagtccatccaagcggagttactccaccttcccaaaccagcagaatcagttcagtctctgagacaattctcagagtccattgaacggatttgccatcagttgttggactatggagaaaatgaacaaaataagttcatggcctccactattaagtccaaactgccttatcaccttctcacccaagtggtggagagggaaatgagggcaggaggtgcctttaattgcacagagctccgaagagctatcacctcaatcgttgaagtgaaagaagaagtacagagatgtactcaggttttccgtggagaggaaaaacctcgcaattttccccctcatccaatggggggaagagcccaccaagggagaggaacaccgttccgtttctcccagccgttcagacaagaacggcagtggaggccaatggaacgaaacgaaccggtgaggaggatgtctcctcaaccgaatcgttccttctcggccatcaacaaaccacagacccctatctcagatagggggtcaaaacgcttatgttccctttgtgaaacaaaggggcatgcaccgagcagatgcacaaaatacaccactccgggggcgcgaaggaagcgccttacggatcaagacaggtgtattaattgcctgatgatggggcataacaccaagaactgcacctcaccccgcaggtgcagtcattgtggtgaaagacaccactttatggtgtgttttggagaaaagtctcgagagggaacctctcgggtccaaccaaataatcagatgaaaagagaggcgagaaaatcctctcaaagtcatctgactatgagcgagcacgctcataaaagcgtgcccagttcggaatgctcacccatcactacaaatgtgatgacaagcgtgatggcgaaaaagcctcacgcatttctaatgaccagaaaaatactggtcagatccaaaaataatagaagagtttggatggaagttccattcctcttcgacccaggaagtcaaacttcctacgcctccgaccctctcatcgagaggctcaagccaccgaaagtgacttccgaagaaatggaagtctatggctttggaggagaaaggaatggaccaatgaggttccattctcccgtgtattccatccaaatcagaagaacggatggaaagtgggaagaaatcctcctaaataggacggagagaatttccacgccattcaaaatggcagaatggaattctgaggaattcccactcaaaggaatggacatggccgacgctatgagtttttctcgggaagagcccgaaatactcataggtgccagacatttctggcaattcttccaagggaaggaagaagtttctccagggttgtttgtaattcaaacaaccttgggccctttggttaacggagagtccgactttgggccggaacttccgaacccaggactatcaatgatggccattgatgagtccaatcaagggcaaatgccaacagttaaagaaattgaatatttctttaatttggagtcattggggattaaagacgatccaaatgaaaatgacgaccaaacagcaatgagcctatttaacaagtccatccgtcgagaaaaagacggaaggtactctgttaagtggccatggaaggaggaggtgcctgacctcccttccaattaccgcatgccttttcaaggctaatgtctacttttggtaagctttgtaattctccagacttaatggagcaatacgatgctaccattagagaccaattgcaaaaggggataatcgaagaggccaggaaagcccctggcactcttgagcattatatccctcatcagggagtccttgccaaaggcaagaaattgcgcgtcgtttacgacgccagtgctcacaccagaggaacaaacagtctcaatgcctgtttgtatagaggcccggtaatactgccggatctcataggaatgcttatgcgattccgatgtccaagattccctctcctctccgacatccaagcagcatttttgcaaattgctttggaaccggaggatagggaagtcaccaaattcctctgggtgaaggatgtcagtaaaccactgacaccagcaaatctgatcacttaccgattttgccgagtggcattcggagtgatcagttctcccttcattttggctgcgactttgcagcaccatttgaagggataccattctccagtggccaacgaattggcccaatcattgtatgtggataacactcttcttgagtgtgaatccacagaagaggctctgcataaatatgcagagtctaaagccattcttaaagaaggacacttcaacctaagggaatttgttacaaattccccagaggtaatgaaggcgattcctgaggaggatcgcttgaacaagcccaaggtaaaagtccttgggctcatttgggacacagacaaagacgaaattgtctttgagttcccaactcatggcttagaaaagctggcaacacgccgtcttgttctaagcttcctcgcctcattatttgaccctcttggtctaatggggccgtgcattcagcccttaaagcttttcttccaaaactctttgggaagaaaagaaaggctgggatga

SEQ ID NO: 62034 - DNA, 678 bp, Heterodera glycines
  Genomic contig location: Contig_ID=SeqID_31723; Location=84..761; Strand=-
  SCN-specific regions: Sequence locations=1-182,215-484,506-678
atgctttacatcccaaccaatatgacgtggattgaggtcgacgggtgtgtgtgtcctcaggcttaacgtctttaaaatactaaatttgttttcttgaatttttaacgaaaataaataatatgtcaggggttgtttaaaaggtgatgtcgttatataaaaaccaatcaaaaagggcgttatacaatataaaaaataattaaatgaaaatttttaacaaaaaactgcccaaaagttatgaacaaaaatactcaaggaaccagtttttgcgaataaccaattgtgcgacaaaggccaaacaattcgacaaaattttcaattttcaaaattttatcaaaaaagaaattttcaaacaataaaaaaacaaaaataaactgaaatatttggttttataaagtgcaaaattagaataaatctttctataaagttaaaaagatgttaaagaaaaaattataaaatattgcactgatcactttgttttttatcaattaaaaatgaaattaaaataactttgtttacagactgatccatgaggaggtagcataatatgggaaattttttgatccattcaacttatgatttattcaaaccaagccctgtcgtttttcaaatatttttcgaaaattaattctggctaaggcagacaataattttagcacaatttttgcccaatgtattaaa

SEQ ID NO: 62035 - DNA, 1008 bp, Heterodera glycines
  Genomic contig location: Contig_ID=SeqID_31724; Location=1..1008; Strand=-
  SCN-specific regions: Sequence locations=1-844,866-901,936-1008
  Gene Ontology: Mol. function=DNA binding; Cellular component =cytoplasm; Biological process=gene silencing
tccaatgaaaaaggaatgccaaacaaagaggaagtgccaaaaggatcggaagagaaagtgcaaaatgaagcggaggtgccaaatgttgagggagtgccaagtgaggcgggcagcgcttcacagccgagcttgtacagccaatttgtgaccagcttcgagagcgtcatcaacagtttggtctcaggtgcgtttcagtatcaaattgtctattagaaaactgactaattataactgctggcgtaggaatcacttcgcagatgacgtggcgacgcgtccacagcaaaaattgccatctttggacttggagggcgttgcggcgttcatccgcgaagaacgacccgagattgtgttcatggtcggtgccggagtgtccacgtcagccggcatcccggactttcggacgcccggttcgctttcgaggcatcggcgtccaatccaagcaattcttgtcaaggcaccggtctctacgacaacttgaagcagtacgacatcccaaatccgcaggcgatcttcgacataaattacttcagaaggaatcccgagcccttttttgtgctggccaacgcacttttccacgaaagcataatggttcttgcgttcttcccattctcggcttttgttgtgaatttgactttatcccattaagccgacttccgcgcatcatttcattcgtttggtggcggacaaagggctgcttcggcgatgcttcactcaggtgacctttaaaatgaacacgaccataagtaacataagctttagtgctttggattcatataccatagcattaatctctttattcaaaataaaaaataaataaacctgaattaaggtagcagatccaaactttttcttcattctaattttctaaaaaaaaccttttttccatttttttggtttaaggattttaatttttttttatttaatgaataaattttgttcatttctcactttgttttgccattcgtcagaacattgacggtttggaattccgtgccggagtgaaggagg

SEQ ID NO: 62036 - DNA, 229 bp, Heterodera glycines
  Genomic contig location: Contig_ID=SeqID_31724; Location=1216..1444; Strand=-
  SCN-specific regions: Sequence locations=1-155,195-205,227-229
gtatttaatggcaatttgttatttaattggttcaagagggactgttcgatgattccttcgaccgcccacaatggtctctctcaccgcctttttgatatttctttctgaaagtgaataatgaatgaatcgctgactcccatctttcctccgtgcttgttgtttttcttttgttcttttacataaaaatatttattgtcccaatttgaaaataaattgttaatttgtttaa

SEQ ID NO: 62037 - DNA, 880 bp, Heterodera glycines
  Genomic contig location: Contig_ID=SeqID_31726; Location=311..1190; Strand=-
  SCN-specific regions: Sequence locations=1-14,36-709,736-880
  Gene Ontology: Mol. function=GMP synthase activity; Biological process=purine base biosynthesis
atgtctccattcagtttggaccttaatgtggacaacatttttttggtgcagggaacactccgtcccgatttggtgaacatttcgctttttatttatccgatttcttctctttgtcagattgaaagtgcctctcaattggccagcggttgtgcggatgtaatcaaaacgcatcacaacgacagcgctttggttcgcgaactgagagatttggtgagattttcggcgattcaacaatttatcctttttttgatattttagggccgggttgtggagcctttgcaagagtttcacaaggatgaagtgcgcgagttgggccgatcgttgggactgcccgagcacatcgtcaacagacatccgttccccgggcccgggttggccattcgcatcatttgcgccgacgaacccttcaaagtcgaaagaagttttcaatttcaattgaattttctttccaggaagaacatttcgacgaaacgcaacagcgcgtcaaggaatatgtcgaggcattcgacgacaaactttgtgccattgttttacccatcaaatccgttggtgtgcagggcgaccggcgttcctattcatacgtggcagcggtgtttaccaaagacccgtcgttggaggacatcccatggctgaaactggaagagttggcacgactgctgcccaacgagtgtcacttcatcaatcggttcgacagaattaaaaattatctcttgcattttgatatttttgttttctggctttaactcattttcgtccccatcattttagggtcgtttttgggttcaatctcggctataatattacaccgatcaatgacattacagtaacacacatcaacgaaggtaccgtattctgtgatgttgcctttccattcgctttg

SEQ ID NO: 62038 - DNA, 461 bp, Heterodera glycines
  Genomic contig location: Contig_ID=SeqID_31727; Location=1574..2034; Strand=+
  SCN-specific regions: Sequence locations=1-87,124-182,204-461
cgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtgcattctgatttggacatttttcagaaatgactaacccaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcaactatcgaatgaatccgtgaattt

SEQ ID NO: 62039 - DNA, 134 bp, Heterodera glycines
  Genomic contig location: Contig_ID=SeqID_31728; Location=637..770; Strand=+
  SCN-specific regions: Sequence locations=1-134
atgcgggttgtgctcacccagccggacgatgtaacccaagtgatttatgacgccggtttcaacgaggccattgtgatgttcgttggccacgaatccactcaaattgccttcaacaaagtcaaaaaccgaaacat

SEQ ID NO: 62040 - DNA, 95 bp, Heterodera glycines
  Genomic contig location: Contig_ID=SeqID_31730; Location=828..922; Strand=+
  SCN-specific regions: Sequence locations=1-95
acatttcaaacacaaatgaggatgccgtgaatttgggagtggagcttggcgacccgaatgccgtgataattttcgacaacgttgacagactttga

SEQ ID NO: 62041 - DNA, 1144 bp, Heterodera glycines
  Genomic contig location: Contig_ID=SeqID_31731; Location=435..1578; Strand=+
  SCN-specific regions: Sequence locations=1-124,146-327,349-486,508 -578,607-1144
  Gene Ontology: Cellular component=mitochondrion; Biological process =embryogenesis and morphogenesis
cttttaatacactccatgcgaattcaaaatgggctattgagtattggcgtaattatggtcttcctgtttcaaccggccaaggtttagcaaatttggcggatgttcagcaatctgttacttcattttctccaattcagacatcttcattcataacaacggacaagaaagcgcaggtgtccggcattcgcattgaacctgagcagggcgcgggcggattcgtcggatatgcgtaggtcattaatgtcgatgtaagatctaacaaaaagtttcgcagggataagggcgtcagcatcgttgagccggacatggatgtgcgcgttgtgctgtttggcatccacctggacgaaattgaccttgtcggcttcacatccaccgacaattgctccgacgcggcggtgctcatcgatcgaaatgaatttgctatccaatcggaaagacgtgtcgtggtcatctatcactttgcaaggttttttggcgccatgattgaatttgttaaacccataaaactttaagcaattcattatacaaattgtgcgtgcgccaaaagccccatcctgattatccacacgagcttcccattcatttggttggttggtttttaaataactatcatatcgctccctttgcttgcagacggatgaagctcactgttgggtgtctacgaatataccgcctcgcaaatactacttctcaatgcctcttcaaattgtcatcattgcagtgctgctcgtcctttctggtctcttctcgggtctcaaccttgggctgatgtcacttactccacaagagttgactctcatcaaaaattcgggttggtgagaaaatttttgtggaataccatggatttattgtttgtctgcttgttgatagttcttggttgttgtttttttcgagaaatgatgttcctttctgtttaggttcaccaaaagagcggaagtatgctcagaccatcctgccagtgcgcaagtccggcaaccggttgctgtgctcgttgctcatcggaaatgtttgcgtcaactctgccatctcaattctcttcgacgatttgaccagtggcaccgttgcattgatcgtttcatcgaccggcattgttgttttcggcgaaatcttcccgcaggcgctgtgtgtgaagaaagggttggct

SEQ ID NO: 62042 - DNA, 891 bp, Heterodera glycines
  Genomic contig location: Contig_ID=SeqID_6568; Location=1262..2152; Strand=+
  SCN-specific regions: Sequence locations=1-31,55-60,82-246,268 -462,518-564,586-848
atgacaattttgttcacatgcaacccaatgattgaaaatgtatattttgctgccatcaataaggaaattgtcatatttttctattttccattcgaattttatcaatctgattttacagtataatacaattggtaccgtatctgtacaaattggtacttttacagcttcaactttggcatcgtatgcttcatttttggttcttttttgatctctgccgaacgattataaaatgttgtaattccgctcaattaaattatctgaatatttatttttgaatgaactggattaaagaacagacaactttttagctagcttaaatttaacttaatttgaagaaattttgtgaaattttaccctcaattggaaaaaaaattgcatattttcaacttttataacgttttttttgaagtttttttttgttttggaattttatgcgattttagttgtgtaatggtgaatatctttaaaatgaaaattaattttatcatttatttataaattaaaaattactttaaatgtgccgcaattaattttccaaaaaaaatactttctccgcttttataaaatttaatttccattatattccgccaggcaaaagtttttggttccaattacttaatttttatccaaaacgacataattttgagattttgagccaatttttaaacagttagtttttaattttccttttattcttttaatggtttacaacacttatcatattaaaaagttcaaaaagaaagttttttcttgaatttgacaattttctatttaattaggttaagcgctatattaagaggaaattggaatataaccaatagcataatttagaattgccttttcatacgaaattttttttcaaattattttaaatatttatttaatatttta

SEQ ID NO: 62043 - DNA, 145 bp, Heterodera glycines
  Genomic contig location: Contig_ID=SeqID_31734; Location=790..934; Strand=+
  SCN-specific regions: Sequence locations=1-72,95-145
atggacgagctgtgtgaaggaaaatggattggacgaactgttggggacgatggggagggcatgttcggaggaggaatgcggaacgggaaaagggggcgaagtgtttctgagcagagagagacacgtccactgcttggaaagagca

SEQ ID NO: 62044 - DNA, 616 bp, Heterodera glycines
  Genomic contig location: Contig_ID=SeqID_31737; Location=553..1168; Strand=+
  SCN-specific regions: Sequence locations=1-31,54-128,159-326,362 -398,420-477,499-588,611-616
atgaagtacaaataacttatgctggcgacgtaaccccacctggaaattattaaattgttgtttgggataacctaacaaaaagttcggacaaaatgttttttttatacttcaaaaaataacaaaaaaggtaaaatttattaaattttaaaataattaaacataacattaaggatcgtatataatggggtacttttattagcatacaatactcttggactcgaattagaaaatattgggattctaaatctaaaaaattctcatccaaaattggtgccggtctttacagaatcggtccgtagcgttcgcattgaaatagttttttagggttttaaaaataaaatttctttaagtatatttaaatcaattaagaatcggatactcaacgcgaatacacaaagctatgaaaatgtggatgtgatattatcattttcaaatatgagaatggaattgttttggagaatttaagcgattgtttcgttcatttttattcagttcaaacaaataatgatggcgaatttgagatcaaaatatccatcaatgtcaatgacaatttaaatgttcacatatttccacttgacaaacaaatggtaaattaaattttaattatttacaaaaa

SEQ ID NO: 62045 - DNA, 471 bp, Heterodera glycines
  Genomic contig location: Contig_ID=SeqID_31738; Location=365..835; Strand=+
  SCN-specific regions: Sequence locations=1-73,116-471
atggaaagaaagtttgctcggaaaaaatgcaatattttgatcaaaaacggaaacagattactcgaaatgaaagtaataaatatatttttaataatatttaaatttacaatttttaggtaaaaagtcggaagaaattaaatccaaatatatcattccgagattcttggaatttggttcctggtccattagcctcaatggtcccaatgtttggcttagatgttcaagacaagccgttctttccacatttggcaaacaggccggaaaattacggctgtcaaatatttccgacgaaatcaaactatttggccgatgggatgaatcctgagaagcgtaaagaatttgacatttggtatgatcaaaaccgaaaccagccatttctacttgatgaagcattggccaggtattttttatatattttttgaaatacctaactaaattttcagtattgtaaaaatgacgtggatattttga

SEQ ID NO: 62046 - DNA, 1416 bp, Heterodera glycines
  misc_feature (1117)..(1117): n is a, c, g, or t
  misc_feature (1176)..(1176): n is a, c, g, or t
  misc_feature (1198)..(1198): n is a, c, g, or t
  misc_feature (1227)..(1227): n is a, c, g, or t
  misc_feature (1306)..(1306): n is a, c, g, or t
  Genomic contig location: Contig_ID=SeqID_31740; Location=1..1416; Strand=-
  SCN-specific regions: Sequence locations=1-158,184-298,320-353,375 -462,485-1082,1105-1416
ttcttttacactcgacggttttttccgtcgaatgtttctctttttaatattatggtttcttctagaattagcgctttatctaacgagcattttagtgtgaacgaaaaatacaacgcctttaataatacattgctagaaaccttaaacgagtttattccaatggaaaaaattaccaaaaaagatttgacccctaaatatccaacgcatttattggcctccatcaaagagaaagccagactgtataggcaatgtaaaactgacccaacaaaaaaagcactttatgatagcattagtttacacataaaaatacaaacaaataaatttcactcgcaaattgagaaaaaggctatttcaaagggaaaaaattccatttttaaatacctacaaaaatacgatgttaatccctttgaaataccgaatttaatctttgaaaacaaatgctatcatgatggtgatgaaaaatgtgaattatttgccaacttatttgcaaattcgtttaataattctgatgttgacccaggctacctaaacttgggcaatacttttgttaatcaatgctttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcattagattctggttctcttccagatatctggaaggaatcaatagtttttcctcttttcaaaaaaggggacaaattcaatcctgaaaattataggcctatttctataacatgctcactttgcagggttatggaaagaattcttagccaaaatatttacaactttctcctaaaaaacaataaaatttcggaataccaatttggttttgttagaaataggtctacgacaagtcaactaataacagttgtgcaagattggtacgaggcaattataataaaattgcttatggccgaacagatctgaaactattttctatttttaatccatccacacgctttaacatccccttttatagatttaacacaaaatacaaactgggcaaaaaattcattccctttgctgngagggtaacaaaattgtggaatcaactcgataaagaactaataaaaacaaattctttanaacaatttaaaataaaacttanaagttcactagggtaatctgtaagacggngaaagttagaatgtaacaaatttctaagtgatttggtatttcgacctcattgactttgaccctcatttatttattattnattccacatattttgtaatttttttctaatttaagaatcgactcattgaagcgatgggtaattaataaatttatttgtcttaaaatcctaaaaaggaatccccccccccc

SEQ ID NO: 62047 - DNA, 1157 bp, Heterodera glycines
  Genomic contig location: Contig_ID=SeqID_31741; Location=153..1309; Strand=-
  SCN-specific regions: Sequence locations=1-4,63-136,169-926,948-1157
cagcacagcaacaccatcaacaacagcaacaacaacaacagcagcagcagcagaaacaacaagtcgtccgtttcgtaaaaattgatgaagaaagtgacgacgaagcgctccgaatcgacatttcggagagtgagtcggaggaggaagacgacgacgatgaggaagaagcggcggcagcactcgaagcagcggtagccagtgccgcaccatcgccggttgtccaagaggtcaaaaagcctcgaattcagggacctatggaggcaccgaagaccaaacgagtggcggcagctgagggaccattcgtgaagcgagcgcgcatagtaggcccgctgaatgcgcagaaatcgcgttgcaacaaatgcggattgcttggccatttgtctggcgacgaggctcgctgcccaaagaccaatgccctggtaaaagcggagatggatcgaaagaaggcggcagcatttgccaaacgcgcggaagcaactatggaatgctcggcacctccgatcattcaactgccagtcaaaggtggtggacaggcacgtgcggccagagctggaggcgttgctgcctcaatggtcgctggtggacgggcatcagctgagggcgcatttcgcgcatcgaagaaaagagcacgccaagaattgatggccgcaatggaaaaacccaaggcggcagccatcagtgtggcggaaaagaaggcggcagcccgaccgggtctccaagtgccaatggagacaaatgccgtgctgaatggactcagcgaaatcggggcacgcatcgaccgcgagcgagacaatcatttgagcatggctgaggaattgcaacaacgtggaaaacgcgccgtggcagcaatcgacgaagtcatcgctcagggggcgcaaatcggacaaatgtacgtggagtggacgcgcaaattgggcgaagtgctgaaggccaacgaacaggaaagagccgaccgcgacgcgctggaacatcgccaggcggcagcattcatgcagtcgttgcgcctcaaaatctcggttctgcgtcgtgaactttcgtctccgcccggagtgtcgccgctggcgactgaacgcgtggaaattgggggacagcccggaggatcgctcggaggacagcccggaggaccgcttggaggaccgcccggaggaaagaaatga

SEQ ID NO: 62048 - DNA, 504 bp, Heterodera glycines
  misc_feature (449)..(449): n is a, c, g, or t
  misc_feature (462)..(462): n is a, c, g, or t
  misc_feature (493)..(493): n is a, c, g, or t
  Genomic contig location: Contig_ID=SeqID_6569; Location=2132..2635; Strand=+
  SCN-specific regions: Sequence locations=1-304,326-360,382-504
atgaaacagaatttgtcagtattaagcctattattatttgttcaaatatttgcatcaaatctctctgataaaggtattttatatggctattagcatacgtttatattattttcttattctgcacttatcgtttaggcacatttgtgaatggaaaaaatggaggtgagaaaatatttctgaaattaaaacgtaattaatctggtcattgatttaatttccattcagcaggcgttgattatttccaagtcaaatacgaagaaattgaacaaaaaattgcccaactgcaaaagcacaatgtaaggattaaatatgaatgtttaaattatttttgtgtaaaatcaatgcgctaatatttgaacaaacaaaaataattttattcaccatttagaacgaatcggacgccaaattaaacaaaatcgaaaatgaattggtaattaattatagcttanaatggattattanaacaatagaatatttttcagcgacaacttanacaagcgataa

SEQ ID NO: 62049 - DNA, 520 bp, Heterodera glycines
  Genomic contig location: Contig_ID=SeqID_6570; Location=304..823; Strand=+
  SCN-specific regions: Sequence locations=1-17,39-400,422-430,456 -486,511-520
taccatttcgattggaatttggacaaaatccgacgacaccttttacaaatattcaaacaatggcttcattttcggacacagtgccactggcttgggcggatatccatcttttgcagagggcgacacaatcggatgcggcgccaatttaacatcgatggaaatcatttacaccaaaaatggacaaaaattgagtgagcaaatattaatttatcatgaaattaagcagatgaagactatttttagacacctcaaatttattcgtttttgacaacgaattgcttccatttgtacaagttaatacgcttggtgatgtgattgaagcggatttcggacctgtctttgagtacaagaatgtttcggatttgttcgctacacaaattacctaatttactaaaaaggaaaggaaacagagaagagaaaacttacaaaattaatttttgcttttgtttttaattgtatatacatttaatttactttatttcacacgcattttaaaatttatatattgtttctgcataaa

SEQ ID NO: 62050 - DNA, 339 bp, Heterodera glycines
  Genomic contig location: Contig_ID=SeqID_6570; Location=1565..1903; Strand=+
  SCN-specific regions: Sequence locations=1-20,42-135,157-252,275-339
atgaactcctcatttgtcatctgctgctgcttccacaactttgtgttgttccttcttttgagttgtgttgtgccacatgcttttgcttgttgtcctcatggaaatctcagagtgaaaggcaagaaatgacaagtcaataatttttttaaaatatttcccgggcagatcccaattagctctttggagattcattgtttaacttttcacaattctcgaaattgaaaagccaatcgaatttgtcaaataaaactcaataattaccaaaattatgtttttcgctttttgagctgttatttcatatataatttgtttaattacctcaaaaggtgcatagttttt

SEQ ID NO: 62051 - DNA, 2851 bp, Heterodera glycines
  Genomic contig location: Contig_ID=SeqID_6571; Location=1..2851; Strand=+
  SCN-specific regions: Sequence locations=1-65,90-148,192-208,232 -561,583-912,934-948,970-1105,1127-1625,1670-2089,2111-2586,2608 -2657,2680-2725,2747-2851
aagaagggaaagtcaaggagactagccactaggacatttgcacaatgtcattgtcacctttaaagaatatatattaatatattttttaactttttccctttaactctaatttttcacaaggaccccccattcttaccagtgcttgtttttcccggttgccctaccgggaccgggacctgagcttttcaaaatccgggaccgggaccttggatgaccgggaattcccggcccggttccggtcccattttccatattcctatggcgttaaatttaagcaaaaaatagtcgaaattttaataaaatcgaatcgaatgtccgtccatcaaatggcgaatcaattaatcaattttcagtgttttcttcggttagccgacttttgcgccgcgccatttgtgccgcgacacttgcgccgcctaacaaaaacgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggcggattttaagcgaaaaaaaaggtaaataaatgagggcataaaaattgcgaaataatgcgaaaaatggtaaaataggagcgaaaatttgaaaatcagtacgttttttcaatgaaattaaattaaaatcgatgaaaataacttattgagaaaattaattacaaaggaattgaatttcattcctttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatggcgcggcgcaagtgtcgactttgctgagcggcgcaagtgtccacttttgctgtgcggcgcaaatggcgcggcgcaaatgtctcatcacggttgtttaatactcaccagaagacaccacgaggggtgttcagccaatgacgaaaattataattcatccgcctcattttaatccaatcttatgaaaagttaccaaattcggtccctagcattttctggcactccccacggcgaatataaaaaaaagtgttaaatctctgtccccaaaaggtccgtgctccgttagctgtggaccagggcggctatttgtcaaatccagaacaggttttgtccactgatcacgttgacagaaaataaagagccaattttcaaggagtatgcgaaggtgaagagcgtagtccaagcagcaatcgacaaatgcatgtgagaattaaggggggcgagaaatccatttaacgagaaacgagaccgagaaatggagagagagagcaagagagagagagagagttaaagagagagagaccgagaaatgaccctgaaaagtgccaaaaatcacaataacaaaaatataagcgagaccacgaaaatcccgagaaactctcggagaattaattctctcccccatccacctgtgttatgctgaagagcaatctctttaaacgaatttttacaattttgaattgggacaaaccctcaagatatgtgctgattgattggcattacacgagcagtgagaaatatacggacaaagcgaaggagttcttcggcagaattagcactctgtgcgctggcaaatgcaactgtttgtacgaaacatggaacgaacccatacaaaacgattggtcctcgcagttgaagccgtaccacgaggagctggttaaagtgagattttaaaatagccatttaatgggtgttggcggaaaagtgattgatcaggaccatgttttggaggttctcatttttaggtagcaccgtaataattagatctaagccattgagacagtatattttttatcattggaaatcaacgtttttccctcaggtgattcggcagaatgacaagaacggagtgataatcgctggaacgccaaattatgaccaggatgtgaaggcggtagtcaatgacccaatcaaagagcacaatataatgtaataaataccgaataaatgatagtgggggagggggggggatggtgggccaatatttatccgaatacgaggatttgatatcctacacctcttccccgccgcacaaaaggtacacattgcatttgtacgcggcatcgcataagcaagaactgcgcaacacggcacaacaggcaatcgacgcgggagtgccgttgtttgtcacggagtatggcacaagttcgtacacaggcgatggcgggccagaccttgtcgaaacacagaattggtaattttccagggaccctatttcgaaaagtataaatgtttacaaattagagagggctttgaacgaattggaatatcgaccttttgtttcaaaggtacgactttttcaacaaaaactccctctcgtacatcaactgggccatcgacgataagcaggaagcgtcggcagcgctgcagaacacacagcccccagtcgggccggccgacgtgtgcagcaccgatcggctgaccaaatcgggcaaatttgtgcacgaccacctcatcggtgtaaaccagaagccggatggctgt

SEQ ID NO: 62052 - DNA, 1364 bp, Heterodera glycines
  misc_feature (788)..(788): n is a, c, g, or t
  Genomic contig location: Contig_ID=SeqID_31744; Location=174..1537; Strand=+
  SCN-specific regions: Sequence locations=1-527,550-609,631-665,687 -846,869-889,913-1252,1276-1364
atgaaagagaagaagatgggcttaaactcgaacaggaaaatgtcgctaattgtgcctgtctggggccatttggggtggcaaaaggcaatttgggcgtatttgaggctcatcaaagtgccgaaaaacagcgaaacaagcacaaaagtgccgaggtaaacagtgcgattcacttttgcatgccttaattttgaaattgcattttatatttaatgccaattcttaattcatttaatcaatttattaatgttgcaattcggcaccatttttcaaatgccaattggatgagtctgtccagcccggttagtgcgattaatgccaaactcgcactgcagccgaccaacggaacgacaaggaatttgaacgcagtgaaataagggacgaaattgcggccggagagggaaacgcaaaggaaaaactaatgaccaaattggtggacagtctcaaaaagagcagtcaatgccaacagaaagctcgaagtgccacgaagagagctgcgaaagggaaagccaagctcaagaacagaaaagtgaaaatggaaacattggaacagataattaaacgaaatcaaattaagcgtaatttagggacaataagcggggaaaagtaatcggaaacattatgccaaggcttagagcctttttgagtaagcttttgcctgtatttgaaggtgatcaaaaggatgccaatgttcatcaaaatgccggggacgacgatagcattgagcagcgatgccgtgaagatgagcattggggaatggccagagtctttgtattggacccacagctganaaagcattggctaacgtaattgaagaaccaattaaactttacctgataatatgaataatttttattaagtccttcaatttgcccattcatttgggattttcagaatttaataatgcgataaaaaattaaatgattaccttttacgccaaatagatacctaattgctgcaatttccgcgagtttacattgaatttttaattactacaattagcattaatgagataagcgttaaagtaatcttcagcaggtgttttatattttttaattactttttttctgtgccgtttccgctagttaaagtcaatggcatggtaatgggcgataaatttaatgatgtgattgatatccttttatctaattcattattttcacggttcataatttgagcaattgcaataattattttgtacaaaattaggtttttcttgaaaaagattataattgaaatagttacagacagattcatttaaaaaataataataattttgatatgaattaagcatgtgcaatgaatggacaaaattgaaaatgttttctaattataaaaaattaaatcaaaaacctttccagatagaa

SEQ ID NO: 62053 - DNA, 370 bp, Heterodera glycines
  Genomic contig location: Contig_ID=SeqID_31745; Location=940..1309; Strand=-
  SCN-specific regions: Sequence locations=1-94,116-262,284-321,343-370
cttttatttattacaaattgtattcattaccattcaaattttactttacataaaaattttgtatcccttttctttttcgatagaattttctaacttttaaatcccataaaatatttgtccaacagaatatttatatatgtatcacaaaataaactaccagaatgaacagctgtgtttttggcttttacatttgattacattaattaccgttaattacgtcattgtatcataaaactgtcattggccttgccaccgttgtcctaattgagggcaactctgtgtttgatgagttttacttatgtacaattttgatttctcgtctaaatttgaattacttattttaatgatcagcacttttttcccataaatt

SEQ ID NO: 62054 - DNA, 335 bp, Heterodera glycines
  Genomic contig location: Contig_ID=SeqID_31747; Location=359..693; Strand=+
  SCN-specific regions: Sequence locations=1-32,54-157,179-237,259 -267,293-335
atgatgaagttgtcaaaaaaacgcaaacaactacagcatcaggagcaaagtcaatcgttggtcaacccaaggccattgaacaaatggaaggcaacccattggttaagtaagtacaaaaggacaccgagtaaatatttgtaaataggagcagcgaaataaattattaaatgaaatgctattacggccttactttatttaattaattgctaaccatggatttgtaaataaacatctttaatttcaaatttcaattaaaatattggaattttcttttgtgtgtgtttaaaaaatgctcttattattcagttaccactggtggatatcaacaagattag

SEQ ID NO: 62055 - DNA, 1145 bp, Heterodera glycines
  Genomic contig location: Contig_ID=SeqID_31748; Location=1..1145; Strand=+
  SCN-specific regions: Sequence locations=1-96,118-223,246-946,988 -1111,1133-1145
atggaaattgtcaattctgttcgagaagcattgccactctttcaaaatccgttgccgaacaaagtcatcggattcagaagcattgcgatcgagtaaaaattgaattgaatttgtaaatgattgtgtgccattacactttcgcattattttcagcttcatcaaccaaaatgtgctcacttttctcggccgttttcaccgtttctttgcttcatgtgaaacaacattgcacatcaacaaagaaaaaagcattaaaggtcgcaaggccattattgatggtcgcattttgaagttcgttgtgctcaccatttggccaatgttcaaggacaccattcgtgtgatgtctttcaacaccaacaccttccgtcaaatgcgcaaattggccccgtccattctcgacgattgtccatcccttcgcgttgttgctttcgatggcaccattttgcccaaattgccgccttatgacagtgccagtgcgtcgaatgacaaaacggtggccaaatggctgttcacgcctcgtcccgacaatttgcggaaggttctcattatcgagaactcatcggttgagaactcagcggttgaccaatggttggcaacattggaacaaatcaaagcggtgattattaatcgactactcatatttcttttctttttttatttgtcttctttgtaggcattttcctctgcttcttctcctgtttctttcgtcatttctgttaactctaactctgagtcgtcctcttcactttcttcatttgtgccatttgaactgaccaaccaattgactggggagaaattggcactgtcacattatggaaatggtattatgcttgtccgttgtccaattggcgaaggcagtgatttggaagaggagattgaacaattgatagacggacgaaaaaacaaaattgagatttccatcacaaaggactgtgtcgacaatgggtgatcaatttaattaattcaatttgatttaatttgtttttgtttttgaagtcttctcaaggatttgcccgggccgagtggtgatcactgatcagaaacagcagaaatgaattgattggttgattgatgcgattatgtgacctaaatgttgagcgttgttatttaattgttgttgtatttgatttttgttcattcacaaatca

SEQ ID NO: 62056 - DNA, 65 bp, Heterodera glycines
  Genomic contig location: Contig_ID=SeqID_31750; Location=104..168; Strand=-
  SCN-specific regions: Sequence locations=1-65
atgatcgaaaatttgtggggtcaaattgtgctaattgcctattttattccaatctttgccgttgg

SEQ ID NO: 62057 - DNA, 674 bp, Heterodera glycines
  Genomic contig location: Contig_ID=SeqID_6572; Location=1772..2445; Strand=+
  SCN-specific regions: Sequence locations=1-343,369-674
atgatgttatcaaattggggtggacagtgcacaaaaatatttataatttgtatgagtacttgggcaatagttgggtaattataaatcaatcaaatgttttttttttattattttagattgcagcgccctaaacgcctttgaacaaacttttatcagtcccaggtccataactcggtccaaagtagtttccgccaataaattctctttgattcatgcattacagaccgagaggcgtggaatgatatatcatttgtgagatttggtttggtacaagttttctagactttttcccataacctaaaagtaccccatctatgaaccttcccaacttaaaatcagtcggttatttttttaatttttaaaaaatactgaaatgtaaaaatcccttttcaagatggggttccattctgctggtgaagactgtgctcgggttggcatggaactccttccccgacttgtacaaaaacctaatggaattgaaagtcttccaaacggctgccatttttgaagtgagttttctcagtgaaagtgtgaggtttggtggaactggtccgcttttgggagttctgtccgcttttcacagtgattttggccaccaatatttcatttgttcaaagattgttcacaatattgtcggtttggtccgttcgctggtgttcaacaccattgtccag

SEQ ID NO: 62058 - DNA, 1944 bp, Heterodera glycines
  Genomic contig location: Contig_ID=SeqID_6573; Location=241..2184; Strand=+
  SCN-specific regions: Sequence locations=1-1372,1394-1868,1890-1944
atggacgcacaacaacttcagcaaattttggacgcggctctaaaaaaatcagcagaagtttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattagatttgaagaaagaagagctaaagtgcatgattctcatcatctctttacgcgacgaattttcggatttgaaacagcgatgtcttcagcgaatggaagaagcccgaaccaatgggaaaagcatcaccctgcaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgtcgaagcaattcttcaattcgccacatccaaacggtgaatacaactgaaaggcatgcacaaatcaacacagtcatcatcgacttaaattgcatggaaatcaacgcagaccatccaaaatggtggaaaataccaatcaaagtgaatggcgcagattatccaatgcatgtcgattccggtgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgggcatgccatggatagaagctttggaggtgatcccaaaagagattatgcatccaaatcttcatccaaaaatcaatacaatttcaacgaaaaccaacgaaatcaaagacacggagacattaatttcggcgctcaaatcaacccactccgatgtcttcagcccagaattaggtcattgcaccaaattcaaggccaatctcattctgaaaaacggtgcaaagcctatctattgcaaggcaagaccagttccacatggcgctttggacgacgtaaatgccgaaattgaccgtctattgaaaatggaggcaataaaacccattgaatttagccattgggccgcgccaattctggcagttaaaaaaaggaatggcagaacacgcgtgtgtatcgatttttccacgggattaaacgacgcacttgagctacaccgccatccgctgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccatgtcagcgttaccgttcggcgtaaatcagcgcccgcatttttcaaagtttga

SEQ ID NO: 62059 - DNA, 1597 bp, Heterodera glycines
  Genomic contig location: Contig_ID=SeqID_6574; Location=17..1613; Strand=-
  SCN-specific regions: Sequence locations=1-222,271-272,303-385,430 -626,649-756,815-825,876-945,984-1168,1190-1254,1283-1314,1336 -1338,1360-1384,1406-1435,1464-1523,1546-1597
atgtttatgaaacattcgaggttagcggaaaaattttaaaaatatagcaattaatcataatattcaatttttagttcaaggcattcttcaaaagcgacaacgccgcgactgagcttgaaattccggggcaaagacaaaacggacggcgtttttgagtggggaaaatcgaaactgagcagcaaacattcggtgagaaaagcgaaataattttcatttaaaaggaataattatttaattataataacaattaatttgaacaattatttaattggaataaaaattggaaaatattttgtctctttttctcaggtcgtccgtcgtggtaaagaggtggaggtgaagctggacgggctcaagttgggcaaagaagacgttttgcgagtggtaatttaaacaaataattaatttaaaaatttaattaataaatttgccatttttgcttgtaactcctcccgccacgagtgccgccagcgctcaaattgcaggcgaacaacgcgtggcagaaccaactgcagcacaaccgcaagccgttgagattgttcaccgactccgcaagacgggcagcaaaacgtgggagatcagcttcaaaccaacggaggtgaaaatgggcatttgtcaattggaacttaaacacaaattttaaaaatggaaccataaaaatgtgccatatttaagacatttaatatttcattatttggaaagaattggttttaggtcatttaaattccgccagaagtgtttttgtactggtaaaaccaaagaaaaaatttatttgttgtttttcaaaattgttatagaacatttaaacaccgaattataccaagaaactatttaaatgacgaatttttatttcaaaaaatttaaaaggtttctgaacaaatgtgtcattttcaggtcggaacgcacaaagtgttggtgttcgtgaacaacatggtggcattttggaaataatttttagattaaatttaataaatttttaaaatgtttagccccatccccaaactccgttcccaattcgggtttatgatgctggccaaattgtggtggaagacattgtcaccgaagcgactgtcaatgatacggtggaatttactgtggacgctggcagggccggatttggaaacttggagatggccataaaggtggaggaattgttgagaaatatttcaaatattttgcacaaaaaataattctatttccaatatattaattagaaatttcataatttaaaacaaatttgaatagactttacacatttattattaaaaataattaattaattgataaaccatttttacaatacaccaaaaaatgaaattattttgaagttgtaaaaactttaaaaaataaaaataatatgtttttgtggcaaccaatcttaacgataataaaaattattaattaacaaatacaccactttctatttatttaactctaaaatattaattaatttatttttttttgccaggaccacgacggcattataatcccatcacatgtcagccaaatcgaaagcggaaccgccaaatttctggtcactttcaacccagccactgccggaacacacactgtgcacataacgtaaaatttgaataaa

SEQ ID NO: 62060 - DNA, 715 bp, Heterodera glycines
  Genomic contig location: Contig_ID=SeqID_31753; Location=319..1033; Strand=+
  SCN-specific regions: Sequence locations=1-74,257-296,320-392,416 -650,672-715
atgaaaggatgcttattaacttctttatttgtatttttgatcagcagcttaattagtattaattatgttggatcagaaaagaaaaaaatggaacaaaaaacatttgaagaaatatttggagaaaaatgggaggaaaaaagaaccgaagaacagaaaagaagagaaataattggaaaattcaataaaataaaagaaaaaatcaagcaaaaaggaaaaaaatattcaaaaagagaatgggaaaaaattgaaagaaaaatagcgaaaaaattgggcacaaatcgcaaatatatttatgaatggaccaaagaattgggattaaatcaaaagaattgctacaaatcaaaaactgatgaagaaaaactcgaaattgtacagaaattcattgaaatgtcaaatgaatttaaggaaaaaggaagaacatattcgaaaaaagaatggaacaaaaattatgaagaaatttgtaataaaattggagttggccttagaataattaaaaaatggaagaatcaatttggcattagccgaaaatttataacggaaaaagaaaaaacggagaaaatgaaaatttattggcaaataaaaggagaaaacccgaaaatgagtgacaaggaaattggaaaaatattgaaaattcatcaaaatagcattttcaattggaagaaacaatttggaaaagaaataatggaggaatgaaaaaacggatgattctaagaaa

SEQ ID NO: 62061 - DNA, 263 bp, Heterodera glycines
  misc_feature (204)..(204): n is a, c, g, or t
  Genomic contig location: Contig_ID=SeqID_31755; Location=238..500; Strand=-
  SCN-specific regions: Sequence locations=1-32,57-175,197-263
atgccttttaaaaatattccatggtcaatgcggtaaaaacgattttttaaataaatggttgaaaaagagcatggtcattacccacttcgatttgccgatccttaaataaatttccatttttaggcattcgatcttttcggcgttggcactttctcaatggaattgtttctgtcgcattcatttctttgactcatttcgctgccncgattttttgtttaatgccgaccttttgaacacaatcatttgcgaaaaatgataataaa

SEQ ID NO: 62062 - DNA, 631 bp, Heterodera glycines
  Genomic contig location: Contig_ID=SeqID_31756; Location=775..1405; Strand=+
  SCN-specific regions: Sequence locations=1-221,251-461,483-555,579-631
atggcatattttgccccttttccccccatttgtcttttccatttaatttttattttccaattgctcggccccgttttctgtgctaatgtttatttgaaaaagcaatacggtgagaacgagttccgtattgagtcatggggcaaaacgaactgttcactgaacggaattgacattgcgcagcttggaattggccgaccatgtgaagaatggccagattttggtaaaaagacaattaaaaaataattagccatttataattaacaaaaaaataaataacactttataaatgatttttaagcaaccattttctgtgatggcaaaatacttgaggtaataattaagaattattaattaattacgtttacgtaatttattaggcagtgaattattggggcgagcgaatgcttttcatgcgcgactcaaagcatttcgttgaccgtcctctgctgaaagatgccaaaaaagtggtcgatgaatttaaaaccatttttgatgtgacggaatggaataaattcgtggtcagcgaaatgaacgaagcgcaagtggacaaattggccaaatttgtccaacaaaattttggaatggccgacggtgcactgattgagtaaaatttagaagattaaaaatgaaa

SEQ ID NO: 62063 - DNA, 465 bp, Heterodera glycines
  Genomic contig location: Contig_ID=SeqID_31757; Location=145..609; Strand=+
  SCN-specific regions: Sequence locations=1-39,61-210,259-465
atggcaccgttcattcatttattttgggttatcgtcaacgatgtcaatgacaatgcacctcgtttcggacacattctgtacttggtgggttaatgagctgatttcgtattttgctaatgatttttcttaattctctccccgatcacttttcccaatttgtttctttctccgatcacttcctaatttggtccctttttcctcgtctgatcgctttccctgtcccttcttcttccctcttccatcccattctttccttttccgcttcagtccctcaatcggtcgactcccgtcggttcggtggttttccgagttcgaattgaggacccggatttggctgaaaatgcacgaaattggttctcattgagtggagaaggagttgaagaggcggagagattattttccatcgacaaatggacgggcgaaatgacactgatcagagaattgacaggggaaaaggttttctga

SEQ ID NO: 62064 - DNA, 861 bp, Heterodera glycines
  Genomic contig location: Contig_ID=SeqID_31759; Location=347..1207; Strand=+
  SCN-specific regions: Sequence locations=1-21,43-537,564-861
atgacggaaaatttaaaatgccacaaaacacagatttacaaagcaagcaaattcatgcgaggcattcaactgtcggaaagcgacaaaggaaaggcattggccgtaaaagtcgtctccacgggagttatcaatcgaaccatccatttggccaagcctacggtgatgatcaagcacgagatgaaaatgttggagtttatgaaccagcacgaggacgaaaacccgattgaagagcattcggttgtgaaattgtacggtggcggagaggtggagaacggaagtgcattcgcgatgatttacataatggagtttggtgacagcacattggacaagtatttggagcagtgggacgagaaaattggaggcttaaatttcaaggaaggcaagccgtttgagagtgcttgggccacaaaaatcaagaatgaagcgcaagagttactgcctaaactcgccgacacattgctcaaattccacaaaagtgagccaattaagcacatttcttatcggccaatctcgacacatgacagcattttttaaccttttctaatcttttaaaaatcacaaaagctcttaacactaacggtgcctctgtcggcatcagcggaccattttctttccaaaaaatgaaaataatccagaaaaaattatgaaaaaagtgcataaaactaaaacaaattttctgttttaatatggaagaaataattttttaagcccactctttagaaacaattgatatccgccgctagggaaattggaaaaatttctaattttgttaatggcttcaacaccaaaattttaaaattttgtattatttcggtcaattttgaaaaaaaaatattttgcctcgcgcctcgccagagagaa

SEQ ID NO: 62065 - DNA, 488 bp, Heterodera glycines
  Genomic contig location: Contig_ID=SeqID_31760; Location=148..635; Strand=-
  SCN-specific regions: Sequence locations=1-278,302-345,367-395,417-488
atgtcgtgcaatgtgacgatgtggtcattttccccagtcactcccgaccgtacacgtcgcaattcttgcatttgcgccccgactcccagcatcagaccgagatggacaatgtgagtacgcacataagtgcccgcctcgcagctcatccaataaacgcccatttgctgggatggactgtactcgatgagtttgcattcgtacaccgtacgaatgcgcagctgacgctttacggcggaaatgagcggcgggcgttggaacagcgcaccagtcagctaaagtcaaaaatatttgaaaacattagactttttatgtaattcagacaccttatccaatgcctggcgtatggtcttcacagattcaactgggttgtgcagtttgaaaatggcgacgtattctttgccagcattttgttgagactttgccagacgagtggtgcggtcgacgcacacaacgagaacaccggaaacctatcatagaaaaaaaataaa

SEQ ID NO: 62066 - DNA, 591 bp, Heterodera glycines
  Genomic contig location: Contig_ID=SeqID_6575; Location=796..1386; Strand=+
  SCN-specific regions: Sequence locations=1-286,347-591
atgcgtgccgaacgggtggtgacgatggcggcggcaccgaaccaccattaccaacccaataatgccacggacgatgatgaagcggtggatgccgacccggatgttgccggctcactgagccaacgcgcggcggagattgagaagcggcgcgagtggcgccatgcccgcctgcgctccatggacgtggaatcgaagcggaccgatgagctggtgcgcatgattaccgccgcagcagcggccgccggtgcagcgggcaccgcttccggcggcaacggtgccgcgacggacagtaacaagaacaacaacaatggcaccggaagtgccacagcaacaacaacaacaacgagggcattggcaaatggaggcggaggaggagcagtgaactttggcaccaccgcgccaacgtcgacaccgacagtaaacccatcctcaaacaacagcaacagtacaccgtccccgattccaattgcaccctaatttgatcactaaatgcctattaatgctcgtcccgcaaccgggcgaccatgttgcagtgcaagtcgaacagctccaggctgacgagacagtccatttttgggcggctgcaaaaaa

SEQ ID NO: 62067 - DNA, 224 bp, Heterodera glycines
  Genomic contig location: Contig_ID=SeqID_31762; Location=395..618; Strand=-
  SCN-specific regions: Sequence locations=1-101,125-224
ggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccctttgcctaaccttaggcccatctgaataataaaaaactcaaattcgagacttggacattttgtgg

SEQ ID NO: 62068 - DNA, 173 bp, Heterodera glycines
  Genomic contig location: Contig_ID=SeqID_31763; Location=474..646; Strand=+
  SCN-specific regions: Sequence locations=1-173
atgcccggcaactccgtgatcgatttcaccactccgtcgacgcccgttgccaaccaaacactgatcaaaatcgccattttaaccgcacaaaattccactgattttgggttgccaagaaagaactctgcgctgcgcgattcgggcggcgccattccaatggcattggagcagct

SEQ ID NO: 62069 - DNA, 800 bp, Heterodera glycines
  Genomic contig location: Contig_ID=SeqID_31765; Location=46..845; Strand=+
  SCN-specific regions: Sequence locations=1-800
atgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccacacattgacacgtgcgacgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccatttaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttaca

SEQ ID NO: 62070 - DNA, 496 bp, Heterodera glycines
  Genomic contig location: Contig_ID=SeqID_31767; Location=874..1369; Strand=-
  SCN-specific regions: Sequence locations=1-496
acatcatgacgctgatgcaccactggtgcctgctgcacatttgtgctggctgatttggctggggaattgcatcccccagctccgagaggcctaaatccccttcaatggtgtcgacaagccctcgggcttggtcgacccaatgcatgaaggccttgccttctggtttgaagtctctgtaattttgctcttcatcttgaagagcttgtcccttcactctcaggaaaatggcttcccattttccattgtatttctcaagaagagaaatggttttgcagagattttgtctctctgcaattaagtctgcacggacactttggtccgtcagctctttgcccaagttttcttgggctgtctcaatgtacatcttgagacgcaccaccattggtgcaatggagatacgcaagagctcactcattgctcttacgcttgatgaaaacgcaataaacccctttgggttgtgcgtttgatccaagcgctacggttgcgctttggattg

SEQ ID NO: 62071 - DNA, 867 bp, Heterodera glycines
  Genomic contig location: Contig_ID=SeqID_31770; Location=317..1183; Strand=+
  SCN-specific regions: Sequence locations=1-66,246-753,775-867
atgggacaggattctggtactaatggtaacacgatcatatgaaatattaagaaaatggaataacactaattatcaaataaaaaattcatttaaatttcatttttttctatgaaaattttcatttaaattaaaacgaattgaaacattttaataattattaaaaaataaaaaataatgaaatattaaaaaaatatatattcaataatatatgaataaacaaaggtatttaaataatttaatattttgttccttataataaattttgacatcaattaaaataaaaatcttttcgattgaatcattatttttaaataattaacctaataaaattgatcagttgttcctaattaacagatgtccaattaacgttggtcaacggttgtccatacaaaatttatgttgccggtgcggtgcaagtgaatttgacggtcaatgaaagacaaacaaaaaatgtgccgtcagtgagcacagcgcaacgattatgggccaacactgactgtgacagcgaagtaaggaataattgctcaagagtcgagttctcgactctcttggtcaattcccgattttaaatattaagacaaatttcgggcccaggttcattctctctatttgaaaaattgtcggtctcgacaataatcatcattattggaaaattgttggtcttatttttaggggaattctcggtattggacaaattgtcagtctcaaggtaattctcattcttgggcattatcagtatcaatattgggacaattctctgtatcaactcttgagacaattacctgtcttggaataattgtcggtcttttttttggcaattctcggtctgggttaattgtcgatctcgagaataattctctttcttga

SEQ ID NO: 62072 - DNA, 471 bp, Heterodera glycines
  Genomic contig location: Contig_ID=SeqID_6578; Location=539..1009; Strand=-
  SCN-specific regions: Sequence locations=1-8,83-471
atggacagagacagacagacaaatggacagagacagacagacaaatggacagagacagacagacaaatggacagagacagacttggagcgttggaacaacgaatggccaacgactgcaatggccaagccgaaagagacgagcacaacgaacagaacggcgacgaacagggcgaagttgatgcaaatggaggaagtcaactcattgtttgttgttcgacctgagaattgggggatgtattaaaagaatcgtgcataaaacaaaaagtatttgcgaagttttcgacaaaaagagaccaaagaatgctccgacaaaacactcaccacgcaatttcccaggcgctgtgccaacgcccgcttttgctgccgcaacggcgccgttgcgctctccgtcgtcgtcgtcttcttcaccctcaacgggttcgtccagaacgaacacatattgagaaatcaaatctgcatcgaccgtcctga

SEQ ID NO: 62073 - DNA, 226 bp, Heterodera glycines
  Genomic contig location: Contig_ID=SeqID_6580; Location=109..334; Strand=-
  SCN-specific regions: Sequence locations=1-140,162-226
atgccaaagcgcggctttcgcttcgctttcgaattgcctcccaccgctcccccggccgttcagacccattggctgcagcagcacgtggcgcagttggcccgtccgcacgtttgcgtcgactgcgacgccggcttcaccaccgcgagaagcgttgcgtgcccacagggaaatgcaacacgcggaaaaaacggcgcggaaggaacagcgaatttcgagcagaaacgaa

SEQ ID NO: 62074 - DNA, 1793 bp, Heterodera glycines
  Genomic contig location: Contig_ID=SeqID_31773; Location=1..1793; Strand=+
  SCN-specific regions: Sequence locations=1-54,78-536,560-669,705 -738,839-981,1004-1006,1045-1063,1085-1279,1301-1467,1490-1793
  Gene Ontology: Mol. function=phospholipid binding; Cellular component= nucleoplasm; Biological process=skeletal development
ctgaaaaaggagttcaaaagcgactttgaagaactgatcttctttataaaatgcaaaaacagccatttaaatttaaatttactaagcatttctttgatgcaaacgcccgccgtttacgatgccaaccaaatgcgtgccgcattgtccggctccaatgagtgagtacatttacaattgaattgggataaagcgcatgggaaagaacttcaaaaaggaacgccagtagctcaacaggtttaagtgatagattacggtataaacgccataatgaccacaggagaaacttagctatttgttttggctaaatttaatgttcatataagccatcgaattgatggtggattctggttacagtttacctcatggcttaccgtatatacatttcattacggtgttaccgtagggcggtgctaatcgaaattttggcgacgcgcacaaaccgacaaattacggcgctgaagcaggcgtatgagcagttggacagaaggcatcagcacaatcagctggaggaggacatcaaagcgaagacgaagggctccttccaaaatctgttggtgtctttgctcagctgctctcgcgaagaaagtgcgcccgcaagcattgtattggcacacgacgtaattagtggcaatgaattaacatatacatattaagtggcaaattagaatgaattaataaaataattacaattaacatataataaacaaaacatatcacacggctaattacatggattggaaaaaaataaaattattaattagtatattcaatatcacatatatttaattatatttataggtaaaaaacaaaatatagaataaataataattattattttggtggtgataatttccatatatttttctcttctgcaggaggccatgaaactgttcagagagggcgagggccgacggggcgttaacgccgtggtgttcaaccaggtgttggccactcgcagcttcgcccaggcaaacaaaacttaacaaagcctttgccattaccagacaataattaattaaaataaaatataatcaattatttatagttgaaaatgtttcacagttttaacaatttgattgcaaataatttgttaaaaatttcagcttcgggaaactttcgagttttaccgacaagccgcgcaccacgagattgaggagggaattaagcaagaattcagcgttcacaacgaaacggggtaatgggagaaggggcgggaaccaattagtgatgatattgtacacgagaggagacagtctaattaggctaattggatccaatgtttataaatatttggatttttaatgtcatttgctgttaatgctttcattttcagtttcttggcactaatcaaatatgtccgcaacgcttctgtgttttttgcggatttattgttcaattcgatgaaaggtaaatttaataattaatggataaatcaatatctattaatcagaacaatttacttatttaactgcattaattatttattaatctctctgctttttcagggctcggcacacgcgactcggatttgattcgtctggtcatttctcggtctgagattgacctggctgacatcaaagtgctttcaaatttaaattctgttaattgaatgttcaagaaatcaaaagccttaattaattcttatttatggatttaacaataatatttgtcatcccattaagcacgcttttcacacgttgcacaagaagagcctggaggagtcgatcaaaggggacaccagcggagcttaccgagacgcacttttggcattggtcaagggcaacacggagcag

SEQ ID NO: 62075 - DNA, 696 bp, Heterodera glycines
  Genomic contig location: Contig_ID=SeqID_31775; Location=155..850; Strand=-
  SCN-specific regions: Sequence locations=1-26,48-169,214-396,437 -581,615-634,661-696
atgtgtgaaaaatctttggtctgctttgattctgttatgaacattttcggattgttgctgcttctctctgccggcgtcaactcacaaatggaaacaataccgtaagataattttaaaccgtaagataatttgaaacaaatggcaaagttactatatcacccagcaatggttaaaaataaatttataaataaaaatttatatttaataaattttcaaatatgtatgtaataggattcgattgactggccaaaaaagcagctgggcaaacatacaactcggcctttttgaccaatgcctcccatctgaggaatcgaaaacattcggcatcgaatttcgtctcccgaagaatggcggaagctgtgacaaagaagggtcagcagattgcgaaattaagcgaaaattaaaaaatatttatatatatatatatttaaatattccattccaatttttagtataagcatttgctacgcgagcacattaagcagccgaacactgaatgttatgcacaccgctgatgaattttcggtgacctccgagctgttcaatgtgcccgaaatggtcagagttttgacggaacatcgaacaattgctgattttaaaaaaggaaatttgttctatacctggcttaatcaaaaattataaaaccatttttaaaaatagtcctcaattttattacgaaactttaattgaattaaa

SEQ ID NO: 62076 - DNA, 729 bp, Heterodera glycines
  Genomic contig location: Contig_ID=SeqID_31779; Location=1047..1775; Strand=-
  SCN-specific regions: Sequence locations=1-93,219-271,314-357,385 -397,420-448,556-556,588-594,623-729
ccttcaacgcaaccaccacgaccctcctacacgtcatgcctccccctgagcgacaagcacgtgtacaagccaatgacggtggcttataggtgggccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgggttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatcttttcgggtctcagcgcatacgctctgtctccgccccatcgcatgcgatcgagacgggactatgttgcgccccacaccgcagtggcagggatcacacatcagctccgtaagaaacct

SEQ ID NO: 62077 - DNA, 565 bp, Heterodera glycines
  misc_feature (54)..(54): n is a, c, g, or t
  Genomic contig location: Contig_ID=SeqID_31780; Location=425..989; Strand=-
  SCN-specific regions: Sequence locations=1-44,83-89,194-288,344-503
atgaataatgtgcagcaattaaggtaaaaaaaaatggcacaaagattttatttntaaaagttttattgaaattaaaaattttcaccgccaaaattttaaaaaataaattaattaattaacttagaaatttttcaacaaaaatcttagaatttttttataagaaaattttaagaaaaagattttaaaaaattttcagcgattttttttcaaatttatgatgaattattaattcgagaatgtttccaaaaaatcgtaaaaatgtttcaacaatttttccttggaattttcataaaaatttttttctgatttttattcttttaaatttctaaattaaaaaaaaattccggccgcgaaattttggccggcgaatttaatgtaatttttttaattttgaaattttagggtacaacttgagaaaatttacgagaacatgggtggaccaaatttggatgcggattccaacaaagtattgaacaatttgcagaaaaaggtgggggaccatcaaataatttaaaattattaaaaaaataattttaatttttttaaatattttcaaaaaaataaa

SEQ ID NO: 62078 - DNA, 1116 bp, Heterodera glycines
  Genomic contig location: Contig_ID=SeqID_6585; Location=564..1679; Strand=-
  SCN-specific regions: Sequence locations=1-246,269-374,415-652,674 -1116
atgcacgatcttgatgaggaaagtagagcaaaagtgaaagaacgatttcaagcatggaaaattggtggtggtattgttggtagcggtagttcggcaggttacggtattcccgctcttggtagcccagcaggacacagtggtaccgtatatggtagaccgcacctagacagggcggagagcagcaaatcggcggagcagcgtgcaagagctgcggcggcacaacaaaaaaccgaaagcgagaagcacaaaaaggtggaaatgcaagaaagcaaaaagcgagaattgcttgtacttaaaatactcaagaatttggtggttttttaagtttttttctgaaaacacaacagaacaataggcttgttttccaaggacccataaaatttttactttttttcaatttataaaataatttttcattatgactcaagagtggataaaactctcgtttttcgcggtaaaatgcgaaaacgagaacccccgccccccaaaaaaaaaggctagcattaatttttcattccgatcacaattcataattgtacatcataaaattctcgcaagacgcataaattatgagaacgagaattcgagaacgagaacaaagtcccaattcataaaagtacataaaattgttgcatttcgcgctaaaatgcgagaacgagaaccccccaaaaaaggcgagaaagcgagataccagaagccagatgagcaatatgcctgtgctgattatgctataaaataacattattaatatttttcatattaagcaaaccgatgctgaggacgaatcagagaatggaagcgaattggatgattttgaaaaagatatttttggtggaatgaattcagataattatgatgaagcacttttaaacgcacaattaatacttcaaagtgaaaaaaaagtagcaaaagtggtcaaagcatggaagaaactgcaacaaaaaaagcaaaacagtcagaggacggtaaatgactggaacagtaatttatttggctggggtaatgcggagcaacaggttaattagtgatatgattattacgatatatgctgttattacggtgctgagtcgtttcgaaattcagccatcattggcattccataaattcgccaataaa

SEQ ID NO: 62079 - DNA, 512 bp, Heterodera glycines
  Genomic contig location: Contig_ID=SeqID_31783; Location=513..1024; Strand=+
  SCN-specific regions: Sequence locations=1-122,150-369,391-436,459-512
atgaccaatttttattgcttatatggtttgtataaaactattcaaattttcagggaatatagattaaacttcaaaatttcttatggggatattgtaaaaaacgaagaatttttgtgtaaaccttaatttaaaaaaatattattatatatcatattagtattttcgctttacaattttttgttataccacttcaggaccaacaacatgtatcggcactgcaaatgagaccgcggttggaaaaattatgagatttcataatatagatgacattgaaatggggccggttaagcatgatttttcacgtgaattagatgaaatgggaaaacggaacctgattgaaaaagcattgagattttatagttttaaaaccagagttcccaagtgtgcttatttctaagatttgtgcttattttgaggggtcggatcttagaaagtaaaaatgtgcttatttctaagatttgtgcttatttcagcgttacgtgcttattttgtgcttatttttggatttgaaa

SEQ ID NO: 62080 - DNA, 538 bp, Heterodera glycines
  Genomic contig location: Contig_ID=SeqID_31786; Location=480..1017; Strand=-
  SCN-specific regions: Sequence locations=1-103,136-180,211-538
atggtgttgctgctttttgagggttgcgtcgtttgcgcaaaccaaaaaatgactgcatcgctgtcacttcgccaatacatgccagaggtactcaaaaacaaaacatttatttatcaatttttatgattttttcagggactgttgaacgatacgtgtgaagcataagttaaacggccgacgtaaaaaaataaacaaataaataaataaatatttgttttctttgttttttagcaatgcactgtcgggggtgaagcctggcagctttgcttcggtattacgctgatggaacggtacggtaattatgtgcagtaaaacacgcactattattgtaaaaattcatttttgtcacataaataacataaaaaatttcaattggaaaacagaaaaaactgctgaacaaaaaaaatttttaatttggcaaaaattcgtcttttttagcctctgtgctgagcggaaaaccaccgaacccgagccaaaagagaacgcaaccacaccggcccccgtatatgacatgcaacagctcaagtaaaaaaataaa

SEQ ID NO: 62081 - DNA, 548 bp, Heterodera glycines
  Genomic contig location: Contig_ID=SeqID_31786; Location=1065..1612; Strand=-
  SCN-specific regions: Sequence locations=1-145,167-548
atgtacggtctcaacaaaacagaagggccggaggaaaacttcaagaacatgaccgagttcgacaaatacggcttcatgcatggtgaattgttggcattgaaaaagccattgaacatcataaatttgcaagcattggaagagaagctaaaaattaatttattaaattctgttttcaattgttgaaattattaattttccaaaaatgcttaggacatttttgaattttataggcgtttttgtaacaaagtgcactcaaattgtctaaaattttcccggcggcgcctatcggcaccgccggacccccaatttactttagttttttggaattttagccacaaaattgccaaaatttgacagtttttgacgcaaaaacggctacaagtccctattttttttgctctcgggtgctgaatttttaatggaaaaattttttttgcccgaagagcaaaaaaggtcttcaggttccccccccccccaaaatttttctggctacgggcttgataacaattttaaagactgactttggcacccaaattgaatcgaataaa

SEQ ID NO: 62082 - DNA, 416 bp, Heterodera glycines
  Genomic contig location: Contig_ID=SeqID_31787; Location=17..432; Strand=-
  SCN-specific regions: Sequence locations=1-416
atgcccaagtgtttgcgtcgggtggtcgccgcttatttcttccgccgggcaaagtcagtccctttgactgtttttcgtgccattgctaattttgcctctgttcaaattcaaaggcgtcacctacgaaagagtgccgccctcgagggctgtcgcgtgccgaactccgtccaatgggtgttccatccactcgcccggcatttcctttcgtgccccgtgcgcgtcggcacaattctctcacaaagcggcgtgcaaaagacgccgaactttcccttctccgctttgactcagccgccaaaacctttggaagtgcttaaagaggcgttcaaaatgcatttgctcggccaattgttgtgccgattggaaagtgcggacggacgcacacttcgactggcggactttgtggagcagtcgcaact

SEQ ID NO: 62083 - DNA, 388 bp, Heterodera glycines; identical to SEQ ID NO: 51536
  Genomic contig location: Contig_ID=SeqID_31789; Location=88..475; Strand=-
  SCN-specific regions: Sequence locations=1-20,42-275,297-388

SEQ ID NO: 62084 - DNA, 1270 bp, Heterodera glycines; identical to SEQ ID NO: 31790
  Genomic contig location: Contig_ID=SeqID_31790; Location=1..1270; Strand=+
  SCN-specific regions: Sequence locations=1-35,57-120,143-318,490 -617,646-1145,1168-1204,1226-1270
  Gene Ontology: Mol. function=purine nucleoside transporter activity; Cellular component=integral to plasma membrane; Biological process =purine nucleoside transport

SEQ ID NO: 62085 - DNA, 1020 bp, Heterodera glycines
  Genomic contig location: Contig_ID=SeqID_6587; Location=4609..5628; Strand=+
  SCN-specific regions: Sequence locations=1-69,91-267,290-305,328 -636,664-681,769-887,910-1020
atgcgtgtctgtgacccgttgtgctcgctgaatgggccatttcatcttgttgcggtaagttaattacacatgcctgggcattttcatttatacaacaattattttcgtgattttgtccatttaattgtgattaatgccaaaaatgtgctaaaacccaaaaaattgccaaaaatgtgctaaaaatgcatgaaattgttcgggattataccgaattgttcgggatttcgaataccgaattgttcgggactcccaatcccgaaagttttctgatcacccttttggctttgaagccgactgatcagtcagagtgattggtcccttccagaaagcactgctcccttccaaccgatcactccaattggccgccaatttgtcatcgtcgtcgtcggcgccactgctgctcgactatccgatcgcttctttccatggcagtgatctgttcctgggtggccatattctgggcgttcaaactgccagtaggttccgtccgatcacttatcacgtgattttttcaacaatcagatttcgagcagtaaggcatacctaatcatttcttacagagctgatcgttcaccccgaaaattttagaaattcaattttattgcaatctagaaaattcagatgacgttttgaaaactctttgtaaaaatacaaaaaatttctcaatgataattgaaatccttaataaaaattaaataaaattctacataaaattttttaggaaatttttgaaatttaaataaatctttaaaaaattacaaaatttttcctagggaagaatgtaaagaagtgaggacagggggcttcttattttttgttttcctaccacatggcggtttttaggaaacgacctagcacctcttacagagctggtcgttcaccccgaaaattttagaaattcaaaattttcaacgattttttgagacctagaaaatttagattagtgaaaatatttcactgaaatctcttcctaaaaatacaaaaatttttcagagaaaattcaaattttcattataaaaa

SEQ ID NO: 62086 - DNA, 138 bp, Heterodera glycines
  Genomic contig location: Contig_ID=SeqID_31794; Location=1197..1334; Strand=-
  SCN-specific regions: Sequence locations=1-138
atggcacgccttgtgcaaatcgcccaagtggtccacgacgagggcattcatcagccattggctgttcaactccaacgttcggattatatggcacattgggacccgtcagatgggagcatggcactcaaacaggtcctg

SEQ ID NO: 62087 - DNA, 87 bp, Heterodera glycines
  Genomic contig location: Contig_ID=SeqID_31797; Location=1861..1947; Strand=+
  SCN-specific regions: Sequence locations=1-87
atggatgaaaatgcggagccattgcatccaccaaatcctcttgaaattggaattattggcagcagtgccaacaattcgttgtcagag

SEQ ID NO: 62088 - DNA, 439 bp, Heterodera glycines
  Genomic contig location: Contig_ID=SeqID_31798; Location=1..439; Strand=-
  SCN-specific regions: Sequence locations=1-338,363-439
  Gene Ontology: Mol. function=protein binding; Cellular component =cytosol; Biological process=signal transduction
ttcgcaatgagtgccgctgcgacccaacgtcttcaagcgaagcggcaaactttggacgaggcttatgctcccccagccaattttttggagatcgaagtggtcaatcccgtaagcaatgcttagtgtggcccgttgtgacctttttcagcagatcactcacggggtcgggaagaaccgatacacggactacgaagttcgactgaggaccaacttgccggtgttcaaacacaaagtgagtcgttttggcattggcggctctgtttaaattggagtgtttgtctcccttctcaaaaggagtcgagcgtccgtcgacgttactcggacttcgaatggctgaggaatgagttggagcgagacagcaaagttttttgttttcatttttgttccatctgtttcgtcagataattgtgccgcctcttcccggaaaagccttcaagcg

SEQ ID NO: 62089 - DNA, 867 bp, Heterodera glycines; identical to SEQ ID NO: 31799
  Genomic contig location: Contig_ID=SeqID_31799; Location=1..867; Strand=+
  SCN-specific regions: Sequence locations=1-458,483-555,577-791,823-867
  Gene Ontology: Mol. function=proteasome endopeptidase activity; Cellular component=proteasome regulatory particle (sensu Eukarya); Biological process=proteolysis and peptidolysis

SEQ ID NO: 62090 - DNA, 4170 bp, Heterodera glycines
  Genomic contig location: Contig_ID=SeqID_6588; Location=2205..6374; Strand=+
  SCN-specific regions: Sequence locations=1-246,268-498,521-881,915 -2738,2760-4170
atggctggcggtggcggcaaagcggcattcaacctgttcgccagtcgtcaagaccaacacggtccggcagcagcgcagatgctgactcgtgccggcattgctgccaacagtgacatgtacacgctggacgatgtccaacgtctccagcagtggctcaacaatcagcatggtgtgggccaaattcgcctggcggtgtttgaaaaggagcaggaataccgcattgtattcaaaggagatgggtgagttttttatttcttttcttgttttgggtaaattagttaattgaagattggcggcgagattcaacctttgccttgtgttggagcgtggccacttcaactacattggaagagttgagcagctgtttgatgtgcccaactactgcatcgactgcgagcggagggctgacgcgcgttaccacgcgttcggatgcaaagttgtgtgccgcctttgtttgcggtacgggcctggttatccatggcaaactgaacaggtagattaagctccaaaaactacaaaaacaatagcaaaaaaaacccaattaagctaccgaatggtggaagtagtgctcgaaagtgcgctgaatgtctgttcatcttcccaaatggtgggtgctatgactaccatctcagcaaccactctccagctccgatggacggccgtggtcagcgacaacgtcggcccatctgtcaatggcgccgggtgtgtcgtgcgtgtggacgtatcgcctacgtggccacacatcagtgccacatgaccagccagccgacgatggaatctgtcggcgctgcaatgggccccacaccgtcgatgagccttgctacatccagcccattgacgacggctcagttcgacaacgtgcatcgattgctgttgacaacgacgattctgatgacgacgacgacgatgaagaattgccgcttcgtctgtgcttctttgacgctgagacgtcacaggatacgccattacagctgaacaaccgcaccgtccagaagcacgtgccgctgctcatcgtcgccgaagtcatctgcgaacgttgtctgcaggctggcatcagcgtgagcgatggccttggaagacgggctcctggctgcgtctgcatgacaggaatggtgagaggtcaactgtttcgccagtggtcttcgccaccctttgccaatgccccgggagacaacagcgcttcgccagttggagcaccagcgttcaatcagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaggcactacaccgccgaaaccgtccacccaagcatctgtgcaccaccggattgaagatctactcgatgcgtctgtccgggcgtaaccaacgacgaatcacgttcaaggattccatcaactactttttttgtgccttggacgcgttggtgaagagcttccaagtgccggaccatctggcgacggtgaagcccttctttccgtatctctacatacgacgacaacatctgtcacagcgcctcaacggtctaccggctcaagagttctacgcaccggacacgatgaaggcagagaaacgggcgcaatttctccgttggcacgccgacaacaacggcaatggattccagctacgcgagcagctcataatgtactgcgtcaacgacgtggccattttgagggagtcggtcatccgattccgccaactcatcgccgacaatactcaaggcctcgacccattcctccacgcgtaaacagctgctggtcttgcgctggcaacttttcgccgctgtttcctgcccgccaattgtctggttcactcacccgagggcggctacttgcgcggacgccgtgcttcggcagaatcgcagcgctacatcctcttcttcgagctggagcacccggaggcgcaagtgcagtgcgccagctggtcggtcggagaggcgcacattgaggacagtggctaccgcgtggacggactttggcgacgagaagcgcctctccgtcccctggccattgaatggcttggatgctattatcacggtaaaggcttttttccgtttccaaaatatcttaaaattgaggctgtcccgcgtgctttcccgaccggcagcaacaattggcggcggggcgaacagcggaagatttgtacgaacggacggagcggcgcctctttgagctggagcacgaccacggctgcgaaatccacaaagtgtgggcctgccagtggacggagcggctccgtcatgacccagacctgaaacgccgttacgatgctgtgttcgtcccgtgcccgctggacccgcgcaacgacgcactgcggggagggcgcactgaaccgttcaagctccaccacgtgtgcagtgacgacgaggagataatgtgcattgacattgtcagcctctacccatacgtgatggtcggtttttgttttaaaatattcgcatattcatgatgaaaagcagaaggccaaccgcttccccgtgggcaacccacgggtcctgacgcgcgaggtgttgctccgtccgccaacggcaccgctcccgtggactgcgcccgaaaacaacatcttccgtgggttgctgctcgtccgggtgcttgccccacacaacatccgggtgccgttgctcggctaccgcacaaaggacgggcgattcactttccctttgtgtgcgtggtgcgccgaccgtcggcagcagcggccgtgccgacatgaagacgacaagcgctcgtgggtgaccgcctacacccacgtggagcttaacaaggcactgcagctaggctacgtggtcaccgatctttttgaggttgtccactcattaaaattttgagttcaagaacacaaattaggtctgggactatgacgaatgggacggcacgctgttcagcagctacgtcaacaccttcgttgggctcaaagtgcaggcgacgggctggccagaaggatgtgtgacggatgagcagcaaaaggcatttgtagacgattttgagcggacggaaggcatccgcctggactcgaccaaaatggagttcaaccccggcctgcgcctcatcgccaaaacattggccaactcgttgtggtaaatattttagggggtgaaaatttaaaaaaaaaaattgcatccacagggggaagctagcgcagcgcgtgggccagactgagattcgctacacgcggactccggctgaattccacgcgctcctcgacgacccaacggtggacaagttggactttgtccacgtgtcagaacacatggaccgctgcgtcgtgcggaagcgaccggaattcgccaaagccccgctgaccaactgccttccggtcgctgcgtttgtcacctcatacggccggcttcatctttacgactacatggagcaggtgtcagccatcgtcggtgcggagctgctctactgtggtatgtttatttgtcacgaatggttttttttggacagccctttgttttagacaccgactccatctactacgtcagcaagatgggtggtccgtgtgtagcagagggcgaggctctgtggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacctttgaggcgatgaaagacctgacgctggccacttacaacattgacggcccaatgtgagtttttaacatatcattcttttacataatattaaaaaaattgaattttagcgatgatgctttagacaatgacgacctttacgtgtacgggggcggcgaacatcgtgccatacgcgtcaacttcccgcaaattgatcgcaatgtgtacgccgatctctacacgcatgaggcccacaaagactacaggcccttctatgccaaggggcgcgttcggcctgggatgcagacgcgtccctttggctatctggaggatgatggacagccgaacgaaggacaacggacgcatcgacgaaagagaaattttgtggagcaagatcccacacagcccggacactctgggtggttctga

SEQ ID NO: 62091 - DNA, 898 bp, Heterodera glycines
  Genomic contig location: Contig_ID=SeqID_31802; Location=465..1362; Strand=+
  SCN-specific regions: Sequence locations=1-10,34-278,300-303,325 -332,363-491,786-898
atgacttccttcatcatcattaccattgcattcagtttttgtgccatttcgatggctcatgtgccgttttggtgggagcagctaagcgatgcggaagagcaatggaggatcaacacaagtaaaaaattggattacaacttttaaaactaagatattaaaatcggggaattcattgaaaaattcttttgaattttttttgttgaaagaaatcatcaagcccatttctgaaaggctggctctcggaaaacgaaaacgcagaaaaacaatatcaataaaaatctgaaagaattttctggaaattttttaatggcatttctgggactgaaaaagcttaatttgaataaaataattttcaatttttaagcaatcaacgaatgctgcccaccagccacatattgttgcgtcaacaatctgttcgtgccgcgagagcttgacgaaatgggaatggacaggtgcatcgatgacggcacaatgggaaaggtgaaaaacattaaaaaaataagaatttaaataaaatttaaataaattatacataaaataataatttaataaattatacataaataatcatttacataaataaattttgcaaaaaaataatcatttgataaattatcgataaaataataattaaataaattatacataattaataatttaaataaattatacataaaaataaaattttaaataaattaaacatgaaataataattaaataaattatacataaaaataataattttttataaattttgcataaaataataatttaaataaatttttgcatctaaatttattggattgaaaaaaaaacaaattattttaggaacaaagttacaacaccatcaaatgtgcgcaacgcaaatatttgggtgacgaatcaacggatatttgcc

SEQ ID NO: 62092 - DNA, 361 bp, Heterodera glycines
  Genomic contig location: Contig_ID=SeqID_31803; Location=160..520; Strand=+
  SCN-specific regions: Sequence locations=1-41,64-361
ggcgcttttggttgtgttaacgaagcgaagtggaccctaagttgtgcgaaagaggcagagaaacagcagggcaaaaccggaaaagcgagcaaaagctcgaaaagggtcggtcattcagcctttcacacctccaaattcaatgcccttttctgcaggtggccattaaaacattcacaaattttgctgacatggagaaagaagcggtgccttagcctgtttactattcgaattccgaattccctaatttttagggtctgctcaaacagctcgaccacccaaatattttgcgaatgtttggtgtgacaaaattggatgacaaaaacgcaatggtcattgagctgatgaacttgggcgatttgaa

SEQ ID NO: 62093 - DNA, 388 bp, Heterodera glycines; identical to SEQ ID NO: 51536
  Genomic contig location: Contig_ID=SeqID_31807; Location=338..725; Strand=-
  SCN-specific regions: Sequence locations=1-20,42-275,297-388

SEQ ID NO: 62094 - DNA, 440 bp, Heterodera glycines
  Genomic contig location: Contig_ID=SeqID_31808; Location=370..809; Strand=+
  SCN-specific regions: Sequence locations=1-167,190-440
atgccgtataacttcgagactcttttgccgttgtgttccaatgaaatggatgcgcccaatcttatgaacgccgcattattcatcgtgaaaagcactgccgatgtggtacagaaatgcgccgctctttcgcgaactcccatggaaaagtttaaaattttacaagtaactttaaatttttcatgtaaaatgcgttatggcttaaaataaacatttttcgtgctcacaatcagcgcataaaattatcctagaaaaaaattttgaaaaaaaattttcaggggagtgacaaaacggataagcaccgaaaattttgtcctattttaacggttactccacatttgcgccccggacatttgcgccccaaaggaaaatcggacatttgcgcccggacttttgcgccccgacatttgcgcctcagacttttgcgccccagtgaaaattag

SEQ ID NO: 62095 - DNA, 2835 bp, Heterodera glycines
  Genomic contig location: Contig_ID=SeqID_6590; Location=109..2943; Strand=-
  SCN-specific regions: Sequence locations=1-8,30-206,235-321,343 -763,785-940,962-1111,1133-2109,2132-2222,2244-2489,2511-2835
atgtttgaaaatgtggaggaggcagagaaaagtggcacacggatttctctcggacaaattgaagaagagttgaaagccatgcagcttattaaggacagtgcattggctcttctttcaccgccaatctcaacaaatgccatccaacttcgtccacaacaatggagagagcccaaatcaaagaaaggcaattacaattctgggaaaacgacagcaaaccagcacacaacgggaggcaaagcaaatcaaagaaagccgacctacccatgtggcgcttgtggaaattctgatcattggcgatctgattgcagatttttcagtgcaatttgtcataaatgccaaaaacagggacacatagcaaagatgtgtccccaaagatcagcttcgacatcaaattcaagacgtcaaaatcgggctgtgcacacagtcaaagtgacaagccattgcttgaatgtcggactgaatcgcggtcattggtggaagcttcaagtgaagataaatgacaatgattgtgagatgaatggggacaccggagcccaagcaacaatcatcacaatccaaacatggattaaattgggaagaccaaaattggaactgtcggacattgaaatgcataattgtaatgaggaaccatttcccaccgaaggaatgtttcaatgtgtcgtcagttgctttgacaagccgccaaaaaggctaactgcatatgttagcagtgctgtcaattacaatctctttggattgccatggattatggcttttgatctgatcccaagggaagtcatgtttcctaaggttcagcaaaaaaagatgtgcgagccaatcagcatccatgccacattggcaccaatgccaaaggcaaacatcaaggacgaagcatcactgattgaggctttgaaaacggatttttcggaagtttttgaaccaggacttggcgaatgttcgaaaatcaaggcacatcttatcctgaaacaggatgccaagccaattttctgcaaggcacggccaatcccacacggtgcaactgaagccgtaaacgctgaattggaccgacttttggaaatcggtgccattaagccaattgatttcagccattgggctgcaccaattctcgccgtgaaaaagaagaatggcaaaacaagggtttgcatcgacttttcaacagggttaaacaatgccctcgaattgaaccgacaccctttgccgagaccggatgatatttatgccgcactgaatggagcgtcatattcctcaaatttggactttagggatgcctatttgcaaatggagttggacgaggagtccaaggacctttgtgttatcaatacgcatcgcggcctattccaatgccaacgtttaccttttggagtaaagtcggcaccgtccatttttcaacatcttatggaccaaatatgtgctggaatacccggcgtgtttgcctatctcgacgatgggctcatcgcttctaagacgttggaaggacatatttcggcactttaccagcttttcacgaaaattaaggaatttggcctgcgtattcagttagaaaagtgcaaattcttccaaaaagaattgctttttcttggtcatattgtgtcatcaaaaggcattcgtcccgatccggcacgttctgaagcgatcagcaaaatgcccgcgccacacgataaaacgtcacttctatcgtttttgggagcgcttaattattatgggcgattcgtgaaaaaaatgcgtgaaatactcacaccgcttgatcagctcctaataaaggacgaaaattggaattggagcgaagagcaacagaaggcttttgaaaaggcgaagaagatcatgacttctgatctgctgttaactcattataatccggctcttccaataatcgtggccgctgacgcatccaaaaaacgtattggcgcaacgattggccacgtttttcctgacaaatccgagaaagtgatcgaacacgcatcatgtgttttgtcaaattcccagcaaaattacagccagatcgaaaaagaagcattggctctagtgtttgcagtacagaaattccaccgaatgctattcggcaggaaattcaccttatttactgatcacaagcctttgcttgccattttcggttccaaaaagggaattccggtttattccgccagccgattacaacggtgggcgttgatcatggcaaattatgatttcgacatcaaatacacgaatacagcatcatttggacaagcagatgtcctctcaaggctagccaattatccaaagcctgaggaagatgtgttgattgccaacatttgcgtcgaaacggactgttatattaacaccattttacaatcgcaaaccgttcatcttacagtcacggcacaagaaattgcggaatcgacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgttatcgttccaagccaactgcgtggccgaattttaaagtcattgcattttgcacatccgggaattgtgcgaatgaaggccttggcacgccagtatgtatacttttccaaatggccggaagtctatcaaatgtcttcaattacggccaagtccacagttttcacacttcgttccataatccatcgacggacgataaaaattggactgaaaaggtgctgctcgcttacaggacgacgccaaataatgccattgatggttattctcccgatcaattattcttcggacgaaaactccgaacgaaattggcattag

SEQ ID NO: 62096 - DNA, 1029 bp, Heterodera glycines
  Genomic contig location: Contig_ID=SeqID_6591; Location=744..1772; Strand=-
  SCN-specific regions: Sequence locations=1-341,363-641,683-821,852 -1029
atgtcccaattgaccagcgatcgggcccagaggcttaaatatgtagagagttctctgagacattcaaaaagcccaatcgagacttttttcatctatgccgagaaccctaagcatcatagaaaacaacatggagcaacaaagaatatccagattcaaaaatgctatttcgctttccaaaatatcttgaaatgttatttcgccaactgtcagttccctaaatgtcggataactaaatgttgggcccgaaaatgcaaaatcttgtttagatgtgaagtcgatcttcccgacccagcttgcaacattttccacagaaactgtgtgatctgccaggtcgaaatcggcaaagacaaaagcaaacagtgctttctttctgcaacacgctgcagttgttactactgttgcgacaaaaagtacgccgcgcattgtccacaaggatgcaaaaattgcatcaatgacggtttttatgaggagggcggatgtccggagaaccacacgccgatggctcggctcgcaagcagcaactacagtagcgagattgggtactgtcccattaaggggacgggcgattaccggatattcgcaacagtgtacaatttgaaaagcggacatttgggtagtaaaacaatttgaacaaaagtgtactctattggacatttgaaaataaaatgacaaaaattatttttactttgcgtctctcttttttttcattttctatatatctttagtctcactgaaaactctccatttgtacattcattgaagaaggtggaaactgcgcgaaaacattttgatacggtaattattgtatttgcccctaaaactaatttttatttttgaatattaattaattaggttgatgcggacaaaagcggtgccatttcgatgaaggaagccattgcatatttggtggagacaaagaatggcacttcggctgaccatttggcaaagaacagtgaatggtttggccacatggacagcaatggaaacagtcaaattgagccagtggaatttgatcggtcgctgatctga

SEQ ID NO: 62097 - DNA, 546 bp, Heterodera glycines
  Genomic contig location: Contig_ID=SeqID_31812; Location=239..784; Strand=-
  SCN-specific regions: Sequence locations=1-170,354-546
gtgttggacgaggctcgtgacggtgtgctgtgtttggatgcgaatgcgtccgaaattgtcaccggctcggcggatggcaatgttcggctgtacgacctgcgggagggccgacttttcattgactacatgaaggattcggtgcgtgccttctgtttcaaaaaaaatcatagaaaatttttttatgagaaaattttaagaaaaaaaaattgatactttttttgaaaatttttcaaaaaaaacttagtaatttatcatataattttaaaaaaatcgctgaaaattttcaaaaaattttttataaaaaaagtttctatgattttttaaaatttctaagtttgaaattttttaaatttctgcggcgaaattttgtctgtcccccttctgtttatttatctcacaaaaagattttttaacttttatgctttctctctgtttttgtcaggtgatcagtgtgcatttgacggcggacaaccaatgctttttggtcgcttctatgggcggcacaattcggcttattgaaaaaacgaatggacagcttttggctga

SEQ ID NO: 62098 - DNA, 1033 bp, Heterodera glycines
  Genomic contig location: Contig_ID=SeqID_31813; Location=485..1517; Strand=-
  SCN-specific regions: Sequence locations=1-331,353-661,694-949,971 -1033
atgtccgagtttggccaagactatgacttgatggtcacgcttgtttctggcaaccgatcaatgccaaataatccttcggtgccaatgccaccggtgctcttcatttttgctcaatggtaattcaataactaatgattgaaagagaagcaaatccgacccgtgccaacttcttcaggtcaaacatcggagggccgagccaacaattcgacgccaatgccaccgattggttcaaaggcattgcggccgccttcgagcggggcggcagtgttcgcttaagcggcgacccgcgcgacatggactggaatgttaccacaccgttgtcgcaaatgcacttgagatggacctttcgaagcgtccgcgaatttgcgatgccgtacgagaagcggctttacctcagcaattgggacagtgccgagctgcaaaagcgcgggtggtctgattggatggcggaacagtggaacaaatttgttggggccagaaacgaggtgggaaaagcacggggggcggaagcagggcattggctgaaagttaggggaacggcacgaaatttataatcaaatgccatggattaaatatgcaataagtgaacagttaataagacaaaagaagctatattttaatctttttctgcagatgatacgtcaaattaattatattttacgaattttcgttttttaaatataatttactttagtgcaatttacatgatgatgaatagggcgaggatttttagtatgaatcactattttggagctttgccactaaaaaaacaatttcggaagttggccactaaaatagttttttgccactattttggcgtttcgtcactattttggaaaatttcccaaaaaatgcaacaaaaatgaaaaatataccccaagaattcaaaaaatacacccctaagaattgaactaaacattttcaaattacacccctaagaattggaaaattttctcaaaaattcttccccaaattttttttcttgctcaatatttgctaagaaaatgttttgtaactgcaatcagtgaataaa

SEQ ID NO: 62099 - DNA, 1460 bp, Heterodera glycines
  Genomic contig location: Contig_ID=SeqID_31815; Location=1..1460; Strand=-
  SCN-specific regions: Sequence locations=1-210,233-540,562-627,649 -727,749-1216,1244-1438
  Gene Ontology: Mol. function=serotonin receptor activity; Cellular component=integral to membrane; Biological process=regulation of blood pressure
gtgggtgccgatgtgacattctgcacgtgttccgtggtcaccatttgcataatctctgttgaccgctacctggcggtgacgcgaccgttgcgctacaaatccgtggtcaccaaactcaaagtgatcgttgtgatcgtgctgatttggtcattttcattgggcattctgttggccactgtccgatgggagtcccaacagcacaccgtggaaaacaaagtgagaggtggtggaaaaaatgttggcaattggaaaccgacattctgatggccccaaaaatgcggcaataggaaatcggaattcaaagctcaagaatgtgggaaagtggcatgccgacacatcgcccactgggaaagaagttgcattagattttttgatcatttgttgatgagtactgtgattgatcagatgatcagcagcataagtgaaatgctaatcgtgaatttcgatgcaaaaaattgccaaggggcagaactgatcgtctatttaaaaatggaaactcgcagggttcagctcccacccggagttatatagccattttgcgggcaatttttgtcaaactcctacagtagcaaatactgcacatacagtatgcaatagtgtacccaagagcaaattcgaaaaaaagatatctgtccatgttgtttagacatgttatgttggcgacgaaattcgctacctcgcgcacagcgtggtgttcgctttcttccttcccgcctctgtcacattgacactgtactggcgcatctacagcctggccaggaacaggcagagagcgttggaccgcggatttttgatgattctcggccacaacatgaacttcttgaccaacacattgtcgcaaacggtgtgtgacactatttttttgggatttcgaaaatgcagagcacagtgatcaagatgaacccaattagggataaattaaagtctcgacgaattaaattctcgaacaaatacactcatacaatcgcactcgtgttacaaaacgatttagaacaggatcctatcaagactctcggggccaatttaaaaaaaatgaaataaatttcaataatgggcctattaggcacaacgacattttcgatcatccacaaataaaatagcccaatcgcattcacaatggaataaataactcgagagttccgttcgcgagaagaaagaaaattctcgacccagacaattaaagagtcaatcaccacaaatatcgataccacatatataacagtcaaatattcacaataatatttcacacacagactgcactgagagtgcacatcggcaagaacaacggcatggttgagcaccagcgacgggtgttgcgcacccatgaacgcattgcaaaaacgcttggcgttgtgtcctgctcatttctgttctgctggctgccattcttcacactgtaccttttaagtgcgtcgtgtgccgcttttggcattggcacgaataattttttaaaaattgat

SEQ ID NO: 62100 - DNA, 679 bp, Heterodera glycines
  Genomic contig location: Contig_ID=SeqID_31817; Location=29..707; Strand=-
  SCN-specific regions: Sequence locations=1-679
atgaccatcgccagtgcctgcgtcaaaaattttgccctcaatcatctgaagcctaactcacttgccatcgtcccggagaaaggctacacccctcaacaaaatcaaagcgcactcgccatcaaatacctcgactggtactcccacatcaacaatgtcaatatccagacggcacactctcggtacggcgaatatgtctttaaacgcgaaggggaggtttaccaagtcgacggatacatcaaaggcacgaatggaaggcgggacaaaattattgaagttaatgggtgtgtttggcatgggtgtgagatatgtttcggtaatatggatgaggaatcgaggatgccgaacggaaagacgctgagggaaataagagagagggagaaaaggaagcacaaaacattgaggcgttacgttgacttggaagttatatgggagcacgaaatcaatgaggagctgaggagaaacaagcagatgcggggatttttcaataattggaaggataattcacccattcgaatacgcgacgcctttcatggtgggaggactgatgttaaaaaactactgcatactgcaaaacctggacaaaaaatcagctacaaggacttcaccagcctctacccgtggaccaacttcacagcggactacccactaggacacccaaaaatcatcagcatacagccaa

SEQ ID NO: 62101 - DNA, 162 bp, Heterodera glycines
  Genomic contig location: Contig_ID=SeqID_31821; Location=1..162; Strand=-
  SCN-specific regions: Sequence locations=1-162
cgctaaaattatcagagtgccgaaaatcgcatgtgatctaagcctaaaaaaaaatggtggaagtaaaaatccgtaattacgctcaaaaagcttctcaaacaatttttacgcttccaattccttctacaatcgcctttatacatccccattatgagcgctaaa

SEQ ID NO: 62102 - DNA, 345 bp, Heterodera glycines
  Genomic contig location: Contig_ID=SeqID_31821; Location=725..1069; Strand=-
  SCN-specific regions: Sequence locations=1-345
atcagagtgccgaaaatcgcatgtgatctaagcctagaaaaaaatggtcaagtaaaaatcgtaattacgctcaaaaagcttctcaaacattttaacgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaa

SEQ ID NO: 62103 - DNA, 1155 bp, Heterodera glycines
  Genomic contig location: Contig_ID=SeqID_71; Location=4606..5760; Strand=+
  SCN-specific regions: Sequence locations=1-33,76-1155
  Gene Ontology: Mol. function=protein kinase C inhibitor activity; Cellular component=cytoplasm; Biological process=protein targeting
atgggtgaacaacgggatgaactcgtccaacgtgccaagctggcggagcaagccgaacgctacgacgacatggcaaaggcgatgaagaaggtggggggtggggggaaaagaggtcgctggcacggctaagcaaaatgtcattttttgtttttttttcagttggtcgaaatggacgccaagttggacgaagaagagcgcaatttgttgtccattgcatacagaaaggcggtcggtgctcgtcgaacatcacgacgtatcattacctcaacagaacagaggccgacactgacgaagaaacagaagcaaattgccaacgagttgaagaagaaggtggagcacgacatggaacagaagggcagcgaggcgttggtcggtggcattggcaaattgcgcactttggcaatctttcaaaaaatgaaatctccgtcattttgaacagtcaaaaggatggtcaaagtgttcagttagttcgtgtggcattttgttcgttcaccttaaaatgtttttgctgtttcaggacttgctggacaaaatcctcatcccgaaggttgacgagcccgtggcaaaagtgacctacttgcgaatgaaagccgacttccaccgctatatggctgagatcaaagaggccgaaaatgacggtaaaaagcgatcaaacccaaacggtttttggatttgtaaggtcatctcccactttttcagatccccagaaggcaaagcagtcgtacgaggaggcgtgggatattgcgcagcagaaaatacggccatcgcatccgattcgccttggagtggcgctcaattttgccgttttcctctacgaattcatgaaaatgccagaagagggtcgaaaattggctcaaaaggtggtggacgcagccgaacaaatcgcattttaaccaccaatttattaacatatcccaatttttgcaggctcatgacgacggaaatgctgatctgctggcggacacgagcggcgattcgtacttggagtccatcggaatcctcgagaagctggacgagaacatgcggatttgggcatcaacgcaagaacgggacggatcatcagaacgaggaaacttctaggatatgccgtcccatgtcacatatgtacaaatattgtaaagtaggcatttgtatcccatgtctgtatatattgta

SEQ ID NO: 62104 - DNA, 399 bp, Heterodera glycines
  Genomic contig location: Contig_ID=SeqID_71; Location=3155..3553; Strand=+
  SCN-specific regions: Sequence locations=1-130,153-342,387-399
cttgtaatcagaataatctacagaaaacttttgtctcacattgtgccaaacccagtgtgtatggttctgcgacaaatattcctacggttttggtgataccgtaggaattggcgtcaataatgctaattgatttttatgtttaaataatcaaaatcccgtaactttttcacagatacttctgattttatggttgatccatcttttgctgatggctcattttatccattcgttactttgtttgactctggtgacaaaattgaggcgaattttgggcccaatttcaaattcgatttggcaattctctgaaggaagaattaattattcactaatgttttcgatcaatttgctctttttaatcatttttgtgtctttcttcttcaattaaaatttggttttttg

SEQ ID NO: 62105 - DNA, 378 bp, Heterodera glycines
  Genomic contig location: Contig_ID=SeqID_71; Location=8908..9285; Strand=-
  SCN-specific regions: Sequence locations=1-378
atggatcagagcaaagcattggtcaaccaaaatgaggacaaattaacattggccatcgatttcactgtagatgaagcaaatacggagcttaaaccattggaatttcaatggcatggacgagtttctgattggatcatagccaatgcaaactgggggacactgacgatgaaaattgagaaattttctgaatttacgaaagaagtgggaaatagacggaacagcgaagccgtgcaaatgaagggatttgagtggaaaatatcggcagaaataacaacggataaggaagacggcaccgacaaaaatttgggcttttatcttttgtgcttccctccgtcgaaaaatggtgaaaatatgagaatttctaattgcattcattag

SEQ ID NO: 62106 - DNA, 692 bp, Heterodera glycines
  Genomic contig location: Contig_ID=SeqID_71; Location=10315..11006; Strand=-
  SCN-specific regions: Sequence locations=1-112,138-356,380-647,669-692
atgagcgaagcggagaattccattgggacactttgtgattataacaaacaaatgaactacagttggggatttggaaatttcattagctttgaggtgagtgccaattgtttccttaattaattttaattaataattatggctaattaaggaattgatggacccggaaaaaggcttttacaccaaatgcgaggacaaagtgacattggtcattgatgtcatgactgttgatgaaccaaaaatggacaaattcatgttggatcaaagcaaatcgaaagggacactttttatggaaattgaaaaagcgtcggaattttcgcgagaagtctttggaagtgatcgtaaaagtgaaactgtgcacatcaaaggattgccatggaaaataatggcaaaaattctaacaaaaaatggaagcgttaacaatgagaaatggttgggcatttacctttcgtgcggtgctccagaagaaggtgtaaattaactaccaattattgctaattcattagcgataattaattgccattaagatttgcattggcgctgctgcgttcgatcagcaatttttcgaattattaatcaaaaaaatggtgctgagaattccactgttgggacactttgtgaccgtgtttttgacaacaattcaaccaaccggggatttcctaatttcatttcttttgtggtgagtgacaattaaa

SEQ ID NO: 62107 - DNA, 999 bp, Heterodera glycines
  Genomic contig location: Contig_ID=SeqID_72; Location=99..1097; Strand=+
  SCN-specific regions: Sequence locations=1-707,730-972,995-999
atggcacctgcactggacctggacccaaacactgttgcactcgcagagcaagaacgacaacgcactttggtgttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtgatcatgccaacaaccacacaccaacatatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaccagcaatgcgacctcgccagacaaatgttccgactcccgtcaaagaaaatggaccaaaaccgaaggaggccagcgacgacatttccaaaccgccggaaatttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaattaaaaaaaaaatacatttattccagtacttaaaatttctcaccaaaatttttcctcaaaaaaaaattttttttttctcttctacaaccctaaaaaaacaaacaaccacttttccatttgttggaggtctgacttttctaatttctgcttctccattcaaaatcaaaaatttggaatttaaaaaaattccttaccgtttgtttatttttgcggtattatgaatgaaaaattctgtttgacatctttatatacacataaaaaaaaaaaattttcaattttcgactttgtcgttttaagcaacaaaatttaaaaagaaaatcaaca

SEQ ID NO: 62108 - DNA, 587 bp, Heterodera glycines
  Genomic contig location: Contig_ID=SeqID_72; Location=2685..3271; Strand=-
  SCN-specific regions: Sequence locations=1-54,76-587
atggccaggaaaatgcaattttttgaggttttttggccataacttttttgtttctcagctcattttttgaaactttgcaggttaataggcactatcaagcagggatgtatggatttatctggactaaaaacgctaaatatggatttatatggactaaaaacgctaaatatggatttatatggactacaaaactcaccaaatcaaaattttaaagtaggaatgctatttttagcacatttcttcatgcgcagaaacatatttaaactatacaatttataattttcaattaacaaaatacagaacatcattcccatttcattcaaatttgaaaattcaaattttaaattgaatattttaatacgttttgatattttttatacaaaattggcatcctttctattgtactcactttatttttatattcaacacggtacactgagtacggtaattttttgccctttcattttggcaatttttaaattttcgaaaaattcaaaatttgttttccgactacattgaaatagaatatttgcttacctaattttaaatttttcgaaaaaaaattcctctgaaacttgatcaataaa

SEQ ID NO: 62109 - DNA, 331 bp, Heterodera glycines
  Genomic contig location: Contig_ID=SeqID_72; Location=2241..2571; Strand=-
  SCN-specific regions: Sequence locations=1-263,296-331
cgccttatttgaatggatgaatgaaatgtccaacgaaaagctgacaatgacagccaacgatgggtcggtttgccaatggctaatgaagcgatgccaaattgaggggacggagtcgattcagtgggaagacgaaaatttgggcaatttgaacactgtcatcttttccatttccgatctccaaagctgcattgtgtgagcaatttacatataaagcatttgattttattcaaattgtgctttatttaggccattgtccccgccaccaccagcagcagaagaagaagaagcgggacaaagcagcgaaaaaggggcgtcttctgacaatgagtga

SEQ ID NO: 62110 - DNA, 272 bp, Heterodera glycines
  Genomic contig location: Contig_ID=SeqID_73; Location=946..1217; Strand=-
  SCN-specific regions: Sequence locations=1-8,30-109,151-272
atgaacaattttatcgtaaaacatttaaatccattaagcaaaaactgttgatgagaagccatgtgaaacaatgaattgcttgttcggcataagaattgaatgtaatggcattttattaaaattttaaagcaatttaatttaataaatttactatctttagagtggaaagaaagtgaaaaaagatgatgaaactgattggattgaggaaagcaaataattataatgtttctaattttggtgcatttttttattttccaattatttttaataaa

SEQ ID NO: 62111 - DNA, 984 bp, Heterodera glycines
  Genomic contig location: Contig_ID=SeqID_73; Location=1537..2520; Strand=+
  SCN-specific regions: Sequence locations=1-30,147-644,678-984
atgcccaagccgaacaagtgttgttttaaggtagttgtcgtggttgtcggagtcgtcgtggtagtgggagttgtcgtcgtggttgtactggtcgaagtcgtcgtggtagtggttgttgtagttgtggttgtgggagttgtcgtagtttcctctgaactttccgtagtttcgtttgtcgccgaactgtccgtgtttccgtctgtcgccgaactgtccgtattttcgtctgtagtcgcggggattgtgaatgtgaatggggacatttgctacggaaaaaatttcttaaatattacaaaaaaaaattatcctcaaaaaagtaccgaaaatttccaaaacaaaaaaaaggatttattgtccttggattttaccaattttccatttaaaatcagcccgaatctgtccttgaaaattcatcttgaacaatgagggtaaaaacccaactctcctcctagcgaacgcgtgcttgctgttttttaaaatagtcataagtttcaacaaattgaatattcttggtaccatccgatagcttttaagattctctctgtacctaccaagtttttccaaaaattctatcgtttgaaaaaaaaagttttgggcaaaaaaaagatttttaggatttttttgtcgtatcttttttggaaagcaataaaattttatttttatttttttttaaatttgcagttagatagagagaagagatctttaagagctatcaaatgcggagtaggacaaaacgtcgtcagccgaaacgtcgtcgaacgaatttttcgaccataacttttttctttctcaaccaaattaaacattcttggtattattcgaaagcttttaaaaatgctattagcctgcaaattttcaaaaatttttatttatgcacaaaaaaatcagagcaaaaaaaagttcgaattactgggtttttgagttccaactggtcataacttttttgaaacttaaccaaaatttttgagattttgcaaattaata

SEQ ID NO: 62112 - DNA, 1358 bp, Heterodera glycines
  Genomic contig location: Contig_ID=SeqID_73; Location=3415..4772; Strand=-
  SCN-specific regions: Sequence locations=1-125,148-445,478-615,638 -1328,1350-1358
atggcatttatgctcttctgctcaattatcgcatcacaaatattctatgttgcttacggtacgattataatttgctgtgttttgatggcatggcctggacccaggcatggagctggatttttttgaaatttgttttaaaaagcaaataaatgcttggaaaattcaattaatttcttagtagtacatttaaaaatatttaaattgacaatatgaaatctatataatcattttttgatgacgtaaaataaaaaaattgatcatttggataacaaattctaaattttgtccgggaaatccagggtttttcatgcataacctggacttgagtttttttccatatttgacatggacatggatttttacaaaaaattgttgccgaaaatggcctgggcctgaatccaagaaaaacctaggtctggatccagcaagtcgagctctaatacatactataatatatacattacatttttgtattttcagcaccacaatgcgttgatgaaatcttccacaacaaatggattaagggcagcgccgatgaattcaatctgtgcaacgagggtgtacggtgctattccatgatttgtgaatacggtactcagttgaagggatagttatttttcttaatttccattttgggaattagatcagaatttcgatccaacaaaaacgccgtaaaaatcggatatggcttggtcttactgggcgacacagagttgagctcaagaattttcgagggaacaaaaagcaaatgccgaaaagctttgaacccgcgtctctggccttccggcccaatgttctaccagctgaacaacaaaccctcccctccatgctctccccaattagagattaattaatcgtcacctttaattgattcattagccttcccctcggggaagcttctccttctctatctcatgtgtgtgtgtgttttttaagtcggacaaccatttgcattcgtcaaaggctgcgcggcaacagaatcttattgcagcaacgataaccggtacggggggacgggggtcaactgcaggtagagaaagagaaaagtctgtgttttgattcggcataattactacctaaaagccttacgggatggaactgtgtttccggggctgaattgactcgccctctcatttcgggtctactgcgttcccatttcggcgctcacttttcggcgccagctcgtttttccactataacttttttctttgtcacccaaatccaaaattgttgatatcattcgaaagcttaacatgtttagaagctttttctaagctattgtttcgcgattagataattacaaaaatatacatgaaaattgtgaaaagttgaaatttttgaagttttttattaataaa

SEQ ID NO: 62113 - DNA, 1394 bp, Heterodera glycines
  Genomic contig location: Contig_ID=SeqID_73; Location=6678..8071; Strand=-
  SCN-specific regions: Sequence locations=1-177,199-740,762-1394
atgtcgggatccctaagtgtcggatcctcaaatgtcgggatccccaattgtcgggtccccaaatgtcgggtccccaagttgcaaatccccaaaagtcgggtagcctcaagtcgaacccagcatgcgttgtttgcgtgcaccgcttttatgggcttgatcaacgaagtgaaaaatgagggcattggatgggtcaaagatcaactgaagagctactgtcggctcgtcccgttttttagttccgactgctaccgtttggttgcggatgctttactgaatacgattgtaaacaaattaaattgtattaaacttgagaagctcaatccgacaattatctgtaaggaacacggtatgtgtaatgaagaacaaggaaactcaacggcaaggttgctacatgcaagcatgggtcctatggcagcgccgcgttctcgacacagtattttgttgccaaatgatggtccggttatgccgcctgggtcattggaagcccttgctgaattcaattatgaacggcttttgatggaccagctgggcgatgactcaattgaaggcaattattggcaaaaatcgggtggaaaattcatattaaggcgtggaaaaaactttaaaatttcttgcgcgatacggtttgatcgcaaactctgctttgtgccgtgaatgccaaggtcaccaaggggcacttgtcaagtatgcactagcaccggaaggatttactgtattaatacaattgagtatccgaatacaaaaatttttaagtggagatgtaattactgtcgaacatcccggggtgctgaagtgtcaagccgaatgtctgttcggatcggctcgttttttgataaaacacacatatcactcaaacaagtgcttcgcctggcttaatggtgggcacaacatccaacaagcaatttggaagttataatgagagaaaatgaaattggatcgattgcgacaatcgtcgatttttacaactttatgagagatctttgccaagtatgatggggaatggtgtctaactatatgcatgttactaatttactagtcttgggcggttcgaatgcaagcaaatgagaatttgggcgggatgggccgcgtggttgaaattgacgaatcaaagttttttcggtaaaaaagcgagtatattttctttgatattagcacccaattacagggctaagtataacagaggcagaatggtgcaacgacagtaaaattgggtgttcgggatgcttgagagaggcacgaataaagttcggtttttccctgtcacaaatcgtgatgccgctacgcttttgccattgattgctgaaaacatcgagccaggcacaatgatcatttcagacggctgggcagcaataacagagaagagatgtgatcaattccaacggagttactggtag

SEQ ID NO: 62114 - DNA, 633 bp, Heterodera glycines
  Genomic contig location: Contig_ID=SeqID_73; Location=8519..9151; Strand=-
  SCN-specific regions: Sequence locations=1-222,262-316,340-373,395-633
atgaaaaaatttctttttttgacaattataattctgttgctactaaatactcatagttcgaacaaacagagacatcggaaacaaagagaagtttcggctttagctcgtttgactgtggctttatcacgtataagcacctacattaaagcccacccgtacattaccgcctcgacaattttgatggaaatgggctcagtttccctcaacatttatttgctaatacaagaaataaaaggttaaaaatctttattttttgaaaagatataattattttagcttgcgaagagaaacagatcttaaaggactttttcccgtttgtgctcactctgaattcttatgaattcagtgtgaatgttgatgactacaaccctggatatatttttggaaaaataaataccgaaatagggcgaccagtggaagagatttgttttgcaggtcagccacaaaaaattaattcgttaaaaaattcatttaaagcaccgaacaaagtcacccgaaagataagaaaccgaaaagatgacctcggcattttgttgctgtacgcaattagacagcaaagtcggctggaactttttgaatgtccttgacggatttctgttcccgttggcccttgggaaaggcactttaaataaa

SEQ ID NO: 62115 - DNA, 1263 bp, Heterodera glycines
  Genomic contig location: Contig_ID=SeqID_823; Location=2207..3469; Strand=+
  SCN-specific regions: Sequence locations=1-1263
atgtcgttggaagaccacaattattgcggcgagttgggcggcaacgaaacgcccacaaagagaagaaggagaaatgacgatgatgatggggagggagaaccgaaatttcaaaaaaactgcattcgcactctgagcgccgacaaacagtacagccaaaagttcaaagtgcagagtgtaaagtcgacttttatcattgaaaatctgcccgccaaccccgagtcaatgctgcgcgcattgttcgctcactgcatgtcaaccgccctggacgagtcacagcagaacgggatcacaccggatcaattgggcgctacaatctcttcagatctgctaaatccgagcatatggattcccatacgccgcatttccgacaacaccgccgactcaatcatgaaccgcttccttgaggtggcacagtcaaaatcacgggagggctctctgtggggctcgccgttcactgtgaccatcacaacgcttgatgttgcgcagctacctcagcggcaacaggtgcgtggcagtgggaaaaggacaacaaattcagtgcaacatatcgtcaaagagagtgcactcctgcgaatcaacaacagtgatgatgcctattgccttttttacgctttggaggcaagcagaaaataccacatcaaagagatgagccgaagaaatttctgttattatattaaccatcagaacgggcgacgactggaagacgtgtttggactgatgagcagcgcaaacattcgcaccgatctgagagaatatgacgcggttgtctatgtgccgattgtcgtggactattggaatcgaaaatacgccacagcaaaccagcgatttaaagtgttcatttttggcgccacaggcacctatcggccaaaatttcaatacgggccggacaattacaacgtcgaaatcccgctctaccatcacaacggccatttcgacggaattcgatgcggggtgggcaaagcggtgtttgggcgtgactactactgcttttcgtgtgagtgcccctacgataatgctaatggtcacacgctacaatgcaaagcaaagtgcataaactgcggtcgcataggagcggggcgacaacaacgacaattattacagagaatgcacagcatgtggcaaggatttcatgagccaagactgtttcagtcatcatttgtcgagcaatgtgtgtcaacagttcaaaaaatgcaaacagtgcggagttgtgtggaatgtcagacaaaaccgacgaaaaggacgcagcggacacgtttgcggtga

SEQ ID NO: 62116 - DNA, 1078 bp, Heterodera glycines
  Genomic contig location: Contig_ID=SeqID_823; Location=1002..2079; Strand=+
  SCN-specific regions: Sequence locations=1-26,55-110,141-239,362-1078
atgtattttaaaagcgctactgctattttattctttttgattgtttttattggtattggaaaatgtgcatcggctaatgcaaacaaaaccaaatcccgaggggcagtaagcaccaccaccaccgccatcaccaccaccacaactgtcaatccgcagaagattggtgtacctcgtttggcatcatctactcgtatggggaaaggcagcgtgactggcaaaccactaaaaattgtcaccgccaacaccaataccaacaggaacataaccaccgccaacaccaataccaacaggaacataaccaccgccaaaaacaacaaaaacagcagcagcaaaatcaccacccctacaacaaaaactgcaaaattggttgtggatgagcagttgccagtcgcaacactcctcccaacattgattcaccaaatgtgcaaggatcgccccggtgaggaaaacttttatcagcaagccgtttgctgggcactttttgcgctctatttaatggtgtttgtcagtctggtacttcatcagctttgttctatctgttggttaaagaagaaaaaggagtatggacagcgcgcagatttcgactattttgaggcaaagtcgggaaaccgcacgagttttccggggctgtttcccaagtgaccagctcccggcgccggacacgctacggtacccagcggcgctagttgtgaacaacgacccacattacaaacaaggatcccattggtgcgcgatttatgccccttcaaagatggaggaagcggtcatttactttgatagtctcacaaaaacaattcctcctattgtaaagacatcatttatggataaatttccaaaaggttttgttacaaataagcacccgtaccagtccccgctgactaccacatgtgcaattcactgtattgtgttcatttatcatatggccttaggtcacccatttgatgcatttctgcgcatattagacgctagtgaaagtcccgacatgtattcattgtgcgttctgaataaaatgattaatccgtatttgtgtgcgcgcgtgccaattttaccaccctttgggaaagggcatagggaatga

SEQ ID NO: 62117 - DNA, 1041 bp, Heterodera glycines
  Genomic contig location: Contig_ID=SeqID_823; Location=4025..5065; Strand=+
  SCN-specific regions: Sequence locations=1-54,76-333,386-766,789-1041
atgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggtggaatgacgcccgaccgacagcgcagattcgaccagtggtacgcggaacaccgccatcagcagttcgacctatgtgaacagctcgcagcctactgcaccaacgacacgcgcatactaattgaggcgttggtcgcttttcgcacggagttcttgacgatcagtgacccgctggagcggcatggatgcttggatgacgacaacgacgacgaagatgaagaggaggaggtggatgacgacaatgcatttgaagtgatcggcggtggcattgacataacgtgggagccgatgaccatcgccagtgcctcaatgagacactttcgactcaatcacctcaagcgggatcagctcgccattgtgcccgagtgcggctacgacactacaaacacgcaaagccttgtagcgctcaaattcatggactggtacgccaaaaagaacggggtgagcattcagacggcacactcgcccggcggagagaaaaaaattggccagtacactgtggacagatacatcacggcgaccgacaccgtgattgaggtcaacggctgccactggcacgcgcacgaccatccacgtcaccgctttcagccccaaacagtgatggcgaatgggaaaacggcgcagcggatacgggaggacgatgcgcgacggatggccttcatcacatctcaggtacaacaagtgcgcgtattttgggagtgtgaaattaacgcggagaagcgcaacaacgacgaaatgaagcgcgcctttgcgcagtacaaggacagcggcccaattcgtttgaaggactgctaccatggaggacgtgtgggtccacaacgactacactacgaggtgccagaggggtggcggatgaaatattacgacgttcgttcacttacccccacacgaatgccgtga

SEQ ID NO: 62118 - DNA, 1071 bp, Heterodera glycines
  Genomic contig location: Contig_ID=SeqID_823; Location=5473..6543; Strand=+
  SCN-specific regions: Sequence locations=1-737,766-1007,1029-1071
atggccatgaaaacacatgccagcggcttcccggatgaaattggcacaaccgaggaagatcagcagcaattcatagaggaatgtgaggaaaaattcggaatccgaatcgagcgggaaaatatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgaccagctcaccgacgaatgcgtactggtcacctatgcggccggaaacgaatgggtggaggaacacgagtgctcaaacattgtgctttctctttggacaacatcggtggcacgcctccacttgttgcggctaatgcagactgttgctcgcgcaccaaactcggtgctcatctacaccgatacggacagtgtgtgtttcgcccatcgtgaggcggacgggtgccctctggagacgggaccccacctaggtgacctttcggatgaatggccggaccacgaactcgtggaatttgtttccggcgggtgcaaacagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgacgaagaaggagatgacattttttcaattttgattgagtaccccaatttcctgagacccaacattaaggacgggacggttatttctgtcaagttgtcgaagcggtatcgccctattgtaactaagggggttgtggggatgaatgctattgtacatgattttggttttataaaggcgtaatttatactgaattgtactttttaaaaatgcataattaacaaatggaagattacaatttaaaataatgaagcgtgagaagttgcaaattttaggtagaaaaatgcataatttagtaagagaagtagcagttttggaata

SEQ ID NO: 62119 - DNA, 666 bp, Heterodera glycines
  Genomic contig location: Contig_ID=SeqID_823; Location=6606..7271; Strand=-
  SCN-specific regions: Sequence locations=1-436,470-614,636-666
atgcatttgcttatcgcattctcgcgcattttggactgttcccctgacgaagtgggcgcgcgaatttgctgtagcgttgcggatcgagaaaaattgttgaaggaatttgcacatcgtaagctcatcactacatactacgaccgtaatggcttcacccacacgctcttctttgctggactcactgaagagggcgccaactcagtgcttgcttatggtaacctgaggcgcccctacaatgtttgcgttgcggcccattattactcgcggcaccgcattatgctaaaatacccgcattatccatgcgttatcgagaaatgttttggtcaaagggatgacggacccttgcacaaatattacccgcttgaactggtaaaagtcgtcgatgactgctttccgcctgtgtacgttaattcgctgtctcaaaagcgtgacggcgcatcatcgtcatcatcatcatcctcgtcatcattgctgcgaaatttgccatcaccttcgtccgatgatgctgattatgacgaccatggtctctggtttggctcgatgcccacacaaaacagtgttgcggaaacaccacctcctccgtcttgtggttttgtgaaaggaatcatatggattgaaaaagagcaaatcaaaaatattctcagtcaagcagttaaacatgactaa

SEQ ID NO: 62120 - DNA, 469 bp, Heterodera glycines
  Genomic contig location: Contig_ID=SeqID_823; Location=7472..7940; Strand=+
  SCN-specific regions: Sequence locations=1-15,72-168,198-469
atgccggaagaatctaacaacaacagcacaaactacaacaacaataacatcagcaacatcaactataacaatgagaatgctcaattatggaagcttgtacgtaagaaatatattctgaccttcaatctttgttacggctgttctcaaaaacttttcgagtccactaaaaacaacaacaacatcagcaacaacaacaattatgcttttgaaactgatcagtttggaggcgttaaggtgcaatttcacatgtgtaagggatgtgtttggttgaacatgaagctgagcgatttaaatagtgcacccaaaagtggtaataatcatatgaaaacaactcgcaactttccaaacacaaacaatgcaacttactctactgacaataattttggctccttcttcaataacaccaacccgcagaataatgcaaatgaatggatttgacaaaattttgagcagatcaaaattgtaacaa

SEQ ID NO: 62121 - DNA, 634 bp, Heterodera glycines
  Genomic contig location: Contig_ID=SeqID_823; Location=8224..8857; Strand=+
  SCN-specific regions: Sequence locations=1-207,229-405,427-491,545 -548,570-634
atgaactctcagcagcgccaaattgaacgagagcagctccgcgccaggcttaatttgttggtcgacgaggtagatatggtcgtccaaggccttatcaacaactacaggagcgatggactgataaatgaagtgagtttaggaatgcatgcccaaccagggactaggatttcaatgtagggaggcataacgattttctcgtcctctgtttaattttataaaactaaactttgatcaggaagcggccattggacaggcaccagaaactgtggaactacagaacgtgaccattgggtcacaccttcccgcgcaacaaggcgaggaatgggaaattgggccacacatgcccctacaacagcattatgagcatcagccttgggaactggacccaccgatgcccgaacagcatttggaaattgggccacagctcccggatgcgtgggaactggttccctatcagccaccaccacaatgggaccaagttgtgcatgtggaacaacagcagcaacaacaacaacaccaccagcaacaacaacagcatcagcaaggcgcgtgggacgagggatgggaggagcagctttcgccaaatgcaatagcgcagatccaggacgaggcggatgggtgcgccagagattga

SEQ ID NO: 62122 - DNA, 129 bp, Heterodera glycines
  Genomic contig location: Contig_ID=SeqID_824; Location=486..614; Strand=+
  SCN-specific regions: Sequence locations=1-129
atgaactccgaaagacgtcgcaatgaacgtgagcaattgcgcgcccgtttaagtttgttggtcgatgagattgatacggtcgtccaggggttgatcaccaactaccaggacgacggattgatcaatggg

SEQ ID NO: 62123 - DNA, 870 bp, Heterodera glycines
  Genomic contig location: Contig_ID=SeqID_825; Location=1396..2265; Strand=-
  SCN-specific regions: Sequence locations=1-26,48-766,854-870
atggacctgaacacactgcacatggacatgatggaattggccagcagtgccggggacgagggcaccgtcggcaaagccaacgcactattggaacgtgcgggcgacaaattggacctgtccatggagcacatcggaatattaaagcgccgggtacagctcagcaaccaggtgcaaagtggcattactgactgacattaaattggctttttggcactttcagttggccgagttcaaagacagacgggcgaacgccagcgaaaaaatcattcaaatggaaacaattcgggagagcatcggcgacaaggcggagcaggtcaaacagttggagcagctgattgccgccaccggttgcgagttgtccgagacggaacgtcaattgcgcaccatggaacgctcgaagcaggcaaaaattgatgttcaaaaatcaattttgctatggttttcaaggagttggaaacgactgtgcagcaaaacttgcgcaaaatggcactcgacgtggacagcatcaacggcacgctgggcaaaatcacggagatgggcgaggtaaatgtcaattgatatttttagcattttccttctctttgttaatgtatagtaatcatttatggcctataggtgttcctgctccttttgacggctattgtcatttgcgagtgcggcgcaggaagaaaaaatggtcaggcgggatgtgagcgacacaccgttggacggggcggcggaggcgcaaccggccgaaacggagcaggatcgaagcggggaggaggacgtggcggcggtcgcggtggtggaaaaggcaatggccgcggtggtggacgaggcggcggcgggcggggagggcaggcgctgcagcagccacaggatgaggacgag

SEQ ID NO: 62124 - DNA, 3328 bp, Heterodera glycines
  misc_feature (2807)..(2807): n is a, c, g, or t
  misc_feature (2890)..(2890): n is a, c, g, or t
  Genomic contig location: Contig_ID=SeqID_826; Location=153..3480; Strand=+
  SCN-specific regions: Sequence locations=1-280,304-728,756-761,783 -834,857-883,995-1139,1176-1235,1257-1364,1389-1467,1489-1797,1841 -2029,2052-2179,2201-2229,2257-2273,2337-2339,2366-2674,2696 -2847,2869-3005,3027-3075,...
  SCN-specific regions: Sequence locations=...3097-3097,3123-3128,3158 -3171,3206-3328
  Gene Ontology: Mol. function=structural constituent of muscle; Cellular component=cytoskeleton; Biological process=regulation of striated muscle contraction
gagcggaccgcgtccggtggcggaaggcgacgcgttggcagcacagcggcggatcggtcggcacaggcggcagcagcggcttgcgctgcgggcgaagaggcaacggacgaggtggacaacaacgaggaggagcgacagaacatggcggtggtgacaaaaaggatggcaattttggtaaaaaaaatttcaaaattattgtgtatgcttttcgggatttttgtgcttaatacctaggcgccttttttgtgcctatttcgccattttttgcacctatttttggattttttatttattaatatttttccttgagaaaagcagcacaaaaacaaaaatctttcactttttaattgtttttttcaatttttgggcacccctttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaatttttaaatgaaatttttaaacacagaaattaaaaaaaactgctgttttttggaaaaaactttttttgtgaaaaagtcatttatcataaaactgagaaatcactaaaaaaatttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaattaaaaaaattttatcaaatcctaaaataatgttaaaaatattttatcaaattaaaataatgttaaaaatattttatcaaattaaaataatgttaaaaatattgtcaggtttctctgatcatttccaaatgtcggccacaagatgggggcgagtacacattgatggtgaagaacgcgcatggcaagcacaaagttggcgccaagctgcttgtcacgccagcggccgaagtgaaaaaaaattgccagccaaatttaaataataatatttacaaaaaataaatttacagtcgaatttggacatccgggccaagcagaaaaaacgtggcacgggcattagcaattcggaacaggaaaaacagcgccaacggagtgatgccgagcccaaaagcaaggctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaaatttcagtgcctcttctttttttttttgatggtgacacaaatttaaagacatggcaaaagaaattattgaaattcaatttttttgattaaataaaaatcgtgaacggaaaatgggtcagtggaaaatgcgtcagtgaatcagtatttctttaaattgagatacggtagtaatattaccgaaatcacaacttgttttttagggatttgggaaagtttcaattattttgacttttaaaaacttaattgataaaattcagaacaaaattattagacaattttgtccttttgtaataatacaatacttaatgctacagtaactttattttaaaaatactgtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggtgggaaggagggggcaaatctcttgctaatcaaagaatacattcatattttgtgttatgaaagatcaatttcaaaaattgagtaggagtttaaattacctattttgggattcctttaagcccaaaaatccctaagtatggatatttccaaaattcaaaccaaaactagctcaaattcttcaattcaaatgcctatcagaaatttaaaaaatatattagaaaagtcagaaacaaaaccatttttttaacaatatattttttaattttatatttttttacattatctaaaatttgtttttatgccaaatttcattttgtttttctattgtgtattttattgatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgctagccggtgaccttctagttcgatgacgatttgtattaaatttttttgtttttcactgttcctgttttatttgtgcccatctcttttttcgactttttcttcgagttcgggtctagggttcggaattcagaatgatgttcttaagaattttacttttatacgacaatacttaatgctatcgaactaatttaaaatatttgtatcacagacgcatttctcgggcacgccgccgagcagtacagcaaagcagacggaatgtcaataattagagcnaaatagaaaaggagtccaataaacaccggccaacacatatacaaaaccgaggccaaccaacaagcgccattgtttgaatttanatattaaagaattaaagtggcaagcgttttttgttaatgttacaaaaaatttgaattttttgaggcaagtagttttttatcatatgatgtactttctatgtttaatcccaggattaaatcatttatttaaataaaagctttctcaaaaaagaaaatttagctgaaatattgcattacaaaattcacaacagataacactgtaagcactgataaaataataacaataaattttcgaactatttttataaatgaaaatattaattacaaccataattttgacattttatttttgcagttttatttggacttcaaagatgttaatcctagctggtcactaattggatgcgcactgatttatggaatcacgccacatttagagtcattttcaattcatctgtcattgttgtaacataagaacaaagtgtgaaattaatttaa

SEQ ID NO: 62125 - DNA, 1364 bp, Heterodera glycines
  Genomic contig location: Contig_ID=SeqID_6592; Location=1033..2396; Strand=+
  SCN-specific regions: Sequence locations=1-153,176-296,322-620,642 -659,681-713,736-853,917-1298,1328-1364
atgaaggaaagatggtttcaaaataacatccatccctcaagtggtggatttggtctagtggttattacaacggatccaagtaagcggccccgagtgggggttcaaacccggtcttccacccccaatttttcgcctaaataatagggacttttgagctaaaactctcaaaatcctcattgcaaaaaagcctcttttacccctccaaaaaactccttaaatgtgagaaaagctttgatcaaaacgataaatccaatcctgcgattaaattggaatgcgaactcttcatccacaaatagtttgtattttattttattattgttcatttggcactctaataaacacaaaaaaacatcgcagaagaacggagggacaatcaaaattcaaacatttgaatgcgatctaataactagggctccaatttttaggcactaaaaaccgccaaaataggtaggctttaggctctaaaaaacacccaaaacaggctctaaaaaatggaaaataggcactaaaaatcctcaaatttaggggtgtaaaatgaaaaaaaatttattcaaatggtaaaaaaataagtcaaatcagtattgagataaataatttttaaatcacaaattcttgtcaagaaaataaataaataaatttatgagatgaatttttgaaaatttttcatttctcttttctctggggttttgttcaatgttcgcatgcaaatgctttttgtggtaacatttgatcagtgaaagtgttcacttttttttattatgctattttggcatgccaacattgacaaattgtaaaaatgggccgactttggcaattgacattcagacatacacctgcccaatttgccgcattgttctatcattatttttcccatttctgtttgccttttctttctttctttctttttcatttctttgagataaaagcattttaaattttgtcgtttttaatttgttgaattttttatattgtcttttggtcgattcaaatgactgcgactcgattggacgtcgtttaaatttgggggtcagccgttatcggatctccgggattttcatccccgtttttgctaagcgcagaaacggggacccccgcaccgcaacccccgaggacggagataaaaatacaccccttagaagaagaatggactcaacaacaaaaatcgtcaaactagccgtcagtcaatccaacataggactgttttgaatttagcatttattaattagccaaacaaaaattgctgcattaatttgtttcgcatttatttatcggcggaaacaaattttatgcaaaaattgcatataattttttcatctcattttccactattactgagtgtgactttttcatcattgctaaaacaa

SEQ ID NO: 62126 - DNA, 1769 bp, Heterodera glycines
  Genomic contig location: Contig_ID=SeqID_6595; Location=33..1801; Strand=+
  SCN-specific regions: Sequence locations=1-70,105-1324,1353-1769
atgacttctaaggtgatgaatttagacatcaaattgctgagctaaacgaacaaattaatgcaatttccataaaaagtaaaacaaatgaagaaggaataaacagagaatttgtaaattcaaattacaacagagggagtgattaccgtaggccaatcagaggaaattggcaacaaaaccgaaattatgcgagaggtggatataatggtggattcgcaccaagaaatcctaactttatcccgcttggtcaaaggagaatgtggaatggaaataattcaaattctaacagatttaacaataatgagccaaggggaagaggattcggtaacaggggcaattttcagaataatcgtggtaatttccgaggaaatggtaatgaaaaacagagataccgaataaatatggtgggagatgaacaaacacagtcaagttcatcgagacgttctccgactccgacttttacatttttaacaatttcgatggttttgtctattttgtttggtacttttagtctgtcaaatgcacaatatcaaatttgttctgaacgagttcagactaccgcaattctgttaccaaatatcacgaaatgctctataccaaaataccaaaaggtggctgaaaacaaaataaccttgtttttaccagtgcgtttacctaaacaatttgccgtttataaatgctatcaaaaattaaccaaaatatgcaccggaaactttttgtttttatggaaaggagtaaaaagtcaggagacaacggtgaggggagtgtctcacgaaacttgtcaaaaatttaaacataaaatgggcggctcaatgaatcgacttagtgagaatctttgggccacggaaaatcctgaaaagttgacatatgcctggactggcgaaaaatgcgagacaacagtaaatgactttttagaggaaggaaaagggggaattttggactttttcctggtcacttcttttgggcataatttaaacccgtataaaaactgggaagaactgccaagaaagacattcatttgggaaatccctgagccaaatgagaaatattgggctacacatttttcggttggcgaattcaaggccgaaataactgaaaatgcagtggtaattgaaagtgagcaaagtgtattttatttcgaaaaagaggctaatgacgaaagggagggcataatcggtgtccctgaaaacgcctacaaaatgtcaaatgatgcttttattgtcttaagcaaaactgaaatacgggaaaaacgagaaacacctaaaattgagccgaaaagaaaggaaagcccggtaaaacagtaagttcaactgaaaagtgaaatcaataaaaaggaaaatgttttgaaaactaaggaacaaaatgctacagtatctgttttaccgaaaagcactgtaaagctggtcaaggacagccaacaaaaaatatcaaatccaattaaaattttacctcaaagtacacaaagtacagtgatcacaacttctaaacctcaagtcaaactctccacaacagtaatgcctgttacgacaagcaccactccgaagccaattactgttcaaagggttataacatcaaccagttctccaaatgttaattatgatggacattttgagacaatttcagtgaaaaggcctcagaatgagcgaatttatcaggcaaagggaagagagtttaaaaatttgggaagtcgttctgaaagcactaccacaaaaaagcctattactgtcacaaaagttgggacgaatatttcaaaaaaatttgaccgtgtctaa

SEQ ID NO: 62127 - DNA, 231 bp, Heterodera glycines
  Genomic contig location: Contig_ID=SeqID_6595; Location=1921..2151; Strand=-
  SCN-specific regions: Sequence locations=1-231
atgttctcacccatttctgacttaataacttcggtgacattctccaatcccgagaaaatatttgaattaattggtgagccaatcattaaacttgtatttgttttgtcagttggcaacactgttatttcactcgcattttgcgtgacttttgtagaaatcgtagtgacagaagtacttgttaccatgggctttaccgttgaagtggttatggttgtggtaacaattttttga

SEQ ID NO: 62128 - DNA, 291 bp, Heterodera glycines
  Genomic contig location: Contig_ID=SeqID_31822; Location=720..1010; Strand=+
  SCN-specific regions: Sequence locations=1-69,204-264,286-291
atggcagcagcgaatccagcactcagatggtttgcggttctgatttgccggaccatggcaagaatattgaaaaatataaagaaatttatttttattttttagaacaaaattaaaaaatatatgtaatttttgacttttcataattttaattgaatcttttctcaattaaagttataatttaaaataattttattcaaaatattccaaaacgaaaaaataacaaaaactctaatgttaaacaaatattaataagaaaaaactgacaaattattattaaaattttttgttaaa

SEQ ID NO: 62129 - DNA, 600 bp, Heterodera glycines
  Genomic contig location: Contig_ID=SeqID_31823; Location=400..999; Strand=-
  SCN-specific regions: Sequence locations=1-163,185-310,339-403,425-600
atggtgttgatgaagccaaatttggcaatgaaagcgatcaaaagaaaagaggggtgggacgaccgaaaaggcatccgagtgaatgcaaagtgtgcgggaggaaaagcatgtactgttattacagaatccgatgttgcgaaagtgagtgacgaaaaaagaatatttataatttaatatacttaaatgtgagtgtgaatcaggagtcggcgaaagtacagcactttctgcagaaaagaaaactgaaaggatttttttcaacggggacggaaactgcttaatttgaatgaaaatctctgttcagcagattctcttttaaatacattaaatatttttatttacaaatttcggaccggatcagtttagtctggccgttttagtcagagagtcgttttagtctggcaagctgtttttgtcctaaattgattcaattctgcttttttcgaaaaatctttaatttaacgccacatatatcatcaatttgagcaaaagttcgcacagacaaaacgccaaaaaaccacgctaattcaaaaattgtcgagaatttcccttgtaaaaacggaagagccgatctcgagttaaaaacaagttctattaaataaa

SEQ ID NO: 62130 - DNA, 700 bp, Heterodera glycines
  Genomic contig location: Contig_ID=SeqID_31824; Location=124..823; Strand=-
  SCN-specific regions: Sequence locations=1-414,437-520,542-602,626-700
atgggtggtctgaatggcttcgacgtgcgcctcatcttcgaccaacacaacacccaacaggaaatggccgtccactgttgggaggattgcatgccacgccttgccaacaacattcagtgcggccagatcgtcgaattcagtcgtcttaaagttcgggagcaggggaagaacgccaagggattcttcccgttcaatctcctctacaacaacgagtctcgtcaccgcgtgctctcggcatccggccacattggtgagttgcattttcgcatttttcgaacgttttttttgtaactgtgttcatttttccctcacattctcaggcgcaaatttggccagcagcagcaacacaccaatcattgttgaggcggcggtggaacaacaacagccgggcatgaacactctcagcaacgtggtgcgtcacaacagcagcagcagcggtgccaataatcagcacatccacggacaaaacagtgagtgtaaagcaattgtcagttcaacaaaatatgaactgatcagatggatttaattaataatttaatttccttaaatcgttattacaggcaccggcgttgtgacggcagatgatggacaaagtgagggcgagcccgatgaggcggcggcagcgaccaatttgaccaatgccggagcgcgagatgcggatgttgaggaaggcacgagcgaaacggttagcggaaattaa

SEQ ID NO: 62131 - DNA, 338 bp, Heterodera glycines
  Genomic contig location: Contig_ID=SeqID_31826; Location=231..568; Strand=+
  SCN-specific regions: Sequence locations=1-338
atgcaaattgtgccatttgaattggtgaacgaatggacaaaggaaaagctgacattggccaaagcaaaggaaaatgaatggtacatcgattggataatgaaacgaagcaaaattattggggagacagcggcggtcaattggaaagacggaaattgggacaacaattgtaactgtgtgttcttttggcttgatagtgacactaattgcattgtgtgagaaaacaacaaaaacagcgatcaaccgcagaagaagaaatgaattaattagaaatgaccgatcgaccataattatatcattgatcaaatgcattttatgaagaaaaaactcaatttcggtaa

SEQ ID NO: 62132 - DNA, 171 bp, Heterodera glycines
  Genomic contig location: Contig_ID=SeqID_31826; Location=702..872; Strand=-
  SCN-specific regions: Sequence locations=1-12,154-171
atggacaacagcaaaaatggagaaacaaggaaagaggaggaaaaggaaggaaatagcattagggaaggaggagagacggaagagaaagagaggaaaaggaaaaattcggcggaaggaagaggagagaatgaagctgaaaagagaaaagaacagcagcaaatcggcacttaa

SEQ ID NO: 62133 - DNA, 648 bp, Heterodera glycines
  Genomic contig location: Contig_ID=SeqID_31827; Location=82..729; Strand=+
  SCN-specific regions: Sequence locations=1-648
  Gene Ontology: Mol. function=1-phosphatidylinositol-4-phosphate 5 -kinase activity; Biological process=glycerophospholipid metabolism
atggcggttatgctggcaaaattgcaccaacagcaggtgtatagcaattgcaattaaatgaaaaggccgccataattgattccttttcctaatttctcagggatccgacatcgattcgggcggtgagggtggcggacgtgcatcgcttccagactctccgattccttccgccagtgcgttcaccactacgctggcggccagcggcggactgaacctggacgacgaattcttcgccattccgtccagcgaaggtggttgaacggaagatcggagtggaacgaagagtggattttttgatggatttatcactttagattctccacgcaaattgctttacttcatcggcctagtggacattctcacttattacggagtgaaaaagcgtactgaaatggcagccaaaacggtgaagtatggctcaagtgcggagaacgtctctacggtgaagccggaacaggcaaataattcctttttggttgcttaaaaaaactgttcatttttcagtatgcaaagcgattgcttgagttcgtcaatcgtaatgttgtatgtccgactcagcaaagctcgtcgacagcggatgcgttttcaccattaacaatcgctgaccctccgccgtcacagcgtcaaattggcagaaccgaactgatg

SEQ ID NO: 62134 - DNA, 515 bp, Heterodera glycines
  Genomic contig location: Contig_ID=SeqID_31828; Location=212..726; Strand=-
  SCN-specific regions: Sequence locations=1-80,103-155,183-202,242-493
  Gene Ontology: Mol. function=transcription factor activity; Cellular component=nucleus; Biological process=transcription from Pol II promoter
atgagcagcgcccagccgttgcaaatgcggcaacagaccgcgcaaatgggcgggtttgctcacaatcagcagcaaatgatgcagcagcagcaacaaaacagtgattatcagctacatttttgcgtctgtaaattaaattttcagtgcaacaaatgcatccccagcagcagcaacagcaaatgggcatgctgaacgcacagcaacaatttatgatggcacagcaacagcagcagcaaagggcgatgaaccaacagcagcacagacaatactgactgatcacattcttataacccaattgaatgtcaaacctttcggtacttttcaattttgggcttagatttgaattcttaaaaaagcaacaaagtgcgcgcagaattgcacaaatttttgtttccgttataaatctatttgaggaaatcttagctcaaattgtgggatttatgcccttgatataattttgacgtgcaatttttgcaattctgtgcggcctttgttaatttaaaaaaaaaattaaa

SEQ ID NO: 62135 - DNA, 160 bp, Heterodera glycines
  Genomic contig location: Contig_ID=SeqID_31829; Location=1142..1301; Strand=-
  SCN-specific regions: Sequence locations=1-64,94-160
atttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttg

SEQ ID NO: 62136 - DNA, 759 bp, Heterodera glycines
  Genomic contig location: Contig_ID=SeqID_31830; Location=226..984; Strand=+
  SCN-specific regions: Sequence locations=1-4,26-39,158-224,255 -259,282-288,374-428,458-474,593-660,691-695,737-737
atggaaattttaaataaattaaaaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggaaagcaatgaaagtaatttaaataggcatatttaaaagagctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaaaaatttttcgaaaaaagctaaaaaaattgaaaatttaaataaatttacaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggaaagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaa

SEQ ID NO: 62137 - DNA, 354 bp, Heterodera glycines
  Genomic contig location: Contig_ID=SeqID_31830; Location=370..723; Strand=-
  SCN-specific regions: Sequence locations=1-41,71-125,211-217,240 -244,275-354
ggaatcgaaggtgttgtaagcttttttccttttttcacttgtaaatttatttaaattttcaatttttttagcttttttcgaaaaattttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaatagctcttttaaatatgcctatttaaattactttcattgctttcctttcgcttacgaccatacca

SEQ ID NO: 62138 - DNA, 359 bp, Heterodera glycines
  Genomic contig location: Contig_ID=SeqID_31830; Location=805..1163; Strand=-
  SCN-specific regions: Sequence locations=1-129,215-221,244-248,279-359
ggaatcgaaggtgttgtaagctttttttccttttttcacttgtaaatttatttaaattttcaatttttagctttttttcgaaaaattttttgtttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctttcctttcgcttacgaccatacca

SEQ ID NO: 62139 - DNA, 107 bp, Heterodera glycines
  Genomic contig location: Contig_ID=SeqID_31830; Location=1245..1351; Strand=-
  SCN-specific regions: Sequence locations=1-5,28-107
tttgccttttttaataaattctcttgtgaaaaggcaaaaaaatagctcttttaaatatgcctatttaaattactttaattgctttcctttcgcttacgaccatacca

SEQ ID NO: 62140 - DNA, 409 bp, Heterodera glycines
  Genomic contig location: Contig_ID=SeqID_31831; Location=190..598; Strand=-
  SCN-specific regions: Sequence locations=1-12,34-38,60-409
atggacacatttgagaccaaagaaaagtttattgaagtggaggaagaaattggaaaggtaagtaatcatatggaacgttatgagacgttcacaaaggttcgatttgggaaaattgttgaaaaaatgaaggaggaggttcggaaaattaccgaaaatttggatgctctaaaaggccgagtacaattgttggaatttgaacaagataatccagagggatttggtgaatggtttgatgacggacaatcccaagaacataatcgattgcctgacgacaaaggggcaacggaaggggaagacaacatcccaattggggacggaagttgcgaaattatggttgcagatccatttttagggggaattacccccctcgagagggttatgatggaaacccaagtgtatcattctcacg

SEQ ID NO: 62141 - DNA, 2528 bp, Heterodera glycines
  Genomic contig location: Contig_ID=SeqID_6597; Location=653..3180; Strand=+
  SCN-specific regions: Sequence locations=1-200,223-425,447-852,874 -1492,1515-1960,1982-2231,2262-2506
atgcgggtgccaaggtcgaacgcccattacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgctggtcgagatttgtctcaacgttttgaacgggagtttctgtctgagcaggaaacaaaagcagagacttgagccatttgccaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccatacgagcactacaaggggctggttgcagcgagggagacaaagaatgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggtgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagacgatcacccaggaccaataagaaagcagcaaaacagcaaaaattgatcgagaagaaggaccacctgttggccatcattatgtctgatccgcagagattcggcgcaacagaccgtggaaaaatcattaacccaaagacaggccgagagttcattgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaagcgggcgttttattccctcaaaatggacaagaaaataaacaaaatatacaccgacccggccaatccgggcgggtatgcgggggcgagtgctctgtacgcggcggtgaaggagaagcacccgaagttgaagcgtaccgagtttgaagactttttgcaaaggaacaccacctacacgctgttcaagccaaagagggagaagttccgacgcctacgcactgtgcctacggggttcatgaccggtaagttgtaccggggcttattgcgcacaattcagggttcagatgttcaggcggacttggccgatttccaagccctttcgcgcaagaacagcggctaccggtacctgctgttggcggtggatgttctatcgaggcgaatgttcggcgcccccgtaaagagtaagcgcccagtggacatgaaaagggcgtttgaggagctatttgagcaaatgccaagggtgccggacacactgtacaccgattgcgggttagaatttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccataaataactcggtgtgccgcgcgaccggtcttagaccgagagaaatcagcgacaccaatgcgagggaggtctggaagagggtgtacggcgaagggcttgtacaatcgaacaagacaccaaaaatcagagcaggggaaacggtcaggattcccgagcctaagcacattttcgagaagggtactgtatttcacacattttttcggtcaatttattttaattttaggttatatacccaattactctgatcacgtttacacagtagacgaggcccgctcaaccaacccccagcactatttgctcaaagactattatggcacaaagttgaagagaaaattttatttgccagaattaacaaaagtacaagtggatgaaagcacaatgtatcgaattgaaaagaaatacaaagaacaagtgagagatggtaaaagagaaatgttggtgaaattcattggatttccggaaaaatattgggtcacaaatgaagaaataaatgaataa

SEQ ID NO: 62142 - DNA, 586 bp, Heterodera glycines
  Genomic contig location: Contig_ID=SeqID_6597; Location=3386..3971; Strand=-
  SCN-specific regions: Sequence locations=1-102,126-586
atggaccacctctgctgcgcgaatccacttgctggaatcgctgaaaaaggtgtatggccctgcaccaggtgtagagcgcttcgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttgtttagccggacccaaggcgtacggactgtggctgcgcaacaacgcaacgggggaggacgagtacaagctcaaggtgcgcggcatcacgctcgactcggatgcctgcgagcgcataactttcgagaagatgaaggacatggtgaagaacaagctgggacagccggacaacaacgtccgcttcaactacccaacgaagaactttcggatcaccaagaagggagagattttcaccgtccccttggtcaagcagttcaacccgaccgtgaataa

SEQ ID NO: 62143 - DNA, 1530 bp, Heterodera glycines
  Genomic contig location: Contig_ID=SeqID_31834; Location=328..1857; Strand=+
  SCN-specific regions: Sequence locations=1-294,322-377,399-499,521 -610,660-831,853-935,960-964,987-1530
atgaaaatcattttcatttccatttttctcattgttttttcctctacaacaaaaaatgtgcgtggcgttcttattggcggcaacataaacaacaggggaacacaaatagttggaagggtaacagtgaatggaccatcgaaagatgacattggacgaaacataaacaacggtggtggaacacagatcattaaagcagtgaatgtaaaagatggagcagtcatatcggatgaagaagaaacgaacacaagcgatgctgaaatggacgaagcctggagaagaagcgatgacaaaggcaatttaaaaattaaaatttaattttatggaaaaaggcaaattccattcgtagaatataagtaaaactgaatccatagctaggattgtttttcatatttttcaaaagatcgaaaggaatgcgttaccagcggcacctttcggcaccgccggttcccagcacatttggcactttagtaatatatttctttttcttcaatacttttacggtctttttggcattgcacactatctaataaagaagaaacccaagtggtggtgggattttccgaacgaaactttcagcgtaggtaaatcagtcccccctctttgtgttatcaattttttaaaataaatttgaaaataatttatgtttttaatattttttaggtttttctgagaaatttaaccgtaacgatagtgataatgaagatactgctgaaggcaactcttccaatgatagtgaaattgagaagggcgcgaaagcaaagggtgttcgacacaactcaaagaataaagggatcagcgaatcgtcgagaggaagcggtgactttggacattggaagggatggaagggtaattttgaacactaattttatcttattaaaaggatggagagaatttctatctatattaaaagtgtcattaaaaggcatattttatctcataaaaattaaataaaagaaagaaggtgcccggcggtgtctgtcaattatttaataatatttctcatcttcaatattcttttagggtgcgtaaatcaccccccccctttttgtatagtaatattttactaatattttagattttgaccagaaatttaaccataaagatagtgatagtgaagatgatgaaagcaactcttccaatgacagtggtggtggcgacgttcaagaaaagactggacaacccaccagaaactattggaaatatttgaagaaagttccggtgccttttctaaatacgtttcggaattctttcaaagggaacagtgaacacgtggctggagaagagagaccatcgcgggagaatgttcttgtgcccaacataaacacgggtggaggtagccagcacattgcaccggtaaattttggagaaggagcgaaagggaatcaagttgggggaaactattgctctggaggtagccagaacattgcaccggttaatcttggagctggattgaatctggctcgtgttggaaacaacaaaaacagtggtggaaaacagacgattggagcggtaactattcgtcgatcgtga

SEQ ID NO: 62144 - DNA, 230 bp, Heterodera glycines
  Genomic contig location: Contig_ID=SeqID_31836; Location=53..282; Strand=-
  SCN-specific regions: Sequence locations=1-230
cgtccgatgtctctctgttggccttctcgatgccattccgaagcgtttttggtccattctttgggttgactgtcgcgttcgttacgccgttctgacctttctttttcccaattgctccatcccactggtcgagccccacctgcacgagtcttctgctcacgttgcttcaccgtgttttgcttgtgttcatttgccttttcttcgtaccaatgagtcggaatcgttggaaa

SEQ ID NO: 62145 - DNA, 905 bp, Heterodera glycines
  misc_feature (887)..(887): n is a, c, g, or t
  Genomic contig location: Contig_ID=SeqID_31837; Location=443..1347; Strand=+
  SCN-specific regions: Sequence locations=1-232,254-299,322-565,604-905
atggcagagcagtttgcacaacctgaaacccaggagcaccaagtgaaagaagctaaggaagcacgagttgatgaccgtttcctttggaaaatcacgcggggccaatttatgtttgcaattcgactaaaaggtgcaggaaataagcagcaaaatttaaagaaaaccattaatacttaatccaatttgctgaaagaaactttttagatttatgtattattgagtttctacaaaaattttctgttttatcaaaaatttgagagtgtgcattcaattctttgagaaaataagttaattaccctcaaaaaattgggaaatggagcaaaatctgtagagacactgtctaaatattctttaattaatacactaattgtccctcttattcaggacgccgagatcaaagagctcagacaggacctagcggaaaaggtgctggataaggacccatttgggtatcccaaaaattacaaacgaaggattcactattaggaaaagatgatcacacatcagcaaaaaaaaataaggcagtttgaaagcgatcttcgcgagcttcgacaaattgtaagtgtatttaaacatttttttaaattttaatatttaaattttctatgaggttaatggaatcgccgtttcccatgtttcaacaatgcccacttcatctgccgtcgccgaccaattcattgccaatgacctttacgaaaaaaaagggtggaagaatacgaaatcgaactggccgggctctctgatcagcgcaattggcagaaaagcgaggaggaacaaaatttagcgcaccatttgtgggatgccgtaagtttttctgaaggaattcatcatgtattttggggtgaaattcggcggggcatttacaagggatgggcgggattagactnaaaatttaattgggcata

SEQ ID NO: 62146 - DNA, 108 bp, Heterodera glycines
  Genomic contig location: Contig_ID=SeqID_31839; Location=6..113; Strand=+
  SCN-specific regions: Sequence locations=1-108
cagctgcaggaccaggtggaccagctgaacaccgaacggggccaccttccagcggcgccttcgtgcattggctaaccaattggggcgcgattgatttggtcgcagaat

SEQ ID NO: 62147 - DNA, 1641 bp, Heterodera glycines
  Genomic contig location: Contig_ID=SeqID_31841; Location=379..2019; Strand=-
  SCN-specific regions: Sequence locations=1-20,44-335,365-492,514 -853,875-922,945-1162,1212-1263,1312-1462,1490-1641
  Gene Ontology: Mol. function=mannosyl-oligosaccharide 12-alpha -mannosidase activity; Cellular component=integral to membrane; Biological process=N-glycan processing
aaaaaaaaggggactgaaattttctatttccaatttgttaattgaatttggatgccttttttttgttttgcctatgcgccaaaagtgatcagaaaaagtgctgattgttagatgggttaacaacacatgttttatcatgttatttttgatttattcgaatgtttccccattgattattccaaaaaagtttaagagtttggctgctttttattctttgatttttttttaaatttgctactgtacttttgatttcttacttttttttactgatttttcccaacttcacaaagtgatggtcccctttttttctgctggtcactttcctataggaactcaaaaaaaaacaattttttaaattatttatgaaacctatttttaacatttaaaacttacgaacaaaccaaatgttgctttgctaatgtattgtaataaggttcaatgttgctggtgttgagcatgaacagttgatgagtgcggagaatgttgagaggcgtaaagcagcagcaacaacagtgcctgacctgtacattaaggtggaaaaaaattgaaaaatatctaaaattcaagaaaaatctgtttggaatgatgttactgaaaacaaaatttgctgaatttccaaaaaaaaaggccaaaaaatacttgacaaaatttttgggtgtttttttgtatttgcaaaaattatcgaatttttaggataggcaattaaaaaattctattgcattgccaaatgacaatttgatgtactgtattgtacagtttcctaattcggtgctttttagccgcttgacgcacattctctgcttcgtcccgaggcatttgaaggtgggtcgcacttgatggagagaatgacacagaattttttaaacaattttttgagacattttagcatggttttacatgtatcggctgaccggtgacaagcagtaccaggactggggctgggacgcatttcaggtgactataatccacacggccaacaggggtgtatatcttcggcgacttttttttttgttgctccaccttattttactaattttgccattttttcaattgaagtggtagggcccggcggtgccgatattcaccacggaggagaattttgagaattattaacgaaatatatattaattcagaataaattagaaaggtattgtaaaatgagtaaattaaaaaaatatttattttcatacaatttattcaattataaatatgttgagagcatgctagatagactctgtttccaataaaaaatggaaattgttgaaaaataatattgaatttttgatattaatttacatatattattatattgacaggctattgaacggtacgccaagcggtcaaatggtgacggctatgcttcagtgcaaaatgtcaaacgaattcccgttcaacaccgggacctgatggaatcatttttcctagccgaggtgggggtttaacagtgtttgaattttactcttttttgaaaaatttgaatttactatttatgtatccattaaaaaaataaatatggtaaaacactgtaattttcagtcgctcaaatatctgtacttgttgctctccgatgaccaacaaatgttgtcattggaccaatgggtgttcagcaccgaagctcatcccttgccaattagaaccttt

SEQ ID NO: 62148 - DNA, 605 bp, Heterodera glycines
  Genomic contig location: Contig_ID=SeqID_31841; Location=1204..1808; Strand=+
  SCN-specific regions: Sequence locations=1-303,325-452,482-605
atgcctcgggacgaagcagagaatgtgcgtcaagcggctaaaaagcaccgaattaggaaactgtacaatacagtacatcaaattgtcatttggcaatgcaatagaattttttaattgcctatcctaaaaattcgataatttttgcaaatacaaaaaaacacccaaaaattttgtcaagtattttttggcctttttttttggaaattcagcaaattttgttttcagtaacatcattccaaacagatttttcttgaattttagatatttttcaatttttttccaccttaatgtacaggtcaggcactgttgttgctgctgctttacgcctctcaacattctccgcactcatcaactgttcatgctcaacaccagcaacattgaaccttattacaatacattagcaaagcaacatttggtttgttcgtaagttttaaatgttaaaaataggtttcataaataatttaaaaaattgtttttttttgagttcctataggaaagtgaccagcagaaaaaaaggggaccatcactttgtgaagttgggaaaaatcagtaaaaaaaagtaagaaatcaaaagtacagtagcaaatttaaaaaaaaatcaaaga

SEQ ID NO: 62149 - DNA, 525 bp, Heterodera glycines
  Genomic contig location: Contig_ID=SeqID_6598; Location=908..1432; Strand=-
  SCN-specific regions: Sequence locations=1-334,356-422,445-525
atgccaaagataacggacacaacaatgacgagcagcatgacggcggcacggcttccaaagcggactttggcggcaattcgcgttcatccaacggtttcaagcagtccaatgccgtgccgaaaaatgagccgtccaacaatgtgtccaatgtcgactcaaccatggttttgggtatacaaaaacgatggttcaacaacagcaacaacaatggcgacaacagtttttgttggtgaacttggcggtgtcgtcgttgtcgttaattgtcgtcaaaaatgccgagaatgatgatgatgacgggaggaatggcattggcatcatttactggttgctaatgaggtgatgatgatgatgtttttggaagatgtgtcaaagctgttgaagaagcaaaatgtagaagaaaaaaaagttggcaaattttgtgatgatgaaaaagggcaatatttttaaatctacaaaatttaaaaatttagacgggggataaaattgtggaattttcatgaaatttatggtgaccttggtattaaa

SEQ ID NO: 62150 - DNA, 77 bp, Heterodera glycines
  Genomic contig location: Contig_ID=SeqID_6598; Location=4981..5057; Strand=+
  SCN-specific regions: Sequence locations=1-77
ctcgaaaagtagcttaacaacagcccaaaaaaacatgtttttcgtgcgtttcaggccacggggagctcaggaaaaaa

SEQ ID NO: 62151 - DNA, 71 bp, Heterodera glycines
  Genomic contig location: Contig_ID=SeqID_6599; Location=1182..1252; Strand=+
  SCN-specific regions: Sequence locations=1-71
atgccattggctgctgcacggcaccgaaacggtgccaaagacggcggagcagcgcacctttacactccgtt

SEQ ID NO: 62152 - DNA, 276 bp, Heterodera glycines
  Genomic contig location: Contig_ID=SeqID_6600; Location=4..279; Strand=+
  SCN-specific regions: Sequence locations=1-276
tctcagctcgtggaagcagcgattggaggagacagagggcggcgattcgggcgcgacagagacggcaacgacaatgggcaccgcggaccgaagcgacggcgaccacaatggcccgagcgactattgccgccactgcggagacggaagaagtgtccggcgactgtcccgtggtggtggtcggcgacggcatttccgccgcggacgcggtgctgcactgtctgagcattgaacagcccgtgctgcacattgtccgtcgtacagagcgcgagctgagaa

SEQ ID NO: 62153 - DNA, 646 bp, Heterodera glycines
  Genomic contig location: Contig_ID=SeqID_31842; Location=827..1472; Strand=+
  SCN-specific regions: Sequence locations=1-382,404-429,459-646
atggttatggtgccagaaagcgagtatttggctctcattaatctactgaaagggagcagcggcgtatctcctcctctagccgatccgttacagggcgagaaaacgctgcttgatgtacagattcaaaggaatttggctgatccaaaaacgaacgcagaaataaaaatgaagcgtcactcatggttgtacaagcgtagacaccagctaaaagatattattgagaacaaacctcaaaaagtaattgttgagagtggctcagttacagcaccaaacgttgcgccgtatatgggcattcaaaaacaacaaacaccgtccaatgtgaacgcacaacaccgcaattcgacatcaattcaatcgtatggtggcgtaagtaagagcaacactgatgtagaagaggacacggacttttcaactgcctctgatcagtttgagcctgctgctgctgatgctgctactacatcgtcgaggaaaacgccacaccaaaagacgccagccatttcattaaggaccagtccgaaaaatttcccaaaattgatgggtattatcgggaaggatctcaaaaaattcggtgtcaatgctagcagcggagaaattttgactaatttcaataaacccgtttcaggctctcatttcaccgaatcgttaa

SEQ ID NO: 62154 - DNA, 80 bp, Heterodera glycines
  Genomic contig location: Contig_ID=SeqID_31843; Location=667..746; Strand=+
  SCN-specific regions: Sequence locations=1-80
atgaaggccagcttcggccggtgggctgatcgaatgaaagaatgtttcggagacggcacattctcattggcacctccaat

SEQ ID NO: 62155 - DNA, 1299 bp, Heterodera glycines
  Genomic contig location: Contig_ID=SeqID_31844; Location=179..1477; Strand=+
  SCN-specific regions: Sequence locations=1-4,245-315,356-420,442 -471,494-516,538-575,597-685,728-976,998-1131,1188-1299
atggtaaaaattttaattccttatttaaaaatttaatttaaaataatatttaaaagatatagaacatttttttccattaaaattattcaaaatgatctgattgaaatatcaatgattaaaaacaatctttttttaatgctttattattttaataaataaattttttaaacaataaaatttaaaaaaattaataatcattgattaaattcattttatattccaaataatttttaaaaattattttgaacaatatagaatttcaaaacgatttggttgaaaaattggtgctaggtcgaacctaaaaaagtatcaatgattataatatttgaatttaattattgtttaaatattatttgctggttaataaatcataacttagctcaaaattgataaaattaaacaatcttgagaaacaaccaatttaattttgtttatataattagatagccaaaagatttctctataaatcagttaaatttaaattttttttattgggtataaaaaaagttagggaccatataattgggtataaattttacgaaattttttgtcataagtttttataaatttttgccaaattttttaaaaatatataagataatggagggacatgtaaagctatcgctaactactaagattctttaattttatcaagtttgtgctaagatatgatttattatacagcaaataatatttaaataaaataattaaatttaaatattattatcattgatacttttttaggttcggctcagcatggaaaaattaatattcaacctaactacataaaatcaaaatgaattaaattactattcaaaaattaatcccaatttcaggtagccccacaacgtgaacaatcagttgacgacagcggtggaccatctgctgcagaaacagtgccattaatagagcatcaacttttgatgacggatcaggaccagctgaacaacaacattgttcaacaacaaaatctgtatcagcagcaccagcacaattttgtggcaccgtccatcttggtgtcgtcgtcgtccatggagaaaagtgcgtcggcacaggacttggccggcacggccgcagcgctgatacgacggcaccgcagtgcgagcaaagtttggacacaacaaataacggaatattaattaatttaaattaatatttctttattgaaaattaatcattttttttttgagccccggacgggttcgatggtattgaatctttttatctaaaactcaaaaaattctgaagtaaaaaattgaaaaatgcttgccaaatttggctaatattcgatccttttaa

SEQ ID NO: 62156 - DNA, 898 bp, Heterodera glycines
  Genomic contig location: Contig_ID=SeqID_31847; Location=132..1029; Strand=-
  SCN-specific regions: Sequence locations=1-122,144-210,247-289,317 -430,466-605,629-898
atgtttctgtacgacggcacccaacaatggcccgaattgttgccaacgctgtgccaattcctggaccagaaccagcaacacgatgccaatgtctttgaggttggactaacggacgagtgcatttttaaaagtttgcttttaaattcaggcccatagcaagaaaaaaattcggaaggagaatctctgaaaaatttttttcatcttcgggtcaaaaattttttatagtttatttttcaaaaattttatcgccggagcgaaaatgcagaaattaataacggttttgtgccaaaaaataacaaattttgttattttggagtcaaatttctagaaaatatgggaaatggaggtttggctgtgccggtaggcgccaccagtgaaatttttttaagttgttttaataaaatatgatatgaaattgtgcaaaagtttcaaaaatataataatatttttattttatcaaatttacggttttccttattggttaccttctccaagagctctctgaccaaaattttcccgaaaatccattcggtgaaatctgttgacaatttgtccaaaatttccaaattttcccgacacctatcgctactgtcggcacaaaaactcataatttttcaaaaaatttttctggtatgcctatcatttatttctgtttgttcagggtacgcttggcgcattgcaaaagatttgcgaggattcggccgaccgtttgtcccacgaggagatcaaccaagtggttgcccgtgtgttgcccttcttcaactcgcagctcgcccggctccgtgccctctccgtcagcacggtcaactgcattttgctggtccaaaacgagtctatcagtgccgtcattgatcctttcctggagtgcctgttcaggctggccaacgaccaagaccag

SEQ ID NO: 62157 - DNA, 646 bp, Heterodera glycines
  Genomic contig location: Contig_ID=SeqID_31848; Location=632..1277; Strand=+
  SCN-specific regions: Sequence locations=1-361,390-646
atgaaatggaagaaagaattcggaatgagttggaaaataacggagaaagaaaaaatgaataaaatgaaaatgtattggcaaataaaaggagaaaatcaaaaaataagtgatgaaaacattgcaaaaatgttgaaaattagtggtaagaatattcgaagatggaagaagaaatttggagaaatttaggatgccgagaattttatgaatagggacaatatcgggcacgaaattttggtttcttttttcatgtttcatgcctttttgatttattatttttttgtaaaaggctcaatttttttcgtattttttgtgttttatttttcaaaatatccagaagccgatccttaggtgtgtattttttattttactgaatatttattgtgaaaatttcaaaaaaatagatgaaatatggattaaaaatccaaaaatttcggggccgggggacttttggcacaggatcgtacgcaaaagccaagtctgggcatttttcagtgcaataattttgcacaatttcaattttttcttcatccgaagtcaatttgtgaaattatattggcctaatttttgttcaatagtaaatatattggcaagtgatttgtgcccaattttttcactattttttttcaattttccccattcttgaaca

SEQ ID NO: 62158 - DNA, 898 bp, Heterodera glycines
  Genomic contig location: Contig_ID=SeqID_31850; Location=596..1493; Strand=+
  SCN-specific regions: Sequence locations=1-56,891-898
  Gene Ontology: Mol. function=transcriptional elongation regulator activity; Cellular component=nucleus; Biological process=viral replication
ggaacggaagaagaagcgggggggggggacaacggacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaagggaaaagc

SEQ ID NO: 62159 - DNA, 540 bp, Heterodera glycines
  Genomic contig location: Contig_ID=SeqID_31851; Location=930..1469; Strand=-
  SCN-specific regions: Sequence locations=1-176,222-540
atgagagatgttgtcgtccagagatcaggaacagtcccaggattttgcatccgccatcaaatttatgattcctcagtttcgtacgagttagtgtcctccttccaccggttgccaattcaaaaaaaaggtgtacttttctagtttacatgaccaatttatatgcattttttaatgccaataaatatgaataaattatatatttctgtttaaaaaatttttaagggtttcggggtcactcactgattacgaatatgacattcatttcgacaaatttcgaaaatccggacccgagttcgaacaaaccagtcgaatttttaaagtaatgcttgagttataaaatttgaaggtttgacttaacgatcaagttctgggccggggctcacaataattcgtcgaaatggatgtcatatgcagagtcggtgacccagaaaattctcgaaagccttttttattatgtcgtttttaaaatgtatatgaaggtggtcatgtacattttaaaaagtacaaaaaaaaggatttacagcaaatttgaaaaataaa

SEQ ID NO: 62160 - DNA, 314 bp, Heterodera glycines
  Genomic contig location: Contig_ID=SeqID_6601; Location=905..1218; Strand=+
  SCN-specific regions: Sequence locations=1-92,140-314
atggggtacggtaacccttcgctgttccttttactttggctcccggtaaattggacaccagaaaattggacaccgaaaattggacactgttgtaaataaaaattaaaataaacaaaatatattaataaacaaaaattttggcttggcctaaaagatctttatcttaatctgcacatatgttgtttataagcgtaaataatatggaaatgaatttgatattatttttgtaacatcagcacgagaagaaaaacatcatatcattcctaaagaaaaagttttattacccatttttcgtgcattatttggcacattga

SEQ ID NO: 62161 - DNA, 570 bp, Heterodera glycines
  Genomic contig location: Contig_ID=SeqID_6602; Location=212..781; Strand=+
  SCN-specific regions: Sequence locations=1-39,62-141,165-247,281 -334,385-473,497-570
atgtgccaccaaattggagaaactcgacgacctttgttattgtgtggatgccaaagagagatgccaccaccgcaaatggtaggagaaaaagcacattttgattggggaatttatgtgcattaatggagtttctcaattgatcaattttaaatggattttaaatgggtttgaaatgtgttcgatcgcctctaaagccgaattgtaattaaaaatattgtgaaaatttgaaaaattattaagggtaatcaatttaattaataataatattttatatatttttgcttttcagctgttctgtccgcaacaatctcgctttgaattttcactgattttgttgatgcaaaaaagaaaatgaattatttttcattttatttattgagttctaattaattggaagaaatttattgcgtaaatttatgaaaaattcttttcggattttcccaatttacgaattttaatacttttcatattgagaatttaatttaaatgttttttccattttctcactttgttcaaattgaaaacaaaaaattatcatgccctttgatagctgctggtggacgccttcaa

SEQ ID NO: 62162 - DNA, 689 bp, Heterodera glycines
  Genomic contig location: Contig_ID=SeqID_6603; Location=121..809; Strand=+
  SCN-specific regions: Sequence locations=1-296,318-633,657-689
atgtactactgttttggtgttactgtacagcaggactatgaccagcaaatggaaatggtgctcgtgcctttcaccacggtgctcaacaagcccaagtatcaagcgattgttgcccagctgaacacaatgccaaaaagtgctgctgattgtgcgacttttggatacggtaggacaaaaactaaaatcaaaattttgtgaaaaaatactttaaatttacagatgttttcttggtggaccctttgatcgaatatgctaagcatttcgcattggaaggaatgtttaaggcctacaaaaaagtacagtttaatttttgtcaattttctaagagaaatgaggcaaaatattagagaccggacaagagggtcggtcggtcggtttcggtataaaaaccgaaaaaaaccgaaaccgaaaaactcaaaaatttctcggtcggttttttcggttaaaaaccgaaaccgaaaaataccgaaaaaaccgaaaaaaaaaccgaccggtccgatctctacaaaatatggtctcggctttcccacgcctcccttcacattttctcattaactaattcttccacttatttattaaaattatgataaaaaactcaaattggcatttttgggtaatactgaagaatggcggtttcccttttttgggataaaaaattcatatatgggggtttaacgaggtgctcaaca

SEQ ID NO: 62163 - DNA, 872 bp, Heterodera glycines
  Genomic contig location: Contig_ID=SeqID_6604; Location=1372..2243; Strand=-
  SCN-specific regions: Sequence locations=1-532,556-600,622-776,798 -817,839-843,866-872
atggcaccaaaaattggcatccgcgttggcctctttttcttgctcccgtcgctgctccttttgcccagcgctggcaatgcccagtactacagcccgccgatgatgaccggctcgggctgcgtggccaccggcaacaagctgtactcacatggggtaagcccagcagccgaatcattcattcctttttttgatgattcatcggattttaaaccaaacggaaaaaataaatttgttgctcttcgcccctctcgaattagtgcctaatttgtcaggcgttacgattgcctttgtcagtttaaatccctacgtttaaatctcgccaaaataaccctacgaaaacaataccccccccaaacgaccatgttttatgcgcttatggaaacattttattcatttaaattttggcagaattttatccgtgaactgagtgccaaagagttggcggagatggagaagtacaaacgtgaattggttgaatggaagcaggtggagaattaatgagcaaatttacagcaattaacaactccgaaaatattctaaatatgttacaaaagaacacaaaatggcattttccaattttggccaatctccgttgtgcccaaattaatttaaaaaattattcagaaggttgatgatgcatatgccagtttggagcaagctgtgcaacgaaactccaccactttgccaacaattccgcctcgtccgcaacttccgactttctgtacatcaaatcaggtcccgattcttgggactttaagttcaaggatttttgtttataaatgaatcaatttttaaaatgaggaatcacgaaatatcgaaatgctattaactagggaatccgttcaagagccaagaaaaacaaaatgaataaa

SEQ ID NO: 62164 - DNA, 1189 bp, Heterodera glycines
  misc_feature (1121)..(1121): n is a, c, g, or t
  Genomic contig location: Contig_ID=SeqID_31852; Location=70..1258; Strand=-
  SCN-specific regions: Sequence locations=1-162,194-503,526-681,703 -1121,1143-1189
  Gene Ontology: Mol. function=protein binding; Cellular component =cytoplasm; Biological process=protein modification
tccgccgattgtaaattaagtctttgccaatgtttttagtctattttctaatcaaaattgtcgaccttctggtccttttttacagatttttttttgtacgatacccgaacaattcccctctctcttttttcatggaaactgaaaacgctggtgagccatgcctttaaatttttgatttttttttaataaatttcatttttcttcaaagaaacagaggaaacacagcaacagcaacaacgaccatttgcaattaagcgatggaatttggtgtctacatggagttgggacgtggagtgtgacacgtgcgccatttgtcgtgtccatttaatgggtcattgttacctaattgttatattaattaagtaaaaggatggactaactatttggaccatatgtaattaaagctcaacattatgaaaaaagactgggcttccatgttggcctggatttcattgacaaaaatcaaggttaccgaaaaacacccgagtctgattcaggagaaaccaattttttccccaaagttgacagactggaaaacatgaattcatcgctcaaaattttcccgtgccgggaatatttttaatttggataagaataaaaagtagaatttttagttgattgtccaatagatttccaaatttttcagaggcatgcctccgttgtcaggccgattcaaaggcgcaagaatgtgtggtcatttggggcgagtgcaaccactgtttccacctttgtatgtgtctcacattgggttatttatattcccggaggctttcgggggtcgctctgaatagaacacgaatctgacatccatttccacctgtttgaatcccgatttgggcaattgaacttcgtaaatttgagttttcgaatttttgtcgggttaggaatttggttattggtcgaaatggatggcagtttcgtggtcaatagaccccgaattatgatgaattactgtttttttttttttgaaaaattttccaagaaatcggtaaaaaaatttctattttttttttgtcattacaacaaatggggggtggggttattttttcaaaatgtgttttttcatttttcaaaaatttgacgaaactccccccccccccttacagggttgtatgtctctngtgggtgaagcagaacaaccggtgcccgctgtgccaatcccgattgggctgtccaacgagttggaaag

SEQ ID NO: 62165 - DNA, 755 bp, Heterodera glycines
  Genomic contig location: Contig_ID=SeqID_31853; Location=1537..2291; Strand=+
  SCN-specific regions: Sequence locations=1-109,145-388,410-755
atgcgcgggctccaaataccggcgaatttgcacaatctcagcgaacgctatcaggtaaatcccattcattcattcattattcgtcattcgtttaaattcctccaatttcatttttataattttattttatttaaattaaatttagttggccgaaaatattcgaacggggcgccaactcgcgccgacttttctgttccatttcattaacatttgcgggtccgtcttcaccccatttgtcgtctattttcatctgatcaccgacccaattttgctgaatttaattgtgttcacttattactccgtcctttctctcagcaacgctttgattgaattgactttaatgaggtcattaaaagtgataatagaataaaactcattatttaaatgcattttaattaattaatttttagacgtcatcaaattttgaagaaaaatgcattgaaaattttggcaaaatttcttccaaatcgctgcttctccaataatcgcatcactgacagtggcaaaagtcagaaaatggtccaaagaattgacgggcaaaagcggtgggaaaagccacagcaaaaaagagacaataaaagcaatgaaatgacggaaatgcactttaaaaagttgaaggaacagtggcaaaagtgaaaaggaaatttgtgaaaaatggaaatgataaaagaaaaggaaaggtgaaaatgaagtggacaaaatgaaattgatcattctgataatcgtttgaccattttattattgacttttggcga

SEQ ID NO: 62166 - DNA, 176 bp, Heterodera glycines
  Genomic contig location: Contig_ID=SeqID_31853; Location=2233..2408; Strand=-
  SCN-specific regions: Sequence locations=1-1,27-47,78-176
cttaaatatttattttaaataatttaccacataaaccatttattcacttttcaataattttaaataacttaattaaggattgaaattgtttctgactttttttagttttagttttattcgccaaaagtcaataataaaatggtcaaacgattatcagaatgatcaatttcattttg

SEQ ID NO: 62167 - DNA, 1233 bp, Heterodera glycines
  Genomic contig location: Contig_ID=SeqID_31854; Location=114..1346; Strand=+
  SCN-specific regions: Sequence locations=1-308,367-375,397-449,471 -553,575-842,869-1134,1156-1233
  Gene Ontology: Cellular component=chromosome; Biological process =chromosome segregation
atggcaacaaaaagtgggactgttcaagaagttgaggaggagcaggatgaaggaagacaacaaattgttggcctatccgccgatgaaacggcggaacatttggcaccaccggcggagcggcaaaaaatgccaaccgccgcggcacggcaaacgcattttgcggtcaaagtgtaccgggcgacgttggccggctttcgcaaccgagcggagtatgtgaaggatgacttccgcttcaaaaacccacgccgtgtgatgaaaatttgggcggaaaaggagtttttgaacctcaaaaggtatgaaaaaaaactcgggaaaaattttttgggatttcttttgcatctgaaattctctaataatttaaaattttgcaaaactattcaaagtttttggattttctgtatttctctacccttattagccacattttccttggagcaggtcattttctcccccaccaatttccaaaaaagtattccaaaaaatcgctttttcgtggaaatttttttaaattttcggtgaagtgcaccccattttcatttcgtttactgtgccactgaaactcagactgaaaaatgccaacattatgtgcccgacgccaatcaaattgcgcaaacacgtgctgctgatgtcgatggttggcgaaacgtacccggcgccgaaattgaaggaattggaatgggtcgacgacgcaatgcgacgggacgcgtttgaaagagtcagacgagtaagtttaaaaggttcgaaaatataaatattttatgattacaaattgaattgagcgggactggtccggcaatttccggtttcccaggtcccggaagaaaaaaaaaatttttgacgcctctcccccgttttgttttttgttacaaaatggcgttttatttgtatggacatctttcccatttgcgcagatggtcgtcacgatgtacaaacagtgtcagttggtgcacggcgacctcagcgagttcaacctgctctaccacctggacactgtctatgtgattgacctcgcccaagccatggacatttcgcatccgtcctcgctgcgcttcctccaccgggacatcagtcagttcggtgatgggcaccaacggcggaattttgttagaaattttgtccaaaacccaaatttgaaaccaatggcattctcttgattcgtgaaaacatatttatatgggttttcagggtcactgatcacctgacattcagcccgggattcgaaattgggtcaaa

SEQ ID NO: 62168 - DNA, 684 bp, Heterodera glycines
  Genomic contig location: Contig_ID=SeqID_31855; Location=114..797; Strand=-
  SCN-specific regions: Sequence locations=1-684
atggcagcgcggcacttcaaaaagaaaacaccgaaagaggaattgcctaagggggcggcggaaggcgacggggaggggacgacggaacgtatgccatcgacgacggaagaggcggaggacttggaggaagacgaagaggaacggcacaacgccaccgaagcaggaaacagcgttgtcaacacgcactactgctgtgagtgggggggggggggaagcgaagcaccaaccgaccccagcaatgcttttatccgaagttccctttccgcgaaaaacatgcatttttagatttggaaagtccttttaacgatgatttgtttgcgattatggtaatcgaaagctactgtcctcgcattgtcttctcaaatttcagcagaaccgctggaatttgagctgcgcttgtgcctctgccgatgggagcattgacaattcaaaggtccatttgggaagggacagatttattgttagaaacctttttcagatttatcgttttgatgttctccaatgcgtggatttagacgaatgtctctacgaagaatgccccaaaggttatttttttgttctttttttcactttggacaattcatcgtttttcaaggtcaacagtgtcttaacatgaacaaaggaaaaatctgcgcttgtcccgtgggctcttataaatctaaagacggaagaaactgcattaaa

SEQ ID NO: 62169 - DNA, 55 bp, Heterodera glycines
  misc_feature (17)..(17): n is a, c, g, or t
  Genomic contig location: Contig_ID=SeqID_31857; Location=1..55; Strand=+
  SCN-specific regions: Sequence locations=1-55
cattttttatacatatnttatttacatatttcgcgatttttcttacataaaaaag

SEQ ID NO: 62170 - DNA, 388 bp, Heterodera glycines
  Genomic contig location: Contig_ID=SeqID_31860; Location=804..1191; Strand=+
  SCN-specific regions: Sequence locations=1-388
atgaaaagtatgtctcaatttttttaaaattcgattggaaacttgtaattgaaattaaattaccaaattttgcgattttgtgccatttttttaagaaaaataggagttttgggggcgcggcggtgccgataggcgccgccgggggaaaaattggaaattttgatcatttataaacaggttttcactgaaaattagccaatttataggtaaaattttgaaaaattttaggggaatttaatccaattcttaggggtgtaaaagtcgtgtttcgcgccaaaatgcgaaacgcgaaagcgaaagtgccaaaaaagcgaaatatgcgaatgcgaaacgcgaatgcgaaacgcgaaagcgaaagcttatccctgataagtacctaatttataga

SEQ ID NO: 62171 - DNA, 1014 bp, Heterodera glycines
  Genomic contig location: Contig_ID=SeqID_31861; Location=248..1261; Strand=+
  SCN-specific regions: Sequence locations=1-143,177-206,408-631,653 -677,739-760,782-855,877-1014
atggtgattagaagaggtacaaaagtgattataagaggtacaacagtgattagaagaggtacaatggtgattagaagaggtacaaaagtgattataagaggtacaactgtgattagaagtggtacaacattgttaggagaggtacaatattgtttaaaattaaataaataaggaaacgtttttattaaaagttaaaaatcgagtgcattttaatctaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgccccccccctcagaacatgtcccagaatccccaatcacacagggattctgagggcttaacgatgtcaaacgtaaaatctgatcacgtattcgtgatcagcggcccaaataacccctaaagacatgtttttggaagatttttggtgaaaaaaatttttcaatcaaaaatcctgtcacccccctttggtcccgaatcctaaaatcacttttatttttgtatctttttttaaaaatgtgataaaaatgtaaaataaaatttatattatagagaaaaaaattgcggatttttgtagtattttacttttctcaaatatcttttcagaaggcagttacgaatttttttctgaaaaatctaaaatttccagaatttctggaataacttttttcatattgatgttagaaaacctaaataaatcccataaaattctcctgatttttctctatttttaaagctttatttgctcaaaattggtcaacccttaggctagatatgaattttcaaatattaagccaaaatcccgagggccaaaaaactgccaaaaa

SEQ ID NO: 62172 - DNA, 572 bp, Heterodera glycines
  Genomic contig location: Contig_ID=SeqID_6605; Location=688..1259; Strand=+
  SCN-specific regions: Sequence locations=1-546,568-572
atggactctacaaaaccgatcgtgtttttgaaggtcagcctaaaaggaaagccggcaacagttgtagggcgagtcggtgagttgtaagctcttctgtatgaatgattaaaaatggcttatcaaaaattctgggtgattgtttgtattttttcagatacgaagacgtccgttttgtcaaaagcttttgcctctaaaattggtgacattgattcgaacctgcgtggccatgtgacgctcccaactgccgatgtgcccgttgtaggatggtaggaaatgttcgtacttgtcaaaaaaaaatttaatttgttagggtggatgacgtgtcagtcgctttgctcaatgccgaaccatatgtctttgcacaacgttttggcgtcgtggcggatcatcacatgatcgcgtaagtttttgaattaagttaattttctgtgcgacatactgtaaatttaagcttttgcgaacgcaaggtcgatggcgtctttggagccgacttactcaaacgcatgggcattttgaacgaggaacagattgacgccattccgctcgcttctggagatgttcctgaggaataa

SEQ ID NO: 62173 - DNA, 1600 bp, Heterodera glycines
  Genomic contig location: Contig_ID=SeqID_6606; Location=927..2526; Strand=+
  SCN-specific regions: Sequence locations=1-71,93-1309,1331-1488,1520 -1600
atgtctacaaattcacagaaatacggtaagggttgaagtgatggttttgaattttgagtgagtaaaacaattgtttctttagtgtttttaattggtaattttgtggacaagggatggcgtagccaccgatccttggcttcgggcggggagctaaaacccctccacctactccaacgataacgaccttataattttgcatttttcccaaccaaagtatttgaaaactagagagttttatcgaatcttacccaacatatttaggataattaagttgtcttagagtcaattatctattttttacaccatctttaagtttccgtcgaacaatttcaaaatggtcagaaggcacttttggaacgaatcggtgaattggagaaacaattgaaagaacggccgcacaaacaggaagaggaaacggagccaatggcaaagaagggtaaggttttcagagagcgcggtgcgccacgtaatccgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggaacggatcggtgaattggagaaacaattgaaagatcggccgcacaaacaggaagaggaaacggagccaatggcaaagaagggtaaggttttcagagagcgcggtgcgccacgtaatctgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggaacggatcggtgaattagagaaaaggggacagccggacaattacggtaggtttacgcattttgaattttgaagaaacaaagtttacgcaatttcaattttcgaataagcttttccaataacatttaacgaggtcagaagttgttccgatttaaatgtgtacatttatttaaatttgtgccgtccattctggattctttgatcaccacaggcaacgcaaaagaaaattttacattttttcaattttttagtttctgtcgatcaattcaaacgccgaatagaagcaatcgaaaccttcttttatgcatcgatttgttggggttgttgtttgaatttaaaaaataaaaatacttaaattttttgttgttcattatcaggcgaaattccaccaaaggaggacgagaagggaaaatacggtaaggaaaaaagagatataatcgaaa

SEQ ID NO: 62174 - DNA, 612 bp, Heterodera glycines
  Genomic contig location: Contig_ID=SeqID_31862; Location=876..1487; Strand=-
  SCN-specific regions: Sequence locations=1-464,487-588,610-612
tccaaattgtttcttccatttttcaattacggtacggccaaccccaattttcttacaaattttggcataatttttcttccattcttttcccaaatattttcttcctttttacttaattcatttttcattacatataaattttagaacaatttcacttttttgttcatccgtttttgatttgtggcttttatttattttttttttcttcttccaaattttcttcccatttttctccaagtttcacttttttcttttttgctccaattccaatttgtccaattaaaagtaaaaaaccaaacaattaatatatactcaaacgaaaaaaataaatatgaggagcaattatcagagaaacttgctttcataatgatcaatcacttgtcacttcttaataattcatttacttctcattttcagacgaattttttgtgttcatttgacccgccttttgtggagacaatggcttaaataaagttataatttaaatatgacgaggttaattaaagccagggtgaccaagtgtcctgattttttagatttgtcctgtattgtggagggcacctatctgaaaaatcaaaaatgtcctgaattctcagactgtcctgaattttt

SEQ ID NO: 62175 - DNA, 671 bp, Heterodera glycines
  Genomic contig location: Contig_ID=SeqID_31863; Location=578..1248; Strand=-
  SCN-specific regions: Sequence locations=1-550,575-671
atgttgagatcattcagcagattaactggtgcgggcgaatgcgattcatttgcatatgtaaggcaaagtaaacgttaaatacataattggacaaatccaaaatatgatgcttaaacatcgaatttcagggtcttttcttcgaattgaattttcttacaaaaaaaaacagttacactttttgccatttttatttgattttcttgtcaaaaaaattatagaaaccgagcaactcttttttagttcttatttcctaccaatgtttgaatggttttatttccttgtttataaaatactaaattaaaatcgaaattctgataaaaattctaattaattatgtttgatttaccaaatttttgaattaagcacttgtttaatttaattacgatttttttctgcctttttgggtgcctatttagcaatttttttcttagaaatggcatccctacttattaatatgtagggctcggatttataattttaattgctttttttatatgaaaatactttcagattaaggcaaacaattttattcactgatcgcacttacaaatacataaaaaacatttcaaaattttcgtggttaaaagacataaatatggttaccggccaaaattgatttataaacggaaaaagatatttcacgtcgcaagatgtcagagaagcaaaataaa

SEQ ID NO: 62176 - DNA, 544 bp, Heterodera glycines
  Genomic contig location: Contig_ID=SeqID_31863; Location=717..1260; Strand=+
  SCN-specific regions: Sequence locations=1-544
gaataaaattgtttgccttaatctgaaagtattttcatataaaaaaagcaattaaaattataaatccgagccctacatattaataagtagggatgccatttctaagaaaaaaattgctaaataggcacccaaaaaggcagaaaaaaatcgtaattaaattaaacaagtgcttaattcaaaaatttggtaaatcaaacataattaattagaatttttatcagaatttcgattttaatttagtattttataaacaaggaaataaaaccattcaaacattggtaggaaataagaactaaaaaagagttgctcggtttctataatttttttgacaagaaaatcaaataaaaatggcaaaaagtgtaactgtttttttttgtaagaaaattcaattcgaagaaaagaccctgaaattcgatgtttaagcatcatattttggatttgtccaattatgtatttaacgtttactttgccttacatatgcaaatgaatcgcattcgcccgcaccagttaatctgctgaatgatctcaacattttctcatcagt

SEQ ID NO: 62177 - DNA, 762 bp, Heterodera glycines
  Genomic contig location: Contig_ID=SeqID_31865; Location=187..948; Strand=+
  SCN-specific regions: Sequence locations=1-589,613-762
atggaacatcttgctgatctgcgcacggtccgtcgaacactcgaggacgtggaaaagctatctcagctttcatccgggactcggtcaggaacaggggacagtctgcctgcgggagatgatctcgctatccgtcgcacgccgcctgcacagcaaatccatgacccgactgatcaccagtcggacgagtggctgtttggacaattcccaagacggttcgagcagctgaacatccaagagggacgtcgggcagtgacgcctgtgatgcgaagcgtcgcccaggtcgcccaatacccggtcttaaacgcaggaggagccggagccaacattcgagaatgggtcaatcaagccagtgatcggagggaacgacgacaagcccatcccgggcttcgaaaagcatcttcttctccttcgctgcttaaaggagggatccccagccaggagggctgtcgaggtctaccctccttcggacgggaattatcccgtgagtagtatatggcacagaaatccggtgtaaaattccggcccttcttacgcaaattccccctcccgcccaattcgaactctattttatgaatatcccttgtcatcccgttcctttgttttcttttttgaccactcgggagttaattgtttcactaattttgactcctttctcttagcattttttttgctgcatgaaaataccgaaaaatgatgactaaaaaaaagcatttacaaaattttccaatattgatcctaattataattttccatttagcaata

SEQ ID NO: 62178 - DNA, 1266 bp, Heterodera glycines
  Genomic contig location: Contig_ID=SeqID_31867; Location=112..1377; Strand=-
  SCN-specific regions: Sequence locations=1-621,644-753,776-1266
atgggtgaaaatattgagaaaattcgacccaagtaccgaaatatacaaaacccgttaattttaaaagccggagcgctttttgaatcagacaatgtgcgatttgaggaaacaattcgtgaatatcgctcaaaaatgaataatttgcacacaccgatattacgattagttgaaaaaccaaacattacggaagctattaaattggttaaaagtgaagcaaatgaaacgcttggtgtgataattggtagatccggagattggttggaaatagtaaagaaaattccggagaaaaccaaggaagcaataagttatttgaaaggcctatcatatgcactgattgcgataccattattaattcttttggtattgatgggatacattggaattaaatacagactgataatatttgccggggttcgtgctgggtcagtattggcaagagtgttaagagcaatcatgggaacaaaaaaacgaagtactcgggttttggcggtaccaaccgcaccagaattggattcaatcgatgaagaagcttatgttctggattatcttcctccgagacgggttgcagcgattacgaatgacccgaggagactcccatccattagtgtccgtcttaatgatttgttaacagcagccttggttgattcatgtgctagtgtatcctactgtagagaaagaacagcaagaaaagcaggacttaaaattttggagcaaaatgacggaaaaggaaatttgactgcggcaaacgattcgagcatagaaattttggggaaaactatggcaaaacttcgaattgaggataatgtgactggaaatgtccgagaatgggaagttgtattgcttgtctcagtggacgaacattgtcccggccctttgcttattggattaccacttcttatggaattaaaaggtgtaatttccctgggagagaaaagagttagacttggcgatgtgtggacaaacattgtgtcagtaattgggtctgaaaagccaaaaccaccgtctgtgatacttgaaaagacggaagttttagagccaaggtctgaaaatatactttcagcaaaagtcaacgaatgttttccaatggaacaaaattttttggtgaaaggaattaagcttaaatatcccggaataattgttggacgaactttggtttcaccaggaaatagtaagaatgtaacaatacaaattttaaatgcgggaaattcagcggttaaattatatggaaagtcacatttggcagattttggaaatcgttcaaattaa

SEQ ID NO: 62179 - DNA, 792 bp, Heterodera glycines
  Genomic contig location: Contig_ID=SeqID_31871; Location=469..1260; Strand=+
  SCN-specific regions: Sequence locations=1-252,274-631,669-792
atgctgatcaaaaaagggagcaacaccaagttgatcagatcactccttcatggtgatctgatcagcccattttggcggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccggtataagtcatagagacatgcggttttttgaataatcagcggcaattttccaattttgcgaaggggtctccggccatgtaaattaatgtaaatcaatgacctttttttgctttcaacaccgcttttttcgcggcacgttttttccaagacttttgggggacaaggagggccggcggtgccgataggcgccgccgggaaaaattttctaatttttaatgcgatttgttaacagaatttgtaaaaaaatgaccaattgattaagttttgggtttttaggatgcttaacatgaaagaaaaaagttggaatattttttaaaattaaaattttaattaaaataattgtaaagaaaatgtgaggaatattctatccaagtggggaattgaacccaggcgaaaaattatgaaaggtagaaagtttaaccactacaccacatgtgcatgtgtgtaatccaatgactaaatgaa

SEQ ID NO: 62180 - DNA, 68 bp, Heterodera glycines
  Genomic contig location: Contig_ID=SeqID_31871; Location=317..384; Strand=-
  SCN-specific regions: Sequence locations=1-68
acttttgaccacctatattttgatcaaattgtgaatatggtaaaataaatcaaataaatgtttatgtc

SEQ ID NO: 62181 - DNA, 75 bp, Heterodera glycines; identical to SEQ ID NO: 54636
  Genomic contig location: Contig_ID=SeqID_31872; Location=606..680; Strand=+
  SCN-specific regions: Sequence locations=1-75

SEQ ID NO: 62182 - DNA, 386 bp, Heterodera glycines
  Genomic contig location: Contig_ID=SeqID_31873; Location=183..568; Strand=+
  SCN-specific regions: Sequence locations=28-175,197-359,384-386
atggaattggccagggaaaggctggccaaggagcaggaaacggtgcgaacactcggcacaaaagtgggcatttatttatcatgttgatgatatcatacacttagagcctaaccagaaaattatcggcattgcaaggcacaagccgacggcattatttttttttgtttatcgtccaaaaaataatttaattcgggttcggtaatgccgacagacgtgaccagagaatttttaaatgaaatcggctaataaaatgctttatttcaccagtttttttctttaaatatttataaaattcagcttaaagagcgacaaattgaagaggaacagcgcggtaaaacaagtcaactgaattttaatcaatcaatggcattttaattaaaaaacaa

SEQ ID NO: 62183 - DNA, 530 bp, Heterodera glycines
  Genomic contig location: Contig_ID=SeqID_31873; Location=668..1197; Strand=+
  SCN-specific regions: Sequence locations=1-29,51-84,150-299,321-530
atgtcccaaatgatggccagtgagaataaagggcttagagaggagaagggcgcgctggaggaaaagctgaacgaactccgacaaagggtaaaaaaggagagaaaaaacggaaattaaaaattaaatttcaaaattaaaattaaaaaattggaatttcagttgcacgccaaagactcgcgcgtccatcggttggccgaacttttgggcgaatttttggaaaagtaccggcaaaatgcgcaaagggcgcgccaccaaatcgggcgacaaacggaagagtgagcgcagaagcgggggaaacaaaatgaaaatgagctataaaacagatgccaacagttggaacaaattgtggacaaaattcggcaaaccgccggcgccgcgccctttgccgcgtcgtcgccgccgcacgcgtcggccaccgcgacgacgtcaagcggcgggtcgagcacgcggacggtgggcggcgggtcgacgacgcggcgatcgaaaacggactaaattatattcagacaaaataattatgaaaaattgga

SEQ ID NO: 62184 - DNA, 139 bp, Heterodera glycines
  Genomic contig location: Contig_ID=SeqID_31876; Location=1008..1146; Strand=-
  SCN-specific regions: Sequence locations=1-139
agaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 62185 - DNA, 90 bp, Heterodera glycines
  Genomic contig location: Contig_ID=SeqID_31877; Location=21..110; Strand=+
  SCN-specific regions: Sequence locations=1-90
aatggtaccttcacatcaaaaaacgactgtcatggagatgagctgcagaaaaaaattacaagccaagaacaagccactatagcagtatag

SEQ ID NO: 62186 - DNA, 994 bp, Heterodera glycines
  Genomic contig location: Contig_ID=SeqID_31878; Location=19..1012; Strand=+
  SCN-specific regions: Sequence locations=1-244,274-517,541-696,718 -749,772-926,952-994
agtgccttccgcgccttttgccccgccattacacactttgctgctatttgtcggcacaacctcacaagcagcaacagttgcgtttccgcttcgtttactccgtcctccaaatgcccccgtcagtgataattgacgaatgtgcggaatttgagggccaaaaacaacaaaaacggtacggcgcatgcactcaatggttgttgcagcaacggactggccaaactgttcaggtggggacggacacccgtaaaatttaaaaaaataaataaaatatttgcggcgattgcaattattttctaattttgaagaaccctgacgaacttgaccaaaaatggttccaatttaccaaaaatcataattcggaattataaccgaaatgctttttctcttgcattccgctcaacctaaaaaattgtgaaaaatttcgaaaataattttattttttcagttttttttacccttttttaatttttgctatgaaaatttttcgtccaatttactttttttgacagttttttggttcataaagaaatccatttccatattgaaaaattgcagatcatccaaaaggagccgtccaaattccgctttttgccccttctttcgtcccctctcccgcttcaatgccgtcccccgactccacgatggttgaccagcccgaccatgcgctgttgttgctgaacatgccgttgatgatggtcggcccaggcactggtgttgctccgttcattgcctttcttcaaaaaatcaggtccccctttttcaccttttctgaggcctcaaaaatttccggaaattggaaatataatttttttttttggggctgtaggagcaaattgaatttatcaacttgaaattgacttaattctttctagaaacttttcacactatctgccctgtcttttttttataagaaaaaattctttcaaaaggtggattttttaaaatttttccaggcatttcatgcaacgaatgggcggcgattgtggacgagtga

SEQ ID NO: 62187 - DNA, 874 bp, Heterodera glycines
  Genomic contig location: Contig_ID=SeqID_31879; Location=669..1542; Strand=-
  SCN-specific regions: Sequence locations=1-146,192-238,347-354,378 -552,574-635,658-874
atgccggaccggaccggactggtattttcaaaaatgaccggattcgggatccggtctctcataatccggtaatccggtcaatccagattttcaaattgccggatccggaaccgaattccggattggtaaaaatttatatttcacatgttaatttgggaaaaaacccttaaaatttcatctattatatgtagaaatttggtgcaccagaaaatgtcgtcatagaaaagacaatgcgccgaaaaaaatatataaaatttcaatttttcaaaaaaaatttaaaaaatttattttaaagttttttatttttgaaaacctatgtttaatgaaaaaataaaaatttttttttgcggcgccctttttccaaaaacttttgggaaagaaagaagtgggtccggcggtgccgataggcgccgccgggaaaaattttgaaaatttgaggcgatttgcaaacagattttcaccaaaaatgagcttttttttttttgcttttttgggcaaattttttaaaaagaaaaaagttttggaggcccggcggtgctgacaggctccggcgggggagaaattgaaattttgaccatttaaagttaaagacattatgccaaatagatattttcaaagaaaaacgaacaaacgtcaaggttttttggttgagaccaagccggaccggatccggtcaaaaattcgccggaccggaccggattggcattttcaaaaatgaccggattcgggatccggtctctcataatccggtcaatctatgtaatccggtcaatccctatttttccaaaaaatcgccggaccggattcctgatccaggaaaatccggtaccggatccggtccggtccgctctctaataaatatcctctgaataaa

SEQ ID NO: 62188 - DNA, 123 bp, Heterodera glycines
  Genomic contig location: Contig_ID=SeqID_31879; Location=1735..1857; Strand=+
  SCN-specific regions: Sequence locations=1-123
atgattctttcttttttgccaattctgatagctttcattgctcactttcgccttttttcttgtctaagtccaaagggcgaaaaattaacggataaaacggaaaaggaaattccgttgcaaatt

SEQ ID NO: 62189 - DNA, 929 bp, Heterodera glycines
  Genomic contig location: Contig_ID=SeqID_31880; Location=98..1026; Strand=-
  SCN-specific regions: Sequence locations=1-351,429-526,548-577,599 -697,736-929
  Gene Ontology: Mol. function=heat shock protein activity; Cellular component=plasma membrane; Biological process=response to stress
atggaggacccgtccaaccgcaaccgcctggccaaactgttgcgcttccacagctccgccgactcggccaaacagacaacgctggaggcgtacgtggagcgaatgaaggagaagcagcaggccatctactacattgctggctcatcccgtacgttttgctttttgtggttttccgccaaacaaatgggtgtaaattgaaaggaaattaacggcacgggttaaagagttttcttgcgagtgaccgtttacatttttttaaatattaaatcccaatttttattcccatttgttgactccaaaaaaatttccattcttttaatatattgttctaattttcaaaaaaaacgttagtaaaattttaaattttttttcttgaaatttttttataaaaatttataacatttttcttgaaaaatctttttaaaaatgacatcaaaacaaaaaaaattttcgattccattcgatagtttctgcagaaattatgtgcttttttggatcctatatttatccaaaaatctgaaaaaaggattacatatattttgtattatagtacagtccaacgtgcggatataattatatttttgaaattttaccaatgtttttttgttttcaaggcgaggaggtggagaactcaccgtttgtggagcgtctgcttaagaagggctttgaagtgctgtatttgaccgagcctgttgatgagtactgtattcaggtgagtcacacacagaaaaaagtggattttttttctaaaaattttaatttagtcgatgcccgaattcgaaggcaaaaagttccaaaatgttgcgaaggagggactgaagctggacgagggcagcaagtcggaggagcagcacaaactgctcgaggaacagttcaaaccgttgtgcgactggctcaaggagaagggcctcaaggacagagtcagttaa

SEQ ID NO: 62190 - DNA, 77 bp, Heterodera glycines
  Genomic contig location: Contig_ID=SeqID_31881; Location=1548..1624; Strand=+
  SCN-specific regions: Sequence locations=1-77
acatgcttctgagtttatggatggtcctttgatccacaaggcgtatattattccgttcactttcgacataaaacagg

SEQ ID NO: 62191 - DNA, 892 bp, Heterodera glycines
  Genomic contig location: Contig_ID=SeqID_6608; Location=1536..2427; Strand=+
  SCN-specific regions: Sequence locations=1-17,40-126,150-586,625 -809,833-892
atggcaaataaattgcaattttctttgtttgttgttttggtcctttgctacggttccacggcttttccgcgtctcaaccaacaacaacagcataagcaaaagcaaaagcatggaggtgaaatgttcatattttaaatttaaaattaaatccacttaaaaataaagctcattaagttaattgtcgttagggatggttccggaatttctgggataaaaccctaaatttagacattgccttaggagttccctaaactcggtggtataaacaaacaaacagaatattagtcttaaagatactgtatttgcagtaaaaaataacaaaaactgttttgtcaacttaattttatttagaaaatgatgggaaacagcagcaaatggcgcgtcgtgtgccatttcctcacccgggtcaagcgccggaatattttcaggaagccagcgacaaagcccaaatggaatacaagcaaatttttgaggatgaaaaaggccaaatgccaaaaggggagctgaaggaaaaactgaagaaatgggctgaaaacaatggcataaaggtgaaaaatatgtaaaaattaacataattcaaaaacggataaaaattaaaaaaaattttaaattactttttaaaaactttaaggatgaatacgaaatgtcccaggaagaaaatgaacaaaagaaggagtcattccataaaataatgtcagcaaatcttggcggagacgcactgaaagtatttaagaagatttgggtatgttattgtcaaataatggcacatcgcagattttgtcttcctccctcattattattggtttttcatattttatttaattttttttttcacgacatatcattaatatttcaggaaatcacgcacacagatgaactgtcacgtcaatga

SEQ ID NO: 62192 - DNA, 459 bp, Heterodera glycines
  Genomic contig location: Contig_ID=SeqID_6609; Location=689..1147; Strand=-
  SCN-specific regions: Sequence locations=1-83,106-225,247-459
atgaacagcgacatggactgtgacgagctgaccaagcagtgcattgaagacggaggaaaaccgtcgaaatgcggaaaatgccgtggccaaagggatattccatgcaatcatatggaatcagaccaagtaaaaataaattggaaaaactgagacggaggcaatttgacaatgaacaaacttttcaagccgcatattaggcaaacagaatttaatcttcgaaaataccttacattaattacatttaattgaccactaacaaaattaaggccaaatgtgtatttcggtttatcccgttactcttttattgttgactcgagttaacggttctgtgcaattacctcctaattaaataacatttggtatcaccctcactcaaattgtatttattgaccatgcgttttcttccagcgatcgcctgtgcaaatgaagtgccattggactgactgcgcgagtgtgtga

SEQ ID NO: 62193 - DNA, 159 bp, Heterodera glycines
  Genomic contig location: Contig_ID=SeqID_31882; Location=842..1000; Strand=+
  SCN-specific regions: Sequence locations=1-138
tgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaattgaaaaaaaaaaatataaaaaaa

SEQ ID NO: 62194 - DNA, 120 bp, Heterodera glycines
  Genomic contig location: Contig_ID=SeqID_31884; Location=544..663; Strand=-
  SCN-specific regions: Sequence locations=1-72,94-120
cgggcatcgcacggctgctgaacgtggcggcactgatccctcaactgcacccatttcagcaactgcagcgaacacagcagacgaccacagcgacgaaacatgagggaaacggcgggggag

SEQ ID NO: 62195 - DNA, 485 bp, Heterodera glycines
  Genomic contig location: Contig_ID=SeqID_31885; Location=31..515; Strand=-
  SCN-specific regions: Sequence locations=1-81,103-188,213-248,271 -311,333-485
atgattttattattaaaaccgcttattgttcaaccaaatgttcggtatcattcgttttttattcgtacctctcgcctctataggtgtttcgcctaaagaggcgaggttacttaattccattcggacttttcgctaaacttcttcgacacctatcggaggtgattctttacttttgaaaccacctcatctcattcagtgaccaaatttatttatattgttatttatcggtcggtgtcacgcttttcgcgtataaattggattggattgaaatggttcggaggtgtgccaataatccgcttaaaatattttctaatttttattacattttttcagaacccaacgcattggttgcccaacggcggctcatcaagttgttgttggcacccaaactggatgagcacatttcagcacgaaaatgggcgggattagcattcgggacactatgaaggcgcgatttggtctgacaacggacagaaagaaataaa

SEQ ID NO: 62196 - DNA, 836 bp, Heterodera glycines
  Genomic contig location: Contig_ID=SeqID_31886; Location=268..1103; Strand=-
  SCN-specific regions: Sequence locations=1-312,334-359,381-470,492-836
atgcttgttggcggtggaaaagcaacaacaaatttgactgattcatcgggggacgacgaaaggcagcgaaaggaaagtccgccccaatcgcacggactgacttcattccccgagacattgaattcgacaaattttgacgagaaagaaatgaaagatgtgcaattgtacgacgaaaatacaccgacatcatttgacgggaaaaaggacgaaagccaaaatgaggggggaacagaagtggaagcaggacaaaggacagcggaggacagccgatcgaaaacgacggcacggagacactctcagacaacggcggacgaggaggaccagcagcaccaatttgtacaaagacagacgaataattgataaaatcccaaacacaattaagccattccgacttggcattttttggaacttttcttaattgatgattggcaaaattgatcagaatcgctacaagcaaattaatgacattgaaaattttttcaggaatctctcgccgtttccatcaatggccaattcggaaagaccgtcgtcatccatgcgaccgacgaggacccaagcgaaactttcgagcggctgaaggaggcgtgcatcaacgccacactcccgtacaaagacatcattgacagtctgttcaacacggtaagaaatggatcaattattttaagccgtaaattacaatcaaatgcctaggggatgtccggtttttgtattcaaaatgccatttaaagctttattttattgaatttgcatactctgaatcaaattttgaaaaatcaatttagggcttaatttgactgactttcttcggattggcataaatgcaaagattaaataaa

SEQ ID NO: 62197 - DNA, 145 bp, Heterodera glycines
  Genomic contig location: Contig_ID=SeqID_31889; Location=830..974; Strand=+
  SCN-specific regions: Sequence locations=1-145
atgaaaatttggccgtataaaaccaccgtcgaatgcgtctcatgccattgcggccgccgcgtgcgcagccactcgcgggacggacatgtcggccatggcctcgaggagaacgggcacaatacgctcatggcatttcttttggatg

SEQ ID NO: 62198 - DNA, 1257 bp, Heterodera glycines
  Genomic contig location: Contig_ID=SeqID_6610; Location=966..2222; Strand=-
  SCN-specific regions: Sequence locations=1-82,104-375,397-483,505 -648,671-796,818-818,841-1216,1241-1257
atgagtgccgttgttcagtcgaacaatgccttggctctaccgacgcgactgaaacaaccattgtctccaccaccgcaaattgctcaggtaaagcaaaagcattgttaaatccacgcgtttcccggctttctttaagccatccgcgagggcaaaccattttatatagttttacataaaaatgatgcatttttttctacaggacttcggaagtgtcgacggtcgccaactcgtcgcatttgtgcgcaaaacgaatgagtcgggcgaaaccgcggtgctgccggtcgacgcaatttcattccttcgccgtttggtcgctcagtttggcggagtgagtttgggttaaccactgcaattcaatggtttttgaaaattcgccctcaatttggattccatttcagcatcacttggaaccggacgatttgtttctgggcactctgcccacggcggacaaccgtgccatggcactcgagtgccttcagatggacgacgacgacacacacagccaacagacgaagcacagtcgtgccaaggaggtgaaggatgggttaggcggtggcattgaatttttctttatttttaggtgattgaccgtctcggtctcgtcgcaaattgtcgtcatgtttttgccggttccaacaaatgggttaaaactcgttttttcaactttcaattaactttggtgtttagaatttcggttcgtcactggttttgcatgcgttgatgtcagcagtcggtccaattgcgtttgccaccaatccgcaattgaacatgtgcttcgaaggggttaattttcaacaaatttttaaaaccgttttttcattttgtgtatttcaatgatttaaaggcctagccaataagactataagccctcatcggttagcctctctctggttacgcccattcactgatcgtgataacatttattttaccgatgtcaaataccggatccgaattttttggtgcacttcattcccccccgaaaatttttttttcaaacctagaaatttttcagaaaaaaatttcttagttaaaaaatttttttgaaaattttttcagcggttttttcgagattttatgatgaaccactatgtttttttcaaaaaaacgctgaaaatttttcataaaaatttttcttgaaatttttaggagattttttaatgaaaatttctaggttgaaaaaaaaatttttttcggagggggtggaggtaacgatctgctcccaaatttttattttaaaattggacagactccaataaa

SEQ ID NO: 62199 - DNA, 233 bp, Heterodera glycines
  Genomic contig location: Contig_ID=SeqID_6610; Location=1..233; Strand=-
  SCN-specific regions: Sequence locations=1-233
agttcccggatgagcctggttttttttgttcggataggttggccagatacgaacaggttgatctaacatatcagacttaaataaaaaatatttcacgatttaaggaataaaattataatttattacttttacttgatttattattacattcacatttttaagtccatgctaattgagacgggacatatgtacgcccaggcagcgcgcaacaactctgaggcggcgcgcaacaa

SEQ ID NO: 62200 - DNA, 184 bp, Heterodera glycines
  Genomic contig location: Contig_ID=SeqID_6612; Location=107..290; Strand=+
  SCN-specific regions: Sequence locations=1-9,31-184
atggccagaaagtttcaaaaggttggttttctaaacatttttagccataaattttttaaaacccaacgaaattttttgaaattttgcaggctaatagagaattcttagggctatcgaataatactaagaatgtttaatttggatgcttcttgaaaaagttatgatccattaaaatttcaaaaaa

SEQ ID NO: 62201 - DNA, 129 bp, Heterodera glycines
  misc_feature (51)..(51): n is a, c, g, or t
  Genomic contig location: Contig_ID=SeqID_6612; Location=1584..1712; Strand=-
  SCN-specific regions: Sequence locations=1-79,101-129
ggtgagaaacacaacgtcaaaatataccatcccgccagaatacacatcctnttggttgatcaaaacgccatttgatcaattgttgttgttgttaattttgttttttttgcaaaatttgaattataaaaa

SEQ ID NO: 62202 - DNA, 114 bp, Heterodera glycines
  Genomic contig location: Contig_ID=SeqID_6613; Location=104..217; Strand=-
  SCN-specific regions: Sequence locations=1-85,110-114
atggcaaaagtgccgcaaatttccatcgtttcgccagcaaaaatcaaacagatggaaaagggcgaccaacaaattggggaagaaggcaaaaaaggaacagaagcacaaattgag

SEQ ID NO: 62203 - DNA, 571 bp, Heterodera glycines
  Genomic contig location: Contig_ID=SeqID_6613; Location=332..902; Strand=-
  SCN-specific regions: Sequence locations=1-308,330-379,410-571
atgggtgcgcgaacaaaggaaaaacgtttggttggaaacgcacatttggcacgccaaacgctttcacatgacgtaaccccaaatgtttctcctaaaaactcttccccagaattttaaagggaactttggggctacaaattgccaatgaaaagctgtcagcgtggttttcgcccaaattaccgttgcgccgtccgttcggccgtgtaatttttacattaaattttaaaattccaaaagtgctttcagctctcttgaccaaagttacctatgctgtctccaatttgttgtgtccgcccaaatttcgtctgattgtaaaatgaaaattatttccgaagttttggcccaattttgcgaaaaagtaaaaattaatcctccactctaaaatttaaaatattcaatttaattttttcagaaggtttcgccgacttttgcccattttggcgccctttcgggtcatttggaagtgccggtgatgcttttttcgcccggcaaatacccacacggatttttggggcccggccgagccatgtggacggaggacgggtcagaattcgtcgattttttaacttga

SEQ ID NO: 62204 - DNA, 1255 bp, Heterodera glycines
  Genomic contig location: Contig_ID=SeqID_31893; Location=51..1305; Strand=+
  SCN-specific regions: Sequence locations=1-83,105-137,159-350,378 -531,698-1136,1163-1255
atgcagcaattgatggcttatcaaatcgtcgtggtcaaccaggcatttccggcgggcaacgaaacgaaggacagatttaaccgtgccaaattattaaatggtgagcaattaaatcgaaataaatttattttccgctaatttttctccaatttaaaatttagtcggtttcgttgaaatgcttaaacaattttgcaaccattctgctcaatgttgggattgtgttgtgttccatgacgtcgattttgtgccagaaaatatcactaatatttaccaatgcgaccgaaacgcaccgaaacggctaatctcagccaccgacgaatgggacaattacaaatatgagtcggttttcgaatttaaaatattaaatattttaaaaagttgaattttatgcctggcgataaagcatggatgggcggcgtcgttgcgataacgccggatcacttttcgctggtcaatggcttttccaatgactattggggctggggagcggaggaccaaaatttgcgtgaaaggttttttgggtgccaatggaaattaattaattaaaaaaaaataaaaaatattttaattaattaaaataaaattgggaaaatattttaatgttaacatggattatacataaaaattcttgtaaaatatttttaattaatattatatttttggattttaattaatgcaattaatctatatataatttgttgcataatgcctaaatgcctattttatgcctatttcgcgagttatagcgcctttttcaggattttgaaaatttctatttcctattatagtgcatattcgggggtttttgtgcctattttgcgattttttctgcctttttaggtgcctatttcgctcgcagcactatttataacttccgcgcgtcacgaaaattttccattttaagatttaaattggcaaataaatcggtgcttttcgttcacggacccatcggccattacaaaagcattgagttggcccacaaagacaacgacacgacaaatgccgagatggactgcgcatgtcggcagcttttgatcaacaatttgtccaacacttggaaaatggatgggctatccagcttaaattatgcgcatctgagcacaacggatgagattttgtacacaaatataacggtgaatattaaaaaataataattaaaaaacagccattgcttaattgtttaggtggatttgttaatggacgaatcactgaaaaagggccatccatgcggaaagaaaattaacggcatttatgg

SEQ ID NO: 62205 - DNA, 80 bp, Heterodera glycines; identical to SEQ ID NO: 58324
  Genomic contig location: Contig_ID=SeqID_31897; Location=295..374; Strand=-
  SCN-specific regions: Sequence locations=56-80

SEQ ID NO: 62206 - DNA, 80 bp, Heterodera glycines; identical to SEQ ID NO: 51817
  Genomic contig location: Contig_ID=SeqID_31897; Location=907..986; Strand=-
  SCN-specific regions: Sequence locations=69-80

SEQ ID NO: 62207 - DNA, 195 bp, Heterodera glycines
  Genomic contig location: Contig_ID=SeqID_31900; Location=349..543; Strand=+
  SCN-specific regions: Sequence locations=1-195
atggtcgtcacgcctggcggcacttcggacaattactgctcctcggcagcggagttggagcagtacgcggaagacggcggcgatgactgtggcgatggggacaacgatggcggggacagtgttattgtgcatcgacggtgcagcagtgggctgagcactgaaattgtcaacgacgcaatggcaaatgccattcgg

SEQ ID NO: 62208 - DNA, 189 bp, Heterodera glycines
  Genomic contig location: Contig_ID=SeqID_31901; Location=767..955; Strand=-
  SCN-specific regions: Sequence locations=1-14,36-37,68-111,138-189
atgattgcagctgtgccatttggtgagtgttttgcccataattttcattattatttaaaatttttaacagatttgttacttgttgaaaccgacagtgatgaggtgtcaatttttaacttctaaattaaatttaaaaaagagatatcatagttcactatcaaataaggtccaaaattggtcacaaataaa

SEQ ID NO: 62209 - DNA, 2092 bp, Heterodera glycines
  Genomic contig location: Contig_ID=SeqID_6614; Location=75..2166; Strand=+
  SCN-specific regions: Sequence locations=1-234,257-660,682-724,746 -1236,1258-1791,1813-2092
atggctgaggttggctttcgattaaagccagagaagtgccgatttgcacttggagaaatacgatatttgggacatttaatttcggaaaaaggtgtgcgaattgaccccaaggatttggagccgatacaaaaaatcaaaaaaccaaaaaatataactgaattacgatcgctgattggtgtcttatcatactttcgaaaatttatttacggattcgctgaaatactgcaacccatttatgaactaacaaaaaatgaaagtacgacggaatggggacaattacacgagcaagccctggaagagttaaaagaaagattgatgacagcgccagtgttagctccgccaagatttggacatccattcgtagttgaaactgacgccagcaccaaagcaatcgccggatgtcttctacagaagaacaaaaaggaggaaatccaccccatttgctactttagcagagttctaactaaacatgaaaaacgatattcagtagtggaattagaagcacttgccatttgcgcttcattaaagaatttccgcccatatttggagggagctggaaggtcaacggtggttacagacaattcagcattaacatcactattccgaagaaaggacttagaaggacgattaagcagatatcagctggcaattatggcattcgatgtagatattattcacagaccgggaaaacgaaatcaattctgtgactatttatctcgttatctgcacgacaaaactgagcaagaagttaattctttaaaattggaccagaaaataaaacgagaagaaatgatcacagcacaaaaacaggacaaagaatcacagagaatttgcgaattaataaaaaatgcggacgaaaaagggaattctgaggggacattcggaagatggaagctttttgagggccttttatgcattacagacaggggagagtggaaggtttatgtcccagagtgtatgcgacaacgattaatgagtgaatatcattctgaccctttccaaggaggacatttgggggagaaacgaacgaaagaaaaaattagacgaagtttattttgggaaggaatggacaaagatatccaaaaccaggtgaaaaactgtgacccatgccaaagaaggaaaataattggcgtcaataagagcgttgaaccaatttgcccaatagaaccggcagcgcgaccatttgaaagacttcatctcgacttaatgggacccctaagaatgacaaagggaggattccaatatgttcttatgattattgactcattttccaaattaatggctgctattccattgagagaacaaacagcaacaatcattaattcagcatttgtagataaattcttatgtctatttgggttaccaaaaattgttgtaaccgactgcggcacacaatttttgagtgcgacttttgagtcactcgctgaaaattggggatttaaacaccaaactacggtaccgtaccatcagtccgctaatggacaagtcgaacggtacaaccgaacattggtggacatgctcgttacaacaacagggggaaaagattgggcttccgcccttccaatgctttgttttgcgtataattcttcaattaattcgcaaattggacattcaccgttctatgtaatccatgggtttgacccaagaataccaagcgaagctatttttgacaaaaaagaggaacaattctcagacatggctatttacgtccaggaactgacaaaaagaatgggtgaagtaagaaaggtagtacaggaaaggctaaacaaatgcgcaggacgaatgattaatcagcaaaaatggacaaaagaaataaattggatggagggaatgttggtcctgaagacaaaaaatgacaaaaaacataaattggaggcgaattatgaaggaccttttcgcatcataaagatcgaaaaaccaaatttaattctgagggctttgaatccggatgatgagagttttgctgcacatatgaatcagtgtaaaccatattatactgaaccggaagaagcaacggaaaagggagtagggcctatcccgaagggaccacggaaaattggggaccgaaatatagaagaatcagatgaggaaa

SEQ ID NO: 62210 - DNA, 556 bp, Heterodera glycines
  Genomic contig location: Contig_ID=SeqID_6614; Location=1..556; Strand=-
  SCN-specific regions: Sequence locations=1-226,249-556
tatcgtttttcatgtttagttagaactctgctaaagtagcaaatggggtggatttcctcctttttgttcttctgtagaagacatccggcgattgctttggtgctggcgtcagtttcaactacgaatggatgtccaaatcttggcggagctaacactggcgctgtcatcaatctttcttttaactcttccagggcttgctcgtgtaattgtccccattccgtcgtactttcattttttgttagttcataaatgggttgcagtatttcagcgaatccgtaaataaattttcgaaagtatgataagacaccaatcagcgatcgtaattcagttatattttttggttttttgattttttgtatcggctccaaatccttggggtcaattcgcacacctttttccgaaattaaatgtcccaaatatcgtatttctccaagtgcaaatcggcacttctctggctttaatcgaaagccaacctcagccatcgttttcagaaatgtttcgatgtcttttaagtgttagtcctctgtcatcgaaccgataatacaatcatccaaat

SEQ ID NO: 62211 - DNA, 875 bp, Heterodera glycines
  Genomic contig location: Contig_ID=SeqID_6615; Location=74..948; Strand=+
  SCN-specific regions: Sequence locations=1-6,77-380,403-701,723-875
atgaccgaggaggaaaaggaagaaaaaacaaaaagagaagaagcgcaggaagcagcaagaaaagaacgagaggaagttggcaagaaggccaatcaaaagggaccgttaattggcgctgacgccaaaaaattattcatgacaaccgtcgagcagccctatgatcacggaagagtgattggacaagtctttgaccccagagcggaagtggaagcgccctgggatatgactaaagccctcgcaaatcgggaaaaggaggatgaaataagagtaaaaagaaaggatgaaagggaggaaggttggaggaatttcgttggcggggaaagaagaccggaaacgggaaatgaaagttggaaagaaaggcaaagaaatgagggaaatagtggggaaaggtggagagagagaccgagggttgtcgatgcttttgcgcggaacacaatttggtcagcggagaatgatgtatccacaaaccccggcattccgccggagggatttcggggaagaagaccgacgcctaatccctgttggaaccgtttccgcaagagaagatacatgagtccgattcgatacaatactgagcagcatggtgtggggacccaaacaccgacatggccgacaacagaaagttccgtcgaacaacttcgatcaatccgcttgatgttggatgtggcaattgcgggactggtgcaaagaaacggcaaaaaggagggtgaagaaacagaaaatggggaagacagcaagggaccaaaatgaaatcgccggcaagataggtccttctcagcacgaggtattgcgtcttattttatgtattaaagatatccaagtattgtaatgaaaattctttctgaaactatatttaaaaaatgaactttaactaa

SEQ ID NO: 62212 - DNA, 931 bp, Heterodera glycines
  Genomic contig location: Contig_ID=SeqID_31902; Location=482..1412; Strand=+
  SCN-specific regions: Sequence locations=1-138,160-440,479-510,532 -697,728-731,754-904
atgaaatcggagaaaaatgatgtggggcatagggggagtcagagtattttatttgttgcgctagtaaaatttcttatttgggtcggtggtcatatatgacaccaaaatctatgcattttaaatcaaatgattgattttcagcagaagcagccaagaaaacgcagcagtcccgcttcattgtcctaaagttctctcctaccgctgttcctggttcagtttcagcaccttgtcgtcctctgcaggtattttttccataaccatttaaaaactgcgctaaacgaggatgaaacccaactcgtaataggcaaactcatgctaaccctactcatattattttttgacaaaaaaagataatttttgtcaaaatcgaccaaattaaacattcttggtatcatttgatagacattaaagttctctctacctgcaaaatacaagaaacttttattggtttacaagtaaaatatgagcagagattttataaactcaaataatttcaaacataaattttgcactagagaatatttttataaacttgttagggatttacatggatcttattgtgagaatgcggggccgacaatttgcgacagggacggaggaagggacgacccgtgtgtgcacggcacttgccgagttggcacgacggtggacgactttgtgtgcgattgtcagtacggatacacaggtgggagaggcgaaataaaattcaaaatattttttaaaaattgtgcaaaatgccataatttgcatttttaaaatgtctttcccttctctctttgccccaccattcattaatcattcaatgagttaggggtgtaccgtaatctctttttttgcccactgttgtggcattcattcgcgcactttcacatttgcacagcggggcgaaatggcgaaagttatttatgaggggggagaaaaaagggaaaaa

SEQ ID NO: 62213 - DNA, 490 bp, Heterodera glycines
  Genomic contig location: Contig_ID=SeqID_31903; Location=925..1414; Strand=+
  SCN-specific regions: Sequence locations=1-2,296-326,349-361,470-490
  Gene Ontology: Mol. function=DNA binding; Cellular component=nucleus; Biological process=N-linked glycosylation
atgaagagaggaggaaagaggaggaggataaagggaggaaaggaagaaagtgagagaaaagggagacggaagaggagaggagaaagaaaagagggaaagggaggaaagaggaaggatgaggaagaggaaaagaggtggaggaggaggatgaagagaggagcaaagaggagtaggataaagggaggaaaggaagaaagtgagagaaaagggagacggaagaggagaggagaaagaaaagagggaaagggaggaaagaggaaggatgaggaagaggaaaagaggtggaggaggaggatgaagagaggagcaaagaggagtaggataaagggaggaaaggaagaaagtgagagaaaagggagacggaagaggagaggagaaagaaaagagggaaagggaggaaagaggaaggatgaggaagaggaaaagaggtggaggaggaggatgaagagaggaggaaagaggaggaggataaagggaggaaaggaagaaa

SEQ ID NO: 62214 - DNA, 1729 bp, Heterodera glycines
  Genomic contig location: Contig_ID=SeqID_31904; Location=1..1729; Strand=-
  SCN-specific regions: Sequence locations=1-310,332-629,653-678,700 -1121,1143-1729
gttgtgcaagaagaagcaacaccggaagctttttgccgtggtgttcagctttcatcagaaatcgctgaatttttcgccaacgagttcaaagaaaggaaagacggaaacaatcagcgagaaatgagttccgacagagttggaaaaattttggtcatcaaaattgaaacatttggtgcaaaaacggaagcgatgattgatggtggagcgcaaatttcgttgattggtgcctcatttctgtatatgctgatcagagaaaaaggattgaatttgcaaaaaacaaattttgcacgcacaaatgaccgaattgccgacgtcaatgggaaggaactccgatgttttggcacactcacattgccaattctccgtaaaggctgtaaagaagtggccatacatttttacgtaaccagtgcaccgttcggattcgacatgcttttcggaacgaattcattgtcagcactcgggttctccctttacgatgagcccaataatgaaatgatccatttcgaaaaagcgacaaaaagcgaagacaccgtccgcattattttcaacacgaaattctaaccaaggactagcaaattcgtcgaaatggaggttgatgaaaaatggaatggccaggacgtgctaatatgtccagcgcctgctaaaaaagcagtcaaaattgatcagtcaattgggaaagttgaaaatgggaaaattgtcggccaaatttcaaatttgagttcaaatgtggagaaaattgacgggaacacagtgatcggaagagttgaagaggtggaatcgtcttatgattctggcaattcgtttttgccgacaaaagactttctaattggaaaaggtgaaaacgatatccaatttggagatgaaatgtcgctgaaagttggacacattccgaatgaagcgaagccgaactaatggcgttgttgaatgattttgttcaaattttcgccttttccgatgaggaattgagccaaacggacttggtgagccatcaaattgccacgggaaattcggcaccgatacgttcaaggatgcgacccgtcccctatgcctacagggaaaaggttgcggaaatgatccaaaactatcttggacgtggcatcatccgaccttcttcgtctccatgggcttcaccaattgtgattgtgccgaaaaaggatggcacactccgtttttgtgtggactacaggggactgaattcagtcactgtaaaggatgcatatcctttgccgaatattgacaacatattattggcactgggaggcaagaaaattttttcgaccctcgactttatttccggttattggcaaattaaaatgtcaccggaatcgatcgacaaaacggcttttgccacagaatttgggcttcatgaattcgtcgttttgccgtttggactttgcaacgccgttgcaacttttcaacgatttatgtcacagcttttcgaaggattaatcaacgattttgtcttcatctatattgatgatatcttaattgcctccgagtcgtgggaaaagcatcaagagcacttaaaaatagtgttcgaacgaattcgggaagcaggactaaaattaaaaatcagcaagtgccatttttcggcaaacgaactaccgtttcttgggcacattctcactactgaaggaataaaaatggatgtaaacaaagtacgtccgattatggaattgccaattccaacgtcaaagaaggcacttcaatcactgcttggatttttggc

SEQ ID NO: 62215 - DNA, 817 bp, Heterodera glycines
  Genomic contig location: Contig_ID=SeqID_31905; Location=380..1196; Strand=-
  SCN-specific regions: Sequence locations=1-192,216-357,379-817
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaa

SEQ ID NO: 62216 - DNA, 48 bp, Heterodera glycines
  Genomic contig location: Contig_ID=SeqID_31906; Location=160..207; Strand=-
  SCN-specific regions: Sequence locations=1-48
atggcgacggttctttggcgccatcgccgagtgaacttcccaagaatt

SEQ ID NO: 62217 - DNA, 191 bp, Heterodera glycines
  misc_feature (186)..(186): n is a, c, g, or t
  Genomic contig location: Contig_ID=SeqID_31907; Location=57..247; Strand=-
  SCN-specific regions: Sequence locations=1-67,89-191
atgcacattctcaagtccctcactgtcatcattgtgttcgtcatgttcggctggactctgaacggactgagcaccttttatgtgccacttttgaagctgtcgccggagaacagcatcagttttgccgctgggcttgttcagctgactctcgtcgcatcggccagcaatacgcccgttctctatgtngtcag

SEQ ID NO: 62218 - DNA, 828 bp, Heterodera glycines
  Genomic contig location: Contig_ID=SeqID_31907; Location=387..1214; Strand=-
  SCN-specific regions: Sequence locations=1-437,461-620,642-828
atgaagaatattctatcccagtggggaattgaacccaagcgaaaaataatgaaaggcaaaaggtttaaccattacaccacatatgcatggttgctaaacgaaataaaatttatttttttctcaaaaatttctccttcttcaccaatttcctatttttttctcgaccagacccccattcttaccagtgcaaatttttaccggcggtaccggtactagacaaaccggtaacggtactttcatttttgaaaaaaccggtaccgataccggtaccaaaaaaaccggtaattaccggccagtaccggtaccggtaccggtaccgagcaactctaaaaaaaacaattgatcaaaaaaaaaattgtgtgcttataggtcaaaaattgagcgcaatgtcaaacggtacaaaattgtgctgaatctgatcagctttacctacggactcatcaacaactccatcgtctacattggcattttgaacgaatttcaaaacaagttgcatttaaagttttaattgctctccaataatttaagaaatcatccaaattttgttggccattttattaaattgactagatttattggtaattgattggtaaatggcctcataaattgcaattcattgattgatttataattcctttctgctgccatcagattggtgttgtgcttcttgggagacaatcggtcgacattctccaagctgtacagctttcgtgtcaacgtctccatggaaatctgcacagtgtgtttttattgcctaatttgggtccaaatggccagagggcgatcaaaaaagtcaaaagtaagaagggcaaacgacaatctaataaa

SEQ ID NO: 62219 - DNA, 603 bp, Heterodera glycines
  misc_feature (472)..(472): n is a, c, g, or t
  misc_feature (515)..(515): n is a, c, g, or t
  misc_feature (524)..(524): n is a, c, g, or t
  Genomic contig location: Contig_ID=SeqID_31909; Location=31..633; Strand=-
  SCN-specific regions: Sequence locations=1-70,92-255,278-603
atgtgtcctcgtccgtggggttggccatcagatgagtgtacgcggcacggacagccgaacggaggtcgcccaactgaaaaacgcacaaagagtgagttgtgattgatcagagaggagaaatctgatcaaattcggagaacacttttgagggaaaaagtgatcaaaccagcaaaaagcatgatccatcagtgatcggacaaaattgccggaaaagctaccaatttttacaaaataatgtgccgcggcaaaaaaaaagaaattttttaaattagattttggcaaaaaaaatctaccaattcaaggattttgattaaattttagcgctcccttaaatggacttttttgaaaaaaagagaaaaacaaaaattggacaaaaaaaaatgttaaaaaagaatacatttaaaaacttctaagtttcatgaaaatttagtttttatgaaatttatgcgcaacaaaaaaatgtgcatcttanattttgaatttttttttttgcataatttatggactatttttanagttaattntcttagcactaattatcaggtcagggtaaagaaaatccaagtttatgatcaaaatttaacatttttggcaaaaaataaa

SEQ ID NO: 62220 - DNA, 1009 bp, Heterodera glycines
  misc_feature (100)..(102): n is a, c, g, or t
  Genomic contig location: Contig_ID=SeqID_31910; Location=37..1045; Strand=+
  SCN-specific regions: Sequence locations=1-50,92-519,541-736,758-1009
atgggacagacaaaacgtctagagtcagtgggacggaagcgaatggggtaagagggaggggcaggggaagaggagggggcagggggaggggagggaagannncagcagtggaaaggtagggaactcggtgacagaaagcaacggaagacgggactggcatttacttatcagagtgatgctaggcaattaataacagttaattgtctgtctaattgcttttcagcagtcaaacggtgtcacaaattgcagcaccttcgaaacaacgactgagagaaaagtacactttaatgttaaaacgatagttgaatatttctgctcgtccgctatccctaactgattcagtgcctttggctctgtttcttcttatggcgggtacggagtgccgtcgccaattggcacgggcgaagccgaagagcaagcgcaagcggacggagtcaccgcattcggaccgggatttttatctaatcaattgggcgaaggaccactccgagttgggcgcgacccaccgggtgagaagagagctagtaagaagcaatttgggttagcactggactgatcagggagaacggaatcaccggacgaatcgaatccgacggagccatcggtcggtggactgaagggacagccgcaggcggcgatgagtgccgagttcgaaacggaggacgagctaatcagcaaaacgatagtggacaacatgccaacgcctgggaggacattcaccgacggcgcaccaatggcagagaatgggaaaatgaaagacacggaaagagagacagcgaaaacaacggagagcggacagaagaaaggtcagcagagaaaccgatcaaagccaagcaaaaactgatcaactgacagtagattattcggattacgagacggacgtgacagtgccgcccaatctgacggatttgctggccaaccttcagccggcggatataagtgcgcgaaacctgcaaaggatgttccgagactcagtgaccgaccgaaggacacttttgcatggctttga

SEQ ID NO: 62221 - DNA, 279 bp, Heterodera glycines
  Genomic contig location: Contig_ID=SeqID_31911; Location=146..424; Strand=+
  SCN-specific regions: Sequence locations=1-153,196-279
atgtttgcattttttttggcttaccacaacttcatcgaacctggtactttctattctttttcaaatcgccccaaattttttttacagccacgaggccgcgaagcggccgagtgaggaccttgggcgcaggaaaattattaaggaggagggttcattatttatttatttttgcaaaattaattcataaatttttttcagaaactgttctgaaacgcaccaaaatttatttacgagtcgaataaggcactctgactcttatattatcaaaaagggagatga

SEQ ID NO: 62222 - DNA, 349 bp, Heterodera glycines
  Genomic contig location: Contig_ID=SeqID_6618; Location=453..801; Strand=-
  SCN-specific regions: Sequence locations=1-349
atggatcggattgatctttcgcaatggctgcagcaaaagtgtgcttccgatgcggcttctgttcatgttgtgtcccgactgtgctcaaaccgtgcaaaagtggccgagttcaccgctttcgcatttcgcgagtcgctaaaaatgtcgcagcaattgcggggccatttttgcaatttgaaaatgccaaccgaagagaagggacgttttgaagaaattaatgagtcgaagcaaattgaattcatcggaggaatgagcgaaattgaaattgcaaaaaacaaattgctcattttggtcggtggcctccatttcattcgcttcgaagaagagtttcccgaagtgttgagaatag

SEQ ID NO: 62223 - DNA, 1763 bp, Heterodera glycines
  Genomic contig location: Contig_ID=SeqID_6618; Location=1140..2902; Strand=-
  SCN-specific regions: Sequence locations=1-95,118-811,833-983,1046 -1343,1371-1374,1396-1637,1661-1763
atgcaggccgatgtaattactttttgtcgttggcttcaccgacaattggttggtgaacgaaacatgcaaattctatgggatcgaatgaacaaattgtttgatttggaacacgacgcactgtttgtctgcttggaggagcaaaattgggacgcgatggaaacaattttaaaattgggcagaattttcacgaagacggaacaatttatggacgacgaaatattgggcaaaaaactaggacaaagttcaaattatgaacaggaaatgttgaagagcaaatgggaaaaagcaattggccaaaaaggtgacgaaaaaggaggggaaaaggcgacgaaaatggagggatggaacaaatttttgaacaaaattcaccaagcggaaatctttggactgatgggacgtcatgagcacataatggacaaattcagagaatgttcgtttcaaaactgaatgaaagaattagagaacggatgggatcgggattccgtgggattaaattcgggatccgacctcgggatccatcccgaatctttttttaaattcatcggcaatgatcgggatcgtgatttcatcgggatctcagagtcgggatccctcccgacccaagttgtccggtctctagaaagtttttcgttttacaccgctttccacaaaataagctaaaaaacaaaagatatcacaattaatttttgcagaaaaaaaataattgtcttaacaattcctttcttttagtttacacagaagaaatcttttcgagattttcgcttttcgtaaagatttctgaatttattaacgaatgggaaacactttatggaatggatgaacataaaaagaatgcaaaaagaaataaaactgggaaaattggaaaaattggaaaaacggaaaaaagcgaatcggaaaaggaaattgaggaggaaaaaatcgcaaaatcaaacaattcaaagggacgacaaaaggaaaaagtaatgagaaatataggacaatagaaaaattttaatataaaattattaaagtacataaaatgtaaaaataataaatatttatttaagaatcaaaattttggctgccccgacagaaaaacaccaagcgaattgtctccctttaatgaagaaaatttcattctgaaaggtatacaactttttgtttaaagttaaaatagcatttattttattttcgattttcattaatttgtcattttaacttaagcagatcaaagtttggcgtcggatttcattgaatttttccaagtggaaaacgacgacgcccaaattattatgaacaaaattggacaatgcttttccattgaattgagcacaattttatgggctttaaccaattttctacagcaaatggaaaaggaaatggaaaaagggttcacaaatcaaagcaaaagtgtccaaatttgtgtggcgtaccatctgatagaatacacagtgaaaagtgaggccaaaacattggaccaatggcggcaatctttgctctacgaagaatttatcatagacgaggcatcttaaaaatattgaaaaatataattgtttaagatgggaattgataactaggctgggaatttaagtcgtgagcttggaagtttgaaaagcagattttcttattcaatttaagttgttaaatgacttgaaattttgcagataaatactttaatataagggccaggatgacattccgaggccccaaaaattttcggaaatcggaattccgagggtcaaaaatttttaccgattttgagcaaatttctcaagaaaaataaa

SEQ ID NO: 62224 - DNA, 1351 bp, Heterodera glycines
  Genomic contig location: Contig_ID=SeqID_6619; Location=185..1535; Strand=-
  SCN-specific regions: Sequence locations=1-971,1032-1351
atgcaatgctttttgccatggttatgcaaatttattataaccgtttaataattttaattgatttaaattgaaattgagctaaactaattcttatattcgaattcttttttaactttttaattccaaaaaaatcattcattttcaaaaatttatgggtaaaaaattttgacttaagacattgaaattttgtgatcaaaactttttataattttgtaaaaaaatctaatattctgttagacaacacttaaagctattgaatgataccataaattttaatttggtttaaactgagccaagttatgtgttacattttttcataccccttgactttattaagactcataattagcaagagaaatgcaaaaacattgaatagaatagctttatgagcattttcttaaaaaaacaaaataattacacctaaaaatacttatcttcgaggcttggcacttaaatctgtttatcaaaaaatacataatatcaattaatatattttaaagtgacaatttagagaaagaagattcaattatcactgattacaaaaagtatctgagcaaaccaataatacagggaatggtggtcgtccatgtcgagaaacttttattttatgccgaagatgacagccataaaatttttgaaattcaagcagtgaattggcactttcaagcattggctatggaaattgtggaagaagcacttccaaatttaaacattgcgaaattggatgaagaacacaaaaaaattgtagccaaaaatggcaaaatgaaaggcatagacggcacgaaaaaggcactgtgctatcattacaattttgtggaagaaattgttgcgaatggatacaaattggcgaaggacaaaactgtgtggaaagattttgtggagaaaaaacgcattggacaattggtcaaggcaaggcatttaaaagcttaagacaaattccacgtttataaaagatacataaataatcctcctaattaataattatatttttttaaattattattattattattttgtttttcattttatttgttaggtcaattcatttgatacttttgaagtaccgacaataaaatggttggacataatttgtaattcaaaggacgaatacgaaaaaactgttgaagaattgagcagttctgagcaaaaattaagcataatccatgccgaaaatttggcaagggccatccgaaaatcggaacaatttcggcactttctctgcagcaaagacatggatgatttgcagataattgtaaagccaagaattgaaaaattggtgggcactttggaattgatgcgacttgaggagcaattcccggaacacttgcgaattggtatataaaaaaataaa

SEQ ID NO: 62225 - DNA, 967 bp, Heterodera glycines
  Genomic contig location: Contig_ID=SeqID_31912; Location=305..1271; Strand=+
  SCN-specific regions: Sequence locations=1-3,25-476,498-551,573 -944,966-967
atgcaaaatttacttccagcagaagctgatgatggacgtgacaacaatccgatcagagacatacgccgtagagttcatttcagcgatcgctcccaaagggttctggacgactcggaccatttgctgaaatccatccgaactcgccgagcggcacctctcgccacttccatgtccatgtccacgctacccacctcgttggagcgcaacggtgatcaaagtctgcaggaccatgcgcggaaaacactgatcagagcgcagcgatcggtcagccccgaagagccactgctgagcgcatcaacgtaagcaatttacagcattaaaatataaaataaaaggtgaaaaaaacaaatgaaaagtaagcgaaataatgaaaaatataattaatctattaaagtattaccggaaaccggggctaaaatcccgagtttgtaggaatcacggtcctgggtatcattttagggcatgattcgggatttgtctccaaaaatgaaaattccagcaaaattttctgaaaatgacgaactaatagagtaccaaataattaatctcttctagtattttccaaagcattgaaaatgccgataaatgtcactgaaaaaaattctaaaactggtttgaattgagaaataacttttgggtgcggtggtgaaaagccggggccgttgtcccgagaaaattgcggcgagatccccgaccccgcccgggctattggttttagaaggcggttatatagcagtaaattttatctttcattaatttttagtagattattttttactcaggagccgttatctgcagcacaccccgaaatttccgagaatcgattttgacgattggattgaggaggaaacgcaagcgaaaaagccggcatggaaagtgctccaagagaatgtcaaatcgtcctacaacaaagtgcgaaatgttgttgctcataaaactatttcattaattttatgaaaaaataata

SEQ ID NO: 62226 - DNA, 269 bp, Heterodera glycines
  Genomic contig location: Contig_ID=SeqID_31915; Location=121..389; Strand=-
  SCN-specific regions: Sequence locations=1-145,201-269
atgcagtccggcggagattcaccggataatgcggttctgatgattgcatcaaaaagtaccaaaagcttagcgaccagcacaaaattatctatgcaaaatacgaacaggaatataatgaaaatcaagagaaggtgacaattaaagcattttttctatatattacaattaatttttattttaaattaaattaaattttttaacaatttgtaggagacaattatcgaagagaacaacgatcaactccaaacatcggcaacgaattggcataa

SEQ ID NO: 62227 - DNA, 464 bp, Heterodera glycines
  Genomic contig location: Contig_ID=SeqID_31916; Location=577..1040; Strand=-
  SCN-specific regions: Sequence locations=1-154,182-197,222-464
cttggttatgtgatcggttcttccgccacttcgttggccaaaagtgcgcttggctccgtcgactgtcccttctgttggcagtggggaattcgcgtcactccgttgctcggcttcttctgcataatcactttgctgatttttgtcaaagaaccggtcaattaattaattaattaaatggaaaacaattcaaagaaagcaattaaaatattaattaattaaatcgcaggtgaggggacaatccgaacaaagtgtggcacaactgatgccgacaaattacgaaacgtattgaaaaaggaaaatttaaaaaagagaaaaaaaatttaaaaacagcggaacgatcagtccaagttcaaggcgaacagtggcatcagcagaagcaccgaatgagaacatttggaaggagtattaccatcggatacgcactcacactaaaagttattgcgcagacattggacatttaattg

SEQ ID NO: 62228 - DNA, 339 bp, Heterodera glycines
  Genomic contig location: Contig_ID=SeqID_31917; Location=153..491; Strand=-
  SCN-specific regions: Sequence locations=1-339
atgaattattattttttggcggatttacgaaacgccctggcggatttacgaaacgccctggcggatttacgaaacgccctggcggatttacgaaacgccctggcggatttacgaaacgccctggcggatttacgaaacgccctggcggatttacgaaacgcccatagtggcggatttacgaaacgcccacgttggcggatttacgaaacgccaatagtggcggaatttacgaaacgacctagcaccatttcgaacggacaaacgaaatgcgttttcctccttctgagcgaagccgttgaacggtcggtgattaaaatcaatatttattcgtgtgaataa

SEQ ID NO: 62229 - DNA, 1028 bp, Heterodera glycines
  Genomic contig location: Contig_ID=SeqID_31918; Location=250..1277; Strand=-
  SCN-specific regions: Sequence locations=1-36,70-71,146-533,555 -682,704-883,925-955,977-1028
gccaccaatttggctgccgcaactgcgttggcaacgtccgcagcggctgccgccgccgccgcttcgtcgaccagcagcagttgtgccaacaacagcaacagcaattcgactgcccaacaacagcaacagcagcacagccacagcatgaaaagcattgagcaacaaatgatgttgctgcagcaaacaatggcactgggcgggttgggcaattccagcggagggacagcgagcagtatgatgaaccatccgtacgcatcatttctctaccagcagaacccggccgagctgttcgagtgtgttttatcgttgtctttgttgaacgaatgcgggcgtattattacaaaaaaaaaattttcaataatttttcttaatgtgacgatgtctgtcggcacttttaaaaatttcggaaaaacgcctatacgcaccaccgcttttcaaaaaattgtgccaactttatccatttgtatccaaaacacttgtgcctttcagcattaaaaatggtcagcagcagtcattgtttggcactgtcgctagtggcggtggcggcaccagcaacaccaccaactccttgtccgcttcggcactgctttcatccgtaacacaacaacagcagcacaaccaacagcaacaccaggcttcctcctccgctatggtggagcagcaggcgatcgccgcgttggctgccgctgcggcggccgccggctttccgtctattggctccatggtgccaagcgctgctgcgacgactggcggcggcggcattgcaaaaagcggcgccagcgcttccgctgcggacatgaacgcgttgtcgtcggccgctgccgcactcaactcggccgacctttatttggccgcaatggcctcctcattccaatcactcataggtggcggcagcggcggtaacgcggcggcggcggctgccgcttgtgccaatccgtcggcaatggccaacaacattttcatgcccaaccaacaacagcatgtgcgaaattcagctgctgctatggccacaaatccggcgtcagcag

SEQ ID NO: 62230 - DNA, 76 bp, Heterodera glycines; identical to SEQ ID NO: 51235
  Genomic contig location: Contig_ID=SeqID_31919; Location=437..512; Strand=+
  SCN-specific regions: Sequence locations=1-76

SEQ ID NO: 62231 - DNA, 996 bp, Heterodera glycines
  Genomic contig location: Contig_ID=SeqID_31920; Location=272..1267; Strand=+
  SCN-specific regions: Sequence locations=1-93,115-137,159-174,199 -331,353-373,404-562,585-586,629-858,895-996
  Gene Ontology: Cellular component=integral to membrane
tacgtgttcctgttttgtttggcacattttatgcacggagttggcgcaactccactgtacaccattggcgtgtcctacattgacgaaaatgtgtctattattaaaattttcaaatatctctccaaactcaaatggttatttctgaataaatggagcaaaaaattagaaaagatcaaaaaaatatattaaaaatttttaggttggaccactgctctcttcactgtacatcggcgtgttctatgcatttgcaatttttggaccagccattggattttttgcctcaagcaaattccttctctggcacaccgattttctcgtcactggccaaaaattacaaaaattgtatggaaagcgagcgcatttttctggctgcaatttttttttacaaaatttatattttatacagaatcatcgacctagacgagacagacccaaaatgggtcggcgcttggtaccttggttttctgttggcctccattcttggcttaatggctgtttttccaacactcatttttccaaaattactgccggaatcattgaaatggcacaggttggttgtcctaaaacaaatttatgattcatttatagaatttttaaggtttttcaagaaaattcattctgattactggacattccagaatatttaatattttttgttcatcttttttccccctacagaactcgtcttcaagaagagacgttggggcagaaaaaacgttcacccgaatgttgtggtattccgccgtcgtccggcaatcgaacagcaatcgtttttggcgctgggagcgccaattttgatggtacctatttcattcaatttatctccaaaatttcttctggctatggtgcctgacttcgattaaatttcaaaaaaaaatttagaaatttttatttcgctccttttccgttcacagaggatggcaatgagaaggcgccaatggtacaatttcagtcctcagcactaaagcctcgttcgggccccatttggtaccaact

SEQ ID NO: 62232 - DNA, 4697 bp, Heterodera glycines
  Genomic contig location: Contig_ID=SeqID_827; Location=194..4890; Strand=+
  SCN-specific regions: Sequence locations=1-273,295-1021,1051 -1353,1385-1405,1515-1715,1737-1811,1833-1943,1965-2453,2475 -3092,3122-3812,3866-4155,4188-4202,4253-4404,4426-4548,4570 -4598,4661-4697
atgtctaattttaatcagaatgactttgccattacatcggtgcaccaaatgcgcaaccgacctcggaatacaattggtgaaatagcggaagtgcgctttgctccccttgaagaagtggaacggcccgatcgtgtgctcgagcgtcttgtacagcggctgtttgacagagtgcttgatggacgtccagcaccgatgttaattggtcttcaactgcatccacctacctttgagaatccatttacgattccacttcgtccacccgagcaaaacaatccggctgctatcgctgatctgatccaaagactcaatgatcaatctgctgccggaattgatctgactggcgggacaacagtcacaaaagtgcttgcagtttggccaatgcaatcggaccacagtgaatcagggagagcaggttgaaatttatttttattttcttttcatattttcttttgctgtataggcgcatgcagccttgaggaagagcaccgattggtgaacactgttcgctcgttgatccgcattaagaatccgaatgatcgactctgtttggccagagctgtgttgttaggtcttcacgattggcgttcacggtcaccaggcggaggcggaccaacagcattcaaaagtttcgcaaatcgccagcacacccacgggcctgaggcacgtaacttattgagacgtgccgcaattccccgcaacaaacacatgtacacaattgatgacgtccaaaaagtacaagattggattgatcaacgatacgggccagcagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaacaacagcaatcccgagcagatgggtcaactggcaatcgtctttgccgtgattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaaccaatgaggaggagaaggagaagaagagggcaacaacaacaacaacaaaataataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttaccacttcaactgcgtacaaaggttgtacagaaacatgttccgatgctcattattgccgaaattatctgcgaagcgtgtataaatgaaggaatttcggttcattctggtgttggacaatacgcaaatgggtgtgtgtgtggtcctcctgcgggaccaagggggcgtcgctggtgttctcctccgtttctgaatgcacctggggatgacaatgctctaccagccaatgtccactacaacccacgaagactgtttttccatagttttgacgacgctaccaacaatgacccggtggacgattttatcaactttctcaccggaagtggtccacatggtgtgaaaacaatttgtttatcacacaatggcggaaaatacgacattcatttaatactggaggcacttcaccggcgcaatttgccaccaaagcgtatttgcacaacgggactaaaaattttttcgatgactttgaaagggaaccatcaacgacacgtgatctttaaagactcgctgaactactttttctgtgaattggatgcactgccacgcacatttggattgaacgctgaagttgcaacagcaaaacctttctttccttatctgttcattcggcgtgaaaatttacaccaaagattgcatggtttaccgggcaaagaattttatcagcctgatcacatgaaagcgtcaaagagagattcctttatgagttggtgggaggtcgagaaccgttctgcacgcttccaattgcgtgaacaactcatcctgtactgtatgaatgatgtggcaattctgcgcgaaagtgtgcttcaatttcgccaaatcattgctgaaaatacgagaggactggacccgtttaaaatctcatccacggcagctggtcttgcgttggccaccctccgccgctgctttcttccaatgaacaagcttgttaatgcgccagaaggtggctacctaagggggcggcgagcatctgctgaatcggcacgatacattcgttattatgaaatgacacatccgggagtacatgttcggtctgcccaatggtcaattggtgaggctaacgtcgaagacactggctaccgccttgatggattagtcacacgtgaaccccctcaacgcaaccttgccattgaatacatgggttgcttttatcatggtaaaaaaaaaaggtcgcccttttcaaccgaacaaaaaaaaaatgcttaaaggttgccccacgtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacgaggtggacgcactgaaccgtttatccttcagtacacttgcagtccagacgaagagataattctcattgacattgtaaaaaaagttaggagaaacaaaaaatattttttcattgttaaaggtgagcttatatccatatgtgatgaaggcattctcgtttccggttggtaacccacgcattctcacgcgagagacacttctatgcgcaccgaccaccgcttccctggtgttctgtcgacgcgaacacattcaaagggctgttgtttgttcgtgttctgcccccagatcccgctgtacacccgctaaaagttcctttgcttccctatcgaactaccgacgggcgcctaacttttccgctttgtgcacgctgtgctgacaaccgacaacaacgggcatgcaaacacattgatgcgtcaagggcatgggtttccgcgtaattttgtgaaattaatccatgtcaatttacttttttttgtcccggtgtttagatacacccatgttgaattgaacaaagcactggagcttggctataaagttattgatttatttgaggtaaaaataacgtatcgtttattagactaaactttaaaaaaaaaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaaaatacagaattacaattttttaaactttaaaaaaaaaaaaaaaacacacacagaaaattcttgcaaactccctctggggaaaacttgcgcaacgagtcggtggaacggaagttcgttatacccgaactccaagggagtatcatgctctggtggagaatggctccgtgtcggggcttaaccctaatttttattcacaattttatcgttttccaaaaaatattaacaaaaatgcaataaaaaccaaaaatacaaccctaagaaatgaaaaacatcggcttttcctacgcctcgttaaaaagtggtcgactggcatggcaaaaaatcttattctatcaataataaaataataatgtgtaaaatatatttatggattttattgcctttaaaatatttcatttaaaacaattaaatttatttattaatataattttctgtactgaaatgaccccatccctctgaagtctctcactgatatttttgtcacttcggctcaccacatgtgcttacaaattagatcggtctgatcggtcactgatcactcccccccccatttcagccttacttctcttttctgtttttgcttgctcatctcctctccatggtcgtccccgctgcaaatcctctcctttacggtaatttcttttctttttttttgccatttttcatccgcattttttagcttggatgaacgcctcttttcgtgatgcctttttgcgcgtattgcccttccgaaaatggcacaaaaatgccatttcaatgaaacgaaaaacgaccgaagggaaagccagagaaagagacaaaggagaaaagagaggcgaggacaaaacgaaaggacagacggagaaaaaacgccgcggggggacggaaaagcggtaa

SEQ ID NO: 62233 - DNA, 190 bp, Heterodera glycines
  Genomic contig location: Contig_ID=SeqID_827; Location=5100..5289; Strand=-
  SCN-specific regions: Sequence locations=1-190
gaacaaaggcggaaaacgggcagaaagaacggatggacggattgagaagagaagtggcgtcggaaaaagggaccgatcggaggaaaatttggcaaagtgatcactgatcagtcagccattctttggacgatgtgacaaaatgtagacagacacaagtggtgattaagtgactaatcatatttacccgtcg

SEQ ID NO: 62234 - DNA, 530 bp, Heterodera glycines
  Genomic contig location: Contig_ID=SeqID_828; Location=20..549; Strand=+
  SCN-specific regions: Sequence locations=1-530
atgacacatccgggagtacatgttcggtctgcccaatggtcaattggtgaggctaacgtcgaagacactggctaccgccttgatggattagtcacacgtgaaccccctcaacgcaaccttgccattgaatacatgggttgcttttatcatggtaaaaaaaaaggtcgcccttttcaaccgaacaaaaaaaaatgcttaaaggttgccccacgtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgacgggtgtacaatgactcattcgttccaagaccgcttgatccaagagaggatgcactacgaggtggacgcactgaaccgtttatccttcagtacacttgcagtccagacgaagagataattctcattgacattgtaaaaaaaagttag

SEQ ID NO: 62235 - DNA, 879 bp, Heterodera glycines
  Genomic contig location: Contig_ID=SeqID_828; Location=2932..3810; Strand=-
  SCN-specific regions: Sequence locations=1-94,159-190,213-232,254 -267,289-879
atggacgcgattcttgcgaccgattggctccacaatgcgtacccggaacaaaagatgacaacaggaaatgaagaagaagataaagcaacacaggtatttttttttatgaaaaaagtttataaataaaactatattagtaaaaaaaaaaaataaattttcaggaaggacaaatgagttggcttaaaatcatcgaggaggaggaggagcgggcgagggaattgcaaaatgatcaaatggaactggaacaagtgaaaggtttatttagttatttttagacattaaaaacagttttttaaatttagacaacattgagttgccaaagcacccgcaaccacaaaccaagtgcagttgcaatgaaaagcagaagagtgtgccgttgattgattttctctgcaaacactacaaatgttcaatgaatgagcttcacgttctgctgcagacgctgagcaaacgtagagaaatttcggaaatgttgcgttccaatcttcatttacgcaccaatcatctgcgccctgcctggaaaaacattcgcgtccattgcaacgaactgacaattcatccagctcaaactgcatatgctatgcgcggttatcttggcattacggtttgtgtttgatttatttaaatttaaccaatctatgtgtacaatacactttaggtgcgcgtctactactatgtaaagcatggtataaagctggcttacccccaactgccatgtgttcttcaatttggtggtggtgatcatagctctctgttcccgcttgagtgtcttagtgttattgttgttaaagaaccatgatttagtgatgatgatgatgatgcatgatgaacgggtgtttttttaattcaaatattgtcgttttttaatgtcagattaaa

SEQ ID NO: 62236 - DNA, 649 bp, Heterodera glycines
  Genomic contig location: Contig_ID=SeqID_6623; Location=299..947; Strand=-
  SCN-specific regions: Sequence locations=1-184,209-598,620-649
ctccgaggagttggtcaaggaagagcaccgaacgcacgtttcaccacaacacatcagcctaatggaagaacggtgggatggattttcaatgtcaaaaatgccctattaggcaccgacgaaaattttccatggacaaacatagaaagctttttatttctaaactcggtttttaattgccttattgttagttttttgaattatttatttagccagatctttaatttatgtagaggcggcgactccatcacaatttcatttttttgctccgacccaatttccaaaagttggcatcggggaaccctgtttcgatgctttttcaaaaaattcttttcattactattttaatttatcgtatcatttcatctaaaacaaacaactttctactgtcattaggcgtcgttgggaaaatctgaatttatcggaacggggcattttctcataaatcgaaaaacggtgggcctaaccgtcgatatcgctagtacttttctttcacaccaaacttactattaacataagtatgccttattttgcatgtattctattttaattacaggaaaaaacgctccgaagaatttcggttagcatcaaaaaattctcattcgcggaaaaaacaaaaccgacgttcgggcttcagcatttaaacgggccg

SEQ ID NO: 62237 - DNA, 710 bp, Heterodera glycines
  misc_feature (4)..(4): n is a, c, g, or t
  Genomic contig location: Contig_ID=SeqID_31922; Location=274..983; Strand=-
  SCN-specific regions: Sequence locations=1-80,163-385,407-659,686-710
atgntgcccgaagtgtttcgtcaattcacatttcatttgggtaacaaaaacaatttatctgcatacattacggtcgatggtaaaaaaatatttaaaattataaaattattatataatttaaaattatttttaaatttaattttaaaatttatttatattttagaagaagtgattgaagttgaagatgcaaaggttgagcagtataagaataagtcattaagtggtgccaaattgagagattttgtgggcttttgggtgctcggcttggacatgatcccatgggatgaacaaacgatgagacttttcgtcatccggcactgcaactgctcattggaagcatgggtaagaaaaaatgccaaaatcaaaaattgaaatgccaaaatcacttttttaaaataaagtttttgcgaccatccgattcggagccaactgatcccaaaaaggcatcgatgggcacgggacgctttgaggaccggtacggccaacatttaaataatcttaatcctgcttgtgtcaaatttgaattgcgcaactttgtgtgtcttaatgattgcttacggggaccggtaaattggacaccagaaaattggacaccaagcggaaaaatggacaccgccggaattttggacatcaaaggaaaattggacaccggaaaagtggacaccaaattctttttaaaaaatgaaccaaggaattagtttaaaaataaa

SEQ ID NO: 62238 - DNA, 1829 bp, Heterodera glycines
  Genomic contig location: Contig_ID=SeqID_31924; Location=442..2270; Strand=+
  SCN-specific regions: Sequence locations=1-20,45-351,373-590,612 -859,883-1250,1274-1801,1824-1829
atggtgcaagaaggtgctggaacatcatcatcgtcatcaaaaacgagtaaagactatgttcgaaagttggacaacaccatcgaacatgtgccacgcttccaatacaccaaagtcaagtcgcggttcagcattgaagacgtgccagccaatcccgagggactcctcgccggaatcttccaatacagtattgacgcagcggtggcggacagtcatgagcgtggggttcggccaacacatctcggctgtctcatcagcagcccattgctcactggcggggacattccaatccccatccggcaaatcacggacaacacggtcaacaccatcttgaaccaattcctcaaagtggcccaaagcaagaaacaacagaacgttacgctttggggagagccattcaccgttattgttacaacagttgatcgccgcggactccctaccaaaagatcacttaaaggtggcgcacgacgggctctggcacctgttcaccatcgggtcaatgatcggagtttgataaaggtccgcatattcaaaaaaatcaattctgatgaggaaggtttaagataaacaaccctgatgaccgtaactactgcctcttttatgctttgcaagcaacgatggtggcaaaaacccgaggctgggccagttggaagctttacgactatacgcacagcaggaggggacaacagggatgtttgcagcgagattctctacaactgatgcagcaaattggcgtacggcttgggctcaatggttatgatgctgaaatttgtgtgccgcgggtggtggatcattggaacaacacgcagcaacagcatcgttttgcagtatttatttttggatcaactggtcagtacaagccactgtacaaatacatcaacaacaataactacgacacacccctggtattgtacctgaacaatggtcattttgacggcgtaaagaaagagtatggattgtttggtcaacactactgccttgaatgtgagaagccataccaacgaccagcaacacacctcaattcctgcaaagcacgctgtatgctgtgctcgcgagtcggtccagcattcccatgcgctcctcgtgatggctttttccatcaatgtgcgggctgcaacaaaaagtttcgcaacaacgaatgccatcagcaccatttgacatccaatttttgcgcccagtcaaaacagtgtaaagagtgcggggtatttgggacacacgagtgcatcatcgaaatgaacgaaaggtaagaagcgtaaataaatttaaaaataccattcgttggcttcagggtcacaaatgtcacgaaacgtattgtcaattgtgcaacacgtaccacaatccagagcggggttgcttcatccaaccaattgaaccgaaggaacatgacccctaccgcattgtggcctttgacttggagacgatgcagcaccaaccagtcaatccacgtgagcctgagaagaaggaacatcaacccaacttcatcgctgcgagagttgcgtgtccagactgtattgagagcggaaagtggcggagagcaacggcaggctgccaaatatgcggactacatcgaaccgtcgctttttgtcagcgccgttttatggacactcaggtggacaagcaagtagtggctgacaacccgctggaggcatttgtggattggcttgtctaccaactgccaaaaaagtacgacacctatgcctactctcactttggcggccgcttcgacatggtgctcgtcttccgcgagctgttccggatcgggttcaaccccgagatgctgagacgggtacaatgctatttttctaaatttggttaatttaaaatttagggta

SEQ ID NO: 62239 - DNA, 111 bp, Heterodera glycines
  Genomic contig location: Contig_ID=SeqID_31926; Location=1160..1270; Strand=+
  SCN-specific regions: Sequence locations=1-111
ggccgtcgatcttggacaccatcccttgcgcatgttcggttattttgccatttaaccggttcaccacaaatttatagtaaaaaggataaacattaaattggaaaccaaaaa

SEQ ID NO: 62240 - DNA, 391 bp, Heterodera glycines
  Genomic contig location: Contig_ID=SeqID_31927; Location=332..722; Strand=-
  SCN-specific regions: Sequence locations=1-264,286-391
atggccataaaatatggaccaaaaatcgcaaaatatggacataaaatggcaaaaatcgcgaaatatggacataaatggcaaaaatgccaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaattttttagcgcaaaatcaacaacaaaagcgaaattttcgcttttttgcttatttttgacataatttattaa

SEQ ID NO: 62241 - DNA, 154 bp, Heterodera glycines
  Genomic contig location: Contig_ID=SeqID_31927; Location=442..595; Strand=+
  SCN-specific regions: Sequence locations=1-154
tgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 62242 - DNA, 228 bp, Heterodera glycines
  Genomic contig location: Contig_ID=SeqID_31927; Location=1194..1421; Strand=+
  SCN-specific regions: Sequence locations=1-154,176-228
atgacttcgacttctgctgatatttctagtgattttgatcagccgaatcaaaaacaggacccagatgactccggagaatttcaacgtgaccctgatgaattcgttgagtctattcagaatgaagtaactcaatggcttgacgaattacggcgaatcaaaaagcctggcgaaagggatgggccaaaactcggcacgcttgagaagtctctaaacgatttgcaggctgca

SEQ ID NO: 62243 - DNA, 356 bp, Heterodera glycines
  Genomic contig location: Contig_ID=SeqID_31928; Location=369..724; Strand=+
  SCN-specific regions: Sequence locations=1-103,125-136,158-181,207-356
atgttggagaatggaaacggaatgctcaatatacgtattttttcttcatacttcaaatcattttttgatcaatggtcaattgcatttgttctttttttcgaaacatttatggagaaaaacatttattttgtgatgtggtcagctgggttgaacctaattgtaagaaaagtgtcgatgatagtaataattaaattaataaaaatttagactcttagaattgattgaaaaataattagtttaacctttcgttcaaaaacttcggcctaagaaaagattcttttcttttttttaaactttcgatgatatcaaaatcgttttgtttacattgagataatgcgggttatgggctgatcaaa

SEQ ID NO: 62244 - DNA, 348 bp, Heterodera glycines
  Genomic contig location: Contig_ID=SeqID_31929; Location=246..593; Strand=-
  SCN-specific regions: Sequence locations=1-1,24-160,190-348
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaat

SEQ ID NO: 62245 - DNA, 348 bp, Heterodera glycines; identical to SEQ ID NO: 62244
  Genomic contig location: Contig_ID=SeqID_31929; Location=815..1162; Strand=-
  SCN-specific regions: Sequence locations=1-1,24-160,190-348

SEQ ID NO: 62246 - DNA, 532 bp, Heterodera glycines
  Genomic contig location: Contig_ID=SeqID_31930; Location=59..590; Strand=-
  SCN-specific regions: Sequence locations=1-423,445-532
atgtacagagcaaaaaatgcgtgtgaagagctaagcgaaattttggaagaaattaagagaaaacgcgtagaaatggcagaaagtttgcaaaaaattgcagttgcagcgcgcgaaaataaggaaagagtttatgtagacttttgtacacagcttgacattgaggcaaaaattaatcgagcagtgattaagaaaaatgaatggcaaaacaaaaaagaacaattggaagatatttttgacataaaccctcaaaattcactaaatagcacaattcttactccaagaaatcagccaatcaaaagagtgaaaattccacaaatacaattgaaaaaatttgatgggtcagttgaaaaatggataccattttgggagacattcagagtacatgtccacgaggatgattcggttaccaaaattgaaaagcataatttattggagtcaaatttagaaggggaagctaaggagctaattgagggaataccaatttcggaagatggttaccaaattgcaattgatttacttttggaaaaatacg

SEQ ID NO: 62247 - DNA, 255 bp, Heterodera glycines
  Genomic contig location: Contig_ID=SeqID_31930; Location=1543..1797; Strand=-
  SCN-specific regions: Sequence locations=1-40,245-255
atgcttattttggaagtcaaacccgcaaatttttatggtaatttattaatcaatatatttttttaaaccttttctagcaagttattaattttattagtttctgttttttatattaatttttagttttttaactcaatttcattttattatttattttcttttttattaattttaattaatttattgcgtataattttagcattagtcaaattaatttaatttctctgtttattttatcttttttctaaaaataaa

SEQ ID NO: 62248 - DNA, 714 bp, Heterodera glycines
  Genomic contig location: Contig_ID=SeqID_31931; Location=870..1583; Strand=-
  SCN-specific regions: Sequence locations=1-147,169-181,203-430,453-714
atgaatattattgacaaaattggcaataatatcgttaggccgacgctcgattttttgagcaaaacaaagctgtcgttatcgcacctcagcggaggctttgattttgatggaaaaatgccgcaaaaagaggtgcgatcagattagggcaaattacactaatttttatatctgtagttttgagatgctttttgagcttactattagtcttttaaatctggcatttttaatcttaaacttttttaagccaaaccattggagcgtaaacaaatcgcacagtggctttttaattttgaagcctacatatacaaaagcaacagtcgtcgggaaaataaatggtgaataatagaatatgcaaatgtttattattggtataaaatgcatgtttaatatatgaaatgctataaaactaacaatttttgttcgattttacaattttttataaaattaaattacagaaaattttccagattatcggatgttaattgctgagtttgaccttatcccgcgttttggcatcgcttattacgagactaaaataatccgaaggcaaatgtcctacgggagcgggtatgtcaaaaactcaaattatagtagtgtggcccgacaggaattcatgtctcttggacttaatctttgaaaaattatattcatggtcacggtttagcaacctgtgtaagaaaattgggaattaaatagtagattaatattaataaa

SEQ ID NO: 62249 - DNA, 1481 bp, Heterodera glycines
  Genomic contig location: Contig_ID=SeqID_6625; Location=2756..4236; Strand=-
  SCN-specific regions: Sequence locations=1-353,375-638,660-796,818 -1056,1079-1163,1185-1253,1276-1349,1377-1481
  Gene Ontology: Mol. function=non-membrane spanning protein tyrosine phosphatase activity; Cellular component=cytoplasm; Biological process=protein amino acid dephosphorylation
aatttgaggatcaaacccttcagaaaatctatttattttatgaggagttcccgaagtgatcagttccatttctctcccaaggtcaatttcatacaagaatggctctattattaaaattcgatggaaattaaataaatttccggcacagatccgtcgcgatttgtcctgtggtgagctaatctgtaccaacgagaacaccgctgcactgttggtggcactgattgtgcagtcggagtgcggcgacttctctccgttggactatccggacgccggcgcctatttggccggcactcatttcgtgccgcaccaaacgcccacttttgcacaggtcggacccatcgacaattgaagttgactgatcagagtcagaagaacgatttgatgatcagaaaatgccaaaattgatgtgtcaaattgaccagtagaggattcactgcttaagccgtactaatcaaaaaatatcccaggcttatcgatcatcaatttccaactgatcactccgttaaacttgatagcccggtgcccttcattcactttttgaaataataccatgtgaacttacataatccgaggatttttcctcagttcatttgcccttcttcttaggccgtgttggagcagcaccggcgactgattggcatggagccggccgaggcggactttgttctgctggagacggcacggcgctgcgatttctacggacttcggctgcacccggcgagagatatcgaaggtggggggggggggatttaaaatatccacccaatttatttgaactattttttacgtgatatttgcattatttatttgattaaaaatggctaatgtatttatatttgatcagcagtttttcgcctgtttaggcactgaagtcgctttggctgtggcgcatatggggattaaagtgttccaccaaatgaattgtgtcaccacattttcatgggcaaaggtgcggaaattgagcttcaaacggaaacggatgatgatcaaagtgaggcggaagaacaataattaaattttaaaaaggaaaaaattgcattaatgtaatctttggggtaatttaattatttatttttatccgaattgaggttcatcccgacagcttccaattctacaaagaaacaatcgaattttcgttcgaaaatcgagacgactgcaaaaacttttggaagaaatgtgtggaacatcactcattcttcaggtggtgtttatctctccattgccagcttcaattagcaaaataatctcctggcattttaaattcctttttattttggatgtgccgattcggtcgccggcagtgccaaacggacggaggaaaatggaacggggggaggacggaagggcacgcagcagcagcaacaccaccaacagcataatctgttcacgaggggatccaacttccaatacaggggacgaactcagaaacagctgatcgattacgtgagagagcaccgaaagaggagagagccctttcagag

SEQ ID NO: 62250 - DNA, 937 bp, Heterodera glycines
  Genomic contig location: Contig_ID=SeqID_6626; Location=1..937; Strand=-
  SCN-specific regions: Sequence locations=1-194,238-240,262-340,362-937
  Gene Ontology: Mol. function=Rho guanyl-nucleotide exchange factor activity; Cellular component=cytoskeleton
acttcgaatattccgcgaggagtggtaaaaaggaaattgataaataattaatcatatatatgtcttcattggcattttcaggggtgcccacctccgccggggatggacccgcgaaaaggcaaaggcaaattgatgtgtatcaaggcaagcagtgccatttggaacggcattttcagaacattaaacacaaatactatttatttttaaataaaataaaaatatatttattaaatatttccaataataagttgttaattttgttaggttcgtatgttggacgattcggtgggcgtttttcacctcggggttggttattcaaaagcagtaaaatataaataaaatcaattatgttgataatacagcataaagcggcgggccaagcactgtttgaggaagtttgtcggtatttgaatctgttggaaagtgactatttcggcttggagttcatcgacagctatgggaacagagtaattagcaagagggactaatgggaattcattataaagcaagaaatttcaaaaattctgaattttagaatggcctgggttgattttctgggttgaaatccgtttcaaaaaaatgcccgcccgttccttaacttaaccaggcagaaataagactggatcacgacccggtccccgcttaattacctaacattaaacgccttttcctttttaaacgccttttctttgccccccccggcggtcccattcttatgctataaaatgatcattgaaacggctatcactttcgcagtgttggctcgacaaggacaaaagcattttgcgtcaaattatggtcgcccaatcggacgcccgctttttctttgtggtgaaattttacacgccgaacccggccgagttggaggaggagtacacgcgctacctttttgctcttcaagtgaatgaattggaaaattccatcaaaaaagacttaa

SEQ ID NO: 62251 - DNA, 592 bp, Heterodera glycines
  misc_feature (155)..(155): n is a, c, g, or t
  Genomic contig location: Contig_ID=SeqID_31932; Location=386..977; Strand=-
  SCN-specific regions: Sequence locations=1-180,202-592
tttattaagtgagaagggcgtgagaatgacccaaacaaagtctcagtgttcaaaatttacggcaccaaaaagcttacaggaattgaaatcattgctcggcgcacttacatatttcagaagatttattaaaaattttgcgcacattgcgagacacnttcaaattttaacacaggacaaatttgaagggaaaataaaagaacattggggaaatgagcaaagtgaagccttagaaacccttaaaaatgtgttaacaaccgcaccagttttacaatcaccccgttttggtaaaccatttatcattgagtgtgacgcatcccgaaaggcaattggggcagttttactacaggaaaatgggcaagtagctttcgcttctcgggctcttaaccgacacgaagctaattatccatccatcgaacgagaagctcttgccctcgtttattcggtcaaagaattttcaccatacattgtaggctcaggaataacaaaagtgataactgattgcagcgcattaaccggaatgatgaaggcaaagggattaaagggtcggttatagaaatatcaagtaacttttcaaagctacgacattgaaaaa

SEQ ID NO: 62252 - DNA, 101 bp, Heterodera glycines
  Genomic contig location: Contig_ID=SeqID_31933; Location=43..143; Strand=+
  SCN-specific regions: Sequence locations=1-101
aaaaatccctcaaaaataaaaggtctattgcgcaccgccctccctatcatgctcgagagcatttgtatgtgtataaaatttatcaaaaaaagagatagcca

SEQ ID NO: 62253 - DNA, 305 bp, Heterodera glycines
  Genomic contig location: Contig_ID=SeqID_31933; Location=297..601; Strand=+
  SCN-specific regions: Sequence locations=1-305
aaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatg

SEQ ID NO: 62254 - DNA, 305 bp, Heterodera glycines; identical to SEQ ID NO: 62253
  Genomic contig location: Contig_ID=SeqID_31933; Location=678..982; Strand=+
  SCN-specific regions: Sequence locations=1-305

SEQ ID NO: 62255 - DNA, 104 bp, Heterodera glycines
  Genomic contig location: Contig_ID=SeqID_31933; Location=1184..1287; Strand=+
  SCN-specific regions: Sequence locations=1-104
aaaattcctcaaaaataaaaggtctattgcgcaccgcccctcctatcatgctcgagagcatttgtatgtgtataaaatttatcaaaaaagagatagccattttt

SEQ ID NO: 62256 - DNA, 204 bp, Heterodera glycines
  Genomic contig location: Contig_ID=SeqID_31934; Location=753..956; Strand=+
  SCN-specific regions: Sequence locations=1-72,94-204
atggagcagtatgagcacggaatggagcagcaacagaacaccgacgagggagccgagccaatggccgtcgaagaacacacaaacgacggagaaaatgagcagctgaagggcggtgccgagttggacggcgaaaagccaaagcagcggccgatggtggacgagcagaatgtggttggtgctcagctgctcttcaacctgatttaa

SEQ ID NO: 62257 - DNA, 578 bp, Heterodera glycines
  Genomic contig location: Contig_ID=SeqID_31938; Location=1..578; Strand=-
  SCN-specific regions: Sequence locations=1-131,188-188,278-283,347 -363,390-578
ggcccgacttaacgccaaaatggacaccctttcgggcgcactcccgtgcttaccgattatgtaaggaatcgaggaaagtagtggaatttcactggtgccttgaggctcccacttatgctacacctctcatgattcttcacaaagtcagactagagtcaagctcaacagggtcttctttccccgctaaatttgccaagcccgttcccttggctgtggtttcactagatagtagatagggacagtgggaatctcgttgatccattcgtgcgcgtcggtagttagccgacgaggcatttggctaccttaagagagacatagttactcccgccgtttacccgcgcttaatcaaggttccttggcttaacattcagagcactgagcagaaatcagactcggacaacgtccacaaggaccatccgtctcctctgttttaattagaccgtcggattacccgagctcgagccagttctaaactggtcgttcagcgccaagcgaagagaataccctgacgagcatacatgcagctgaagcgctccacaagcagctctcagctctagtccacgcaccatccccgaaag

SEQ ID NO: 62258 - DNA, 466 bp, Heterodera glycines
  Genomic contig location: Contig_ID=SeqID_31940; Location=589..1054; Strand=+
  SCN-specific regions: Sequence locations=1-45,67-117,267-390,412-466
atgaaagtattcttaatgatttctttatttgtgtttttgatcatcattttaattaatattaattatgttggatcagaaaagaataaattggaacagaaatcatttgaagaaatatttggagaaaaatgggaagaaaaaagaaacgaagaacagaaaaaaagagaaataattggaaaatataataaaataaaagagaaaattaagcaaaaaggaagaaaatacccaagaaaagaatggagtaaaattgaaagaaaaatagcaaaaaaattgggcacaaatcgccaaaatatttatgaatggatcaaagaattaggattaaatcaaaaaacaaagaaatgctacaaatcaaaaactgacgaagaaaaactcgaaattgtacagaaattcattgaaatgtcaaatgaatataaacaaaaaggaagaacatattcgaaaaaagagtggcaacaaaattatgaagaaattt

SEQ ID NO: 62259 - DNA, 3043 bp, Heterodera glycines
  Genomic contig location: Contig_ID=SeqID_6628; Location=1000..4042; Strand=+
  SCN-specific regions: Sequence locations=1-116,152-698,720-728,775 -915,937-1146,1170-1174,1212-1241,1263-1355,1377-1408,1438-1608,1636 -1717,1741-2026,2048-2113,2142-2477,2499-2599,2625-3043
  Gene Ontology: Mol. function=protein binding
atgtcatcgtcctcaaagcaggggaatccgattgaacggatgaagcatttgttgagctcgggagaagacgcggacatccaatttttggtgggggacggagacaaaaaagaggcgagttttttttaatatttcaatttgaaatataatttatgtcaacttttaaatttttcagcttctgtcggcgcataaactgattttgaagcacgcttccgaagtttttgaagcaatgttccgttttgactcacagaaagaaaaaacagaaaatggtgagaaaataaaaatttgttgattattttttttgaaattaacccctgctaattgccataattagggatggcattcttagttttttaactattttttctgcggctttaactcgacgagaaatgcacgaaaaacacattctttttcgaaaatttttcatttttagtgccaatattcatcactaggaatcactattttggagctttgccactaaaaaaagctatttcggaagttggccactaaaataattttttgcaactattttggcattttttggaaaatttcccaaaaaatgcaataaaaacgaaaaatacacccctaagaatcaacctaaaaattttcaaaaatacacccctaagaattggaaaaatttcacaaaaattcttccccaaatttttttttcttgttcaatatttgctaagaaaatattttgtaactgcaatcagtgaacaaaattgtttgccttaattttaaattatttcaaattaaaaatagctatttaaaaaattacacccctaaatttggacctttttcgccactatttttgccactattttggcattttttggtcactatttagttaattattttgagattttttatcactaaaaatcccatccctagccataattacttttcaattagcctctgttgaaagtgccattgtggaagtgcccgacgttgagccaacggcgttcagagtgatgctcagcttcatttactcggacgatttgagtgaattggacggagacaacgcgatggcagtgctttatgccggtgaaaattggcacaaattaatttagggggcggttgtaaaggagggggggggggggtagcttcttatggaaaacgcaattgcagtgctttacgcgggtcaaaaaatttggagcaaattaattttaattgggtgattaatttataatagttatatcttatatatataaatagtaagaggaagagaattttcctatttgaggctgtgaaatttttggaaaaaaggaatagcgccattcaaaaaagcatttttcagccaaaaatacggcattgatcggttggtcagtccatgtttgcaaattccaattccgaagctgtccaatgttttcttggcctttgcccaggctcgtctttttgacttggaggtaacaaaatataatattatattttgttttttatggtttatacatttttaggatttttcccaccaatgtttgcgtttcatttgtcaaaatgcggtccaattgttcggatcagaggaatttttacaaattgatcagaatttgctctgtgatttattcgagcatgatcaattgatgatcaatgatgaatttgatctttggaatgcggtaaaataaatatttaaaatttaaattacatttgtttattttccaaggcacttaattgggccgatgaaaagtgccgtcaaaatgccatcgaatgttccgatgagaaccgtcgtgctgcgcttggcccggcacttttcaaaattcgtttccctctcatcccaccatatgcatttgtgaaggcaatcggtagaaattcaactgtcatttatcaacattacccccttttttacagttccttctggcatttttacaaacgatgaattcgtcggcgtttatcaattcaatttctaccctaattttcgtggtgtgcccgagctttacccattaaaattgccatggcatggacgaatttccgattggaacacagccaaaggcaacagagggaccctggcgatggaaattgagaaattttctgaatttgcacgagaggaagtggggagtttccgaaaaagtgaaaccgaagtgtcaataaatggactttcttggaaaatatcggcacaaatatatgagaaaagaaataaaaaatggtttggattttatctttggtgcaccgatcctacaacagaaagtgggcaaagaatattaatttggattaaaatttaagtggcattaattaaggtggaaaatggagctgcaaatattcggcgacctatcgaattgtttcgcaaaaaagcgggacgaaggatttaattggcaaaataaatgatcacattattagcaatgaaactcctgcttggggatttaactttttcattacattttcggttagaagacaattaaaatattttttcgcaattaaatgagcaaaattaaggaattgatggacccgtgcaaaggcttttacgacaaagacggggacaaagtgactttggtcatcgatgccgttgtggaggaagaaaataatgagaaattcataaattgaactttgagcaagactatttggattcggcgtatttccctgtcaatgagcaattattttcgtccgaattctttatggaaattctacagtatttatgctttggaaaatacaacaaaaatttggctccaaacgacattttaattcatacgacaaataatgatgttgtaaggaagagagataaatattattttgaaattgaatttttaagtgcgctgcggtctcgaaattatgtgggcgggtgattgagtacgtcgttgggtcatccaacccattcagcgtccgcaaacgcatcagcttgggcacaatgcagccaaccgatctacccgcatgtctgaagcagccggcgagagtgatggtgcgcggaggaatccatcctcaaatccgttcagatgaaaacgaagtctaccacctctacaattcaaatctcatgaagaaagttggatacatttcgatgttctaccatgtacgaattggtgattgtgtttggctcagtatagacttggtattgtattattaa

SEQ ID NO: 62260 - DNA, 578 bp, Heterodera glycines
  Genomic contig location: Contig_ID=SeqID_6628; Location=4549..5126; Strand=+
  SCN-specific regions: Sequence locations=1-283,317-557
atgaaggcaaaagaaaaacaacaacaacagcaacacaaccagccaaaaattgatgatctgctcaaggacttggcccgactccagctcaaccaatcacagcaatcggccggagttttgatgaccgtgccaagcccgcaaactacaatgtcttgctggcccaaattcaactcaatcgaatttgatggagttgtcacggtcgacagcggctcttctacccgccaacattgcggagggtagaggtcccgttgactttggtaaaattaatttgaaagagatagaaatgaaaataaaaaatattttaaattatattaaaaatggtttctcaaattcgttaataatttatttaatatccaaattaattttttgtgtcttttcaacatgtgttttccagcaaccgccttcgccgaggagcaacttgtgaaaaaaaaaacgcgttgctcgattgcattgctctggcggaggagtccgcaaagttgctgagcgcggatgcgcgaattcgctgtctcctggatcttggagaagagctggaggctgggtttcagcgaatacttagtgggtttttaaagaaggaaaaatga

SEQ ID NO: 62261 - DNA, 820 bp, Heterodera glycines
  Genomic contig location: Contig_ID=SeqID_6628; Location=5243..6062; Strand=-
  SCN-specific regions: Sequence locations=1-465,501-710,800-820
atgtctgtctctacccctatcttccccacccgtcccgaatggattattgtccaaaattgctctggttgtcctgggcttactgtatgtgcgagaccattgccatacactaagccaattgagtgcattcacccccgctcgctctcaaatgtcactgctcacctcctctcgcctccgatgagcaccggaaacgggggatttgatgttttcccgtttctccttctgcttttcatcctcattattatccttaaagttcactcttatcccaatcacgaaattatccatcaaaaattttagtgtgctgttctcgcggccattctttgcgttcgccgcccacgtcgtcgtcctcaatgctcagagccaatcttgcgcagttatcgtcgtgggaaggtgaaaaatgttttcaaaaaacgtaaattaaacttaattgctttctttccaaattacattttttttgttctatgagtcaaaatttttaaattatttgtttataaatattttttgtcatttacaggaggacgtggtgatcgaattggggagtccgatggcgaatcgtgacaatgacgaggacggggcaaaaaaggaaatctccgagcaggaattggagggtgagtgaaaatggcattataaatttatcgttttttacttactattatttcagtcattctcgaaggcaatgagaaagagtgttagaccatgcgcacggagtgcgcatatttaatatgatgaatttaaaatattaaatttaattatttttggttttaaattttcattttcatgtttagaataatatttttaaaatcattttctaagttaaaataaa

SEQ ID NO: 62262 - DNA, 552 bp, Heterodera glycines
  Genomic contig location: Contig_ID=SeqID_6629; Location=1072..1623; Strand=+
  SCN-specific regions: Sequence locations=1-375,406-552
atggctgtttgtaaatgcaaagtgtgcgacgagtgccgtcgaaagcaacggctgcatgaaattagcgaacggaaaaaaattattgaaagctgcggtggggaccaccactatataaaaatgattgaattacggatgcgcgacttaaaattatataaacgagcttataggcgaataaaatctgtgatcgaccaagtggtggaaggttggtaatataaggagggtgaaattttaaaaaaatttagggccattccatgtaaaatgcacttcaaagtgcaaagaagaatttacatattatttgattaaatgggaatgttgcactgaggattatggatggggagtgggctgcacatatgcagaaattagtgatatagtaagaaaaaaaataataattaaaataatatttaactgttagcgccaaaatgagttgttggcatattacgatcaggaacgggtgctcggcgatataattgtaggccgtcagggcagagatgcgcctagttaataaagcgggcgcgacgcaaaatacaaaaagaggggcggtaagtaaggtaa

SEQ ID NO: 62263 - DNA, 1056 bp, Heterodera glycines
  Genomic contig location: Contig_ID=SeqID_31943; Location=78..1133; Strand=-
  SCN-specific regions: Sequence locations=1-125,155-228,251-286,318 -544,566-724,746-907,931-973,996-1056
atgagatttgaagttgtgtcaattgctgaaaaagaacagcgcacgaatgaggatggaacgaagattaaattgagaaaattcttggtaagtgtaaaatcataacatcgaatccatctcaaaactcgaatatttataaaattattatataaaataacctcaattttaaattttttgttcaaattttaaggggtttttttttgaatgaaacaatttttttcaaaataaggcttttattaaatttaaaaattaagaacgtaaatttcggacacctataataccactggcccagttaatcccacattgtgaaatattgttttcaattgaaattatgttttataaaaccaaaattttcagaaagactcatttatttcgtcgggatttttgctgaacagacgaggaacggtaaacttttgcttccggctatcattgttttatctttattatcggcaaattacggtattttctttctttcaggtctattgccctcacatcaccaatttcccttttatctgggctaattgtaagcacgacgtggaagtcggcacttttttccagttttctgctgaattcgttaaagcaaaaagtcggtacgaaatccaagagattgtgaaagtgatctgtgattgccctttcgacgtagtcaaactgacgaaggaagaggatgcatttgcggtgtgttcctctgaatcttccgatggtttctctcgatgagtgaccgttttgtcatttccttctgctgaatgcattttctttcagttccaaattcccctctcaaccaacttttactacagcacttatcttgcagtcgacgttcgtttcaccctttcaaatatattataatatgtacttttcgcggttagggtcaatcttaattgagacattaaacttttcaaaaacctttcggcgcggtttttccaaaaaaaattttggagaacggggggggggggcggcggtaccgataggcgccgcccttttttcctttagcttttaaaatatttgtttgttggtgataagttatttatggctgatccctctcacaattagctgactaataaa

SEQ ID NO: 62264 - DNA, 1062 bp, Heterodera glycines
  Genomic contig location: Contig_ID=SeqID_31944; Location=20..1081; Strand=-
  SCN-specific regions: Sequence locations=1-172,210-278,347-352,378 -407,475-487,520-541,589-725,747-764,786-979,1023-1062
  Gene Ontology: Mol. function=small GTPase regulatory/interacting protein activity; Cellular component=actin cytoskeleton; Biological process=response to pathogenic bacteria
gcaaaggagagggactgtcggcgcctaaatattgcgcgtccaacgtttactacgcatgctcaggcggtgtgtccacgaagctgaactgcccgaaagggcttgtgttcgaccaggcaaaccaagtgtgcaactacccaagcgattgcggaaagaaacaaccgtaaaaacactcaaaaataaataattattaaaatttatatttattttaaggcctcaaccgcagcctccatctaaaggatacggcaaatacggcagaggaaaacgcgacgcgtctggagcaccgccagcacctccgccacctcctccgcccccacctcctccaccaccaccgcctccgccacccccagcgtacgagccaccagaaccgccaagctatggagccccaccgcaacccccaagctacggagccccgccgccgccaccgccaccacctccgccacctcctccgcccccgcctcctccaccgcctccgccaccaccagcgtacgagccaccagaaccgccaagctatgagccaccgcagcccccaagctacggagcaccgccgccgccaccgccgcctccacctcctccgccgcctccaccgcctgagacatctcaaccaaaagatgagagagcagttctgccactaccacaaccagaaccaacagcataaatgtgtaaaaatgcggcatagggttatatctataataatcatgctttagcagagctgattcactaaccatttcattctataaatttaaatatgttccttaaacttagaaaaaatattttaattctttttatttgcgtcggaagtctgatacttaatacaaaattgatcgttatagtttattttattacatatattatcacaatgattatgagaaatcggagtggcgtgtgaatttttgaattagaagcggaagatccatattaatgatagatctcaaacgctaatgaatgaatatgtagataatacaatattaattgcattatgaattaatttaaatatgaatttccatttattaataatttttttagcttttacaatattaattgtatctgcgctagattaataaa

SEQ ID NO: 62265 - DNA, 561 bp, Heterodera glycines
  Genomic contig location: Contig_ID=SeqID_31945; Location=566..1126; Strand=+
  SCN-specific regions: Sequence locations=1-444,466-561
atgcacgaatcaaatgggcatcgaattgccgttgaagcagatgaggaagaagaagccgcaattgctgatgaagaacgaattgagcgagagaaggagcgaactacctagttaaccgcattcaactagttcgtttatagaagcagcattaagaacaatttacagcaaaaggaagattgccatagagccaccgttgaagttcacgtacgtcaattgtttcaagaaactatattatgattacaacaaaagggagtggaaggaatatgttcaacaagaacgagctggtcaaaaactttgtcgccttaaaacagtatctccatcacatatgcaactttttgtaccattcattaattaatgagcaactttacaaatattttttatatgtgaactataatttgttaaatatatttgaaattgaatataaatatgatttttacatttctccattgacacctttcgccgaatttggggagatagaaaagagtcacttgtgtttagttcaggggtgcgagatgcggccaaaaatttaatatttgatacctttttgatcgaataattttaaaa

SEQ ID NO: 62266 - DNA, 885 bp, Heterodera glycines
  Genomic contig location: Contig_ID=SeqID_31947; Location=502..1386; Strand=-
  SCN-specific regions: Sequence locations=1-212,234-317,339-406,436 -485,517-583,605-885
atggctccatttgaatacctatttggttcaaaagtatttataaacaggggaaagctcaataagcttatggccaattcacttttcgagtgcgcagacagtgagaggacagacatacagagtggtgatttggccagcgaagttgtgttttgtaattaactattaacaacagaaatggatggatgactcatccaaaatttcccattaaacgaattattttggttttcatttgtgttgtgtacatacatttgtgtgcacatgtttgttttcatattaccaaatgcgctttttccacaggttctgtccttcctaataatcatttttatcccttttctcattccaatatggcagtgacttttgcggatttctttaaagtcatttgtgccatcattttaccggtttgtttctctttaaataatttattaatttctaattaatgttgtgcggtggagtaagatttggttttattatatatatgctaagttttgaaaatataattttattaaattgaatttaaatgggtatggcttttggatttgtaatcgaattaaataatgataatgcaacaatagtcaactgtgctgttagttgttactgttgaattgcaattattttagctcccttggcgtttttgtggagacgggctgctccatccacattttgattaacatcattttgaccattctcggctacatccccggcattatccatgccctctacatcattttacagtactgatgaagatatcgcaattgtgaaaattcgatcagttaaaagaattatttttaatttgtcaatttgcttttcaacaatatcggatgttttttgtgatatgtaacagttctcgccaattctctcctccattttcacttctcatttcagaataaa

SEQ ID NO: 62267 - DNA, 185 bp, Heterodera glycines
  Genomic contig location: Contig_ID=SeqID_31947; Location=1..185; Strand=-
  SCN-specific regions: Sequence locations=1-185
attaatttccggcatctatttctaccaatcaccgagccccagacccgaattcgaacaaaaattcgaaaagtcaaattttatgaattttgagttttatatcaattaaagattaatttccggcatttatttctaccaatcaccgaaccccagacccgaattcgaacaaaaattcgaaaagtcaaatt

SEQ ID NO: 62268 - DNA, 986 bp, Heterodera glycines
  Genomic contig location: Contig_ID=SeqID_31949; Location=351..1336; Strand=-
  SCN-specific regions: Sequence locations=1-6,31-187,209-245,285 -518,567-631,667-851,896-986
atgaatttaatcattttcttttgttttattcgcttgatgccgacgacattctcagcaaaattatggacaaatactgaaaatgattcgctaattgactcctctaatcgttctgctgctgatgctcatttgagcaatgttttgccatcggcaaatggtgataagattatggcaattcaaatcaaaactgatcaaaagcaaattgatcaatttcttgaagaaatttatgacgaatgttcagaaaaaggggagaaaaactcgcaaataattaacaaaatattaataattcaaagaaaaaaatcattggaatataataaaatgagaactgatgaacaacgaattgaaattgttcaccaaatttgtgaaatgcgtaacgaatttgacgaaaatggaaaacgcaaatataaaaatgtgaatgaaattgcaaaaattcttgatgtaagccttgcaaatatttacagatggatggacaaatttggattatcgcgtaaaataatatctaattttagacgaaatatccgatttttattttaatataaatttcaattcaatttttagatttaaaaaaagatcttccacatacaaaaaaacgtacgtaattaagaaggagattacaatttttaaaaattgtctcaattaattttatattcaataaaaaattaaataattcattcaattttaagctagacaccgaacatccgaagtgtggactttttttgaacaaatgccaaacagtctaaatgcaccaaatgtggcaaggaaattcgaattcagcgggacagacagacatcggatatgagacggcacttacagaaaaagcatcaattactcatgcctaattagtgaggaaaaagaaaatattattatttttagaaaatttcatttaaattataattttctaatttgtgcatcattttattttgtcacagcaaattaatttatattttcaatgccttaaattttgattttgagattatgatgtaaataaa

SEQ ID NO: 62269 - DNA, 658 bp, Heterodera glycines
  Genomic contig location: Contig_ID=SeqID_31950; Location=312..969; Strand=+
  SCN-specific regions: Sequence locations=1-658
ataaaaaaatcgattttttcaagtgtccgtttggagtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 62270 - DNA, 410 bp, Heterodera glycines
  Genomic contig location: Contig_ID=SeqID_31951; Location=145..554; Strand=+
  SCN-specific regions: Sequence locations=1-168,190-410
atggagtctttggactcgcccgcttttaagctcgaagcggatgagtcagacgagtcgggtgattatgtccaaatcaacaagaaaatgcgcgagtcgccatatgttaaagtgcgtccgaagcggtcgcggtaaggacaaattgggaggtggtatatatattttagcaaatttattcaacagtctcaactctccgcgcttggagttttctcgattcatcccgaagagttccctcaaattgtctgtttcgagtcgttccgttttggtgtgtgttttcttagtcagcagtttgacctttttatgtttgcaatgttcagaaaagcccagatgacgctggtccatacgtcaactccccgattactttggattagattgctgatggtttgtttcccaccgtaatatacctaattgta

SEQ ID NO: 62271 - DNA, 191 bp, Heterodera glycines
  Genomic contig location: Contig_ID=SeqID_31951; Location=1223..1413; Strand=+
  SCN-specific regions: Sequence locations=1-191
atggaattggatttggagttccgtccattcaacaattacccgacaatgtcttggagttgattttcacctatgtgtcgccttacgaggattacaattccataaaattggtgtcccggcgatggtattatcttgcgaccgcaacgttgaggcgaatgaatcattttttcaacaaatgcataaacttttcatgg

SEQ ID NO: 62272 - DNA, 1144 bp, Heterodera glycines
  Genomic contig location: Contig_ID=SeqID_6631; Location=488..1631; Strand=+
  SCN-specific regions: Sequence locations=1-35,57-312,336-660,682 -749,772-875,904-1036,1058-1144
atgcgcgggggctcgtcaagtaaaagccatttaactattttaaaattataaacattaacttatttaggagcgtcgacgccgcttcaatcgctggttcaatccgagtcaaagcagccgcttcacacgcaacaaattccggccatttatcacgggcacattccaacagaagcaacaagcagattgaggtgggtgttttgaatggctcaactgatgcagttcacgcgaccaaacaatgagtattccacagtttcttatgcatattttttcttacttttcataaaccattcatttttggtataacgaagacttgaaacctattcatatttcaaattttgggcttaggacaatagattaaaaaatgctgttgaatacactcgaaaagatattattttggatgcaaacagataaaaatttgataaacctttttgtagaataaacaatcaaaaaatctaatgcgttctgtaattctgcaaaattccaaaaaatcagacccataaactaaacaaaaaatgtcaagtcgagttttcgcacctttttgtcataactgttttttaaatggaccataattttttaatttggaggcttacagaagacattttactatgcgaaaaggagccagacccacaaatttgtaataaaaaatgttattaaataaattgtaattttggccaaatattttcctttaaaggcaccatctcgcggtcgaaatggaggctgaaccaagaagatacggacttggcatgccgacctgtaatattttaaaatgtgattaacagaaaccatctgactgttattacggtcagcaagtgcaaccactacagtataccatccggggccgacggtcactgcacggccaatggagtaccacggacgtcgaaatggtggtggaggaggaggcggagagggcgggcacagtccaaattcggagttgaggggccgaagccacgggggcagctgcagtccacgcacacaatgacaaaaaaaatgggagagaagcgggtgctgaatttattaaatgaaaaaaacaaaagtgctctggaaaatatttaaaaatgggtggagagtaaataattagcatttacaattatgtacagagaaaaaattaacaaagcataaaagttagttctatgtatgtatatttcta

SEQ ID NO: 62273 - DNA, 1005 bp, Heterodera glycines
  Genomic contig location: Contig_ID=SeqID_6631; Location=2649..3653; Strand=-
  SCN-specific regions: Sequence locations=1-227,263-539,569-623,661 -748,854-867,986-1005
atgccaatgccattcaacgcggcgattggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacacaaaacgaaaaaagcaaataatttcaatttcaatttgtcagatgactcctcttttttcactacaactcccatcaattctctgtttccatgcgtttctctgtggactggcgacaaaattgaggcgaactttgggccaagtttcaaattcaatttggccactctttgaagaaagctgaagaaacaacggaaagggcgattactcatttaattaattaattcattatccatttttcactttatttttttcacatttattttcagttttttatattatttatcatgcgtatttgttaacaaataaattttactgttctttttgtttgtcttcattttttcatgtaaaaatttgatggaaaaaatggaacaggaagaaactcttgaacctgaagagattaaaaacttaaagaaatttttaaaatattaaattactcaaaaaatctctttttttctttcccctcatttatgtcccattgtgttacaatttaaaacgtttttctcaaaccctttacccaactgtaaaaattaattaaaactaaaaatacatatttctatcatatgaaaatattaaataaaaaaagtctgtaaaatataaaataattataaaatttttattataaaaatgaaaaaagaagaaaaaagcttacaacaccttcgattcccaggacgtctccgttccaagtactaagaaggcccaacgttgcttaacttgccagatcggacgggatggcgtgctttcaacgtggtatggtcgtaagcgaaagggatctaattga

SEQ ID NO: 62274 - DNA, 469 bp, Heterodera glycines
  Genomic contig location: Contig_ID=SeqID_31952; Location=1031..1499; Strand=-
  SCN-specific regions: Sequence locations=1-198,232-246,269-335,381-469
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcgggggatttttttccattaggtcgtccgttagcgttcgattgctctagtcaatttttaaaaatttttgttgaaatatttgtagtgctctgaagggcgtgggggggggggggcgggggcccaccacgagtccgagaagcggccgagtgagtaccttcggtgcaggaaaattattaaggaagagagttcattatttatttattttttgcataattaattcataaatatttttttcagaaaatgctctgaaacgcaccaaattttatttacatgttagtttaggcactctgatgctttttctatcaaaaagggagatgaataaa

SEQ ID NO: 62275 - DNA, 845 bp, Heterodera glycines
  Genomic contig location: Contig_ID=SeqID_31952; Location=1365..2209; Strand=+
  SCN-specific regions: Sequence locations=1-192,216-358,380-845
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgcccaggaaacaaaaaaatcgattttttcaagtgtccgtttgggg

SEQ ID NO: 62276 - DNA, 1282 bp, Heterodera glycines
  Genomic contig location: Contig_ID=SeqID_31954; Location=94..1375; Strand=+
  SCN-specific regions: Sequence locations=1-63,85-199,222-737,759 -1056,1078-1259,1281-1282
atgaagacgcggccgtttcccatcggcacgccaagtgtgtggaccggtgagcagctgtggcaccagcagcagccacaaacggcaggaggccacccccacactgattgtggtatgtataattatagttttatgatcatgactaatttctgccccctttttctacagctggaccaccaccaccggttctccgaccacccgcactgccatggtgccgaccggaggacaaccccttccgcggcttcctcttctgccgtgtgctgccacccagtgcggacgagctgggcgaccgcgagccgctgctgccctatcgcacacaggcagacggacgactcacgttcggcttgtgcgcacgatgcgcggagctccgacagcagcgtacctgtcgtcacacggagcgtgagcgcgcgtggaccgccgcctacacgcatgtggaagtgaatcgcgcgatgctcctcggctaccgtgtgctgcaggtgcacgaggtgtggcactacgagcagtgggcgtcgccggagagcgggaacgggctgttcagcgactacgtgaacacctttctgcggctgaaggcggaggcgagcggctggccggccggctgtgacgacgagccggcccgggcggagcacgtgcgtcagtttggggagcaggagggcgtccacctacgccgcgacaacattgggcacaacccgggcctgcgacagctggccaaggatttgctcaactccctgtggggcaagatggcggagcggccggagcgcgacgaggtggtatacacggacagtgcgcgtgccttccacgagctgttgatggatgcgcggcaggaggtggtcagcttcacgcacatcaacgagcagctggaccgctgtgtggtgcgcaagcgggagccgtttgcacgggcgccggagcacaacaatctggctgtcgcctgctttgtgacatcacacgcgcggctcaacctgtacgaatggttggaggaggtgcggcgggtaggcggccgagcgctgtactgcgacacggacagcgtgttgtatgtgaggcgactgggtgcggccggtgtgcgggagggcaacgcgttgggcgacatgaagcgggagctgcccggccgccgcatcatcgacttcttcgccgctgggcccaagaactacgggttccagcacgtggacgcgcgcacgggccaggacctgagggcggagcgcaaggtgcgctcctttgagctcacctacgcggcggaccaacagctgcagtacggacggatgcgccagctggtcatcaaccactttggcag

SEQ ID NO: 62277 - DNA, 1119 bp, Heterodera glycines
  Genomic contig location: Contig_ID=SeqID_31955; Location=56..1174; Strand=+
  SCN-specific regions: Sequence locations=1-236,258-498,555-964,986 -1119
  Gene Ontology: Biological process=growth
atgtccctacccggaggcgagtcacacccgaaatcactacctttaaattggtttccaactgtcaacttcagtattgtcaacggactccgttgggcaatcaccgatgcctttgtccgtcttccttttcgcgcgactcccaaactggcgagtgcgtgtcgtcgcgcgtgccgttgccgcccgcctcgccatgcccggcggggaaaatgctgagtgcacggacaggtgaaaaaaccattattaagcaaaaataattgctgaattctttatgcaaaattaaggcaaatgtttgctgcctggctcctgcgaccccaccgacgcaaattcgtgcgatttgcggaaacgcgagttgtgtttgcgcactacgccgcaacagtcgcagtcgcacccgcaagttcagcaagttcggttgcccacggcaccgccagcgacagaccaatcgtacagaaagaagcaccgcgacacagagacatatgagacaagtaggaaagcagaagaagcagaaaggggctgagggaaagagaaagagagagatagagagggggggggggagacagttcgtattaaaagaaattttcaatttttttttgaacagaatttttctaaaggcctctgatggacttccgattcgaaaatttttctctcggtccatcccccgggggcaattgacaaaagtggacacgcattcactcactcattcagagaacccgataagttacgtgtcctcacaattgcccgattacacgtgccaatgtgtgagcggagagaaacggcatccgatcacaggagtgtgccgtaagaaatgaattgaaatgttgcaaataaaataaatgttatgattgatgttcagttcggaatgaatgtcttcggaaggaggacaacgattgcgacacgcacgcccaatgcattgacacggacgaagggtttttgtgcatttgtctgccggggttcatggacaacagtcaggacaaagtgcagcacacacaagcatggcttaatttgattccatttctctttgcagttgcgtaaaccgggccgtgtctgtacgcctttggtcgacgaatgctcctcgggcattgcgaagtgttcgccccatgcgaaatgcaccgatacgcccgaggg

SEQ ID NO: 62278 - DNA, 1579 bp, Heterodera glycines
  Genomic contig location: Contig_ID=SeqID_6634; Location=262..1840; Strand=+
  SCN-specific regions: Sequence locations=1-280,313-367,389-417,503 -550,589-752,774-791,835-1063,1099-1323,1345-1579
  Gene Ontology: Mol. function=gamma-glutamyl transferase activity; Cellular component=integral to plasma membrane; Biological process =spermatogenesis
tggaaccaatgtgcggtggtgacggatcagcagatgatcaatctcaagccaattcactacaaaatgatcccaaattctaccatcggctgattgaggcacaaaaatttgcatacgctcaacgcgccaatttgggcgatcaagcatttgtgccagaagcgaaaaaattggccaagcacatgacaagcaatacatttttgcataatgtgcacaaaaaaatgttggacaaagcaatgccggacgagcattacactgatgatcggcccatcaaggctgatgtgcgtttaatttaatttttttttttaaatttattttcatggcatttattttaatggattttcatattttcacgaaacttcttttgtgctaacaattttcaaaatttcattttctaggttataagcctcttcaaaattagccttttatatttagtaattaaaattttttaattttgttttacgaattattacttttttaattttgtgaaaaattaaactatttttatgtaaacagttcatccatattttttgagttatatgaggccatagtacagtaaattaaacaaaatttgttttttttttaaaatttttagaaagatcatactggaacatctcacacatccatattagacgctgatggaaatgccgtttcagtgacaagctcaatcaatcaatggtcataatttatgggatttaaaaatttatctaaatggacaaaacttattccgttattttataggtttggggctgtgattcaatccgaaaatttgggcattatatggaatgatgaaatggtaaaaaaaattatttaatggttttttaatattttattttatttgcaggaagatttctcatttcccgatgtgaaaaattggttcggatatgccatttcaccaaccaattttgttgcacccggaaaacgtccaatgagctcatttagtcctatggtcatctacaacaagcacacggggaaagtgagttgcaaacgaattttccatttttttaaatttttggggcaaaaatgaagaatacttgaacggaaacctaatttggggaaatcgtctttaaaaagtttcaaagacttttttgaattttagaaaatttcctgtaaacttttctctactttttatgaaaattttgtcgctgactaagatgttactcgtcgatagttttgaaatttcccatgccacttcatgacaaattttgtcgaagaatttccttccctaaccccgacttttctctccttgatggccgtggtttaactctacttacaattaacagtgtaaaaattccccgctgggtaacgaatgtcggggaggacaggtccgggagaaggcccaaaaaggtcggggatgttgaacgggagttctgggtccgggctcaaccctaattgatatcattaaatttatcaggtgaaatttgtcattggcggctccggcggtgccaaaattccgtcgtctgttgccaaaacagtgttgcatgtgttgtgcctgaaccaaacagtgaaagaggccattgatgcgccagtgttgcacaaccaattcactccgaaccatgttatttacgagaatgggacaccgccg

SEQ ID NO: 62279 - DNA, 292 bp, Heterodera glycines
  Genomic contig location: Contig_ID=SeqID_6635; Location=523..814; Strand=+
  SCN-specific regions: Sequence locations=1-292
aaattgatcaaagatctaaacgaaaacttcgggcacattatgaagtcgtacgacaacaacaacgtggttgtgcaagctattcatgtggccgatgacggcttcatctatgcaaatggggacttccgtcgtcgaacttacatgcacccggccggcttctaattggcgtggcacggtgccatgaatttgtggacggacccccggagttttctagactgaatatacaatataacaccaccatcaacgcataacaccatagattatagacaaaaattgaaggcgatgggaatagaaa

SEQ ID NO: 62280 - DNA, 1515 bp, Heterodera glycines
  misc_feature (72)..(72): n is a, c, g, or t
  misc_feature (93)..(93): n is a, c, g, or t
  misc_feature (158)..(158): n is a, c, g, or t
  misc_feature (172)..(172): n is a, c, g, or t
  misc_feature (211)..(211): n is a, c, g, or t
  Genomic contig location: Contig_ID=SeqID_6635; Location=3033..4547; Strand=-
  SCN-specific regions: Sequence locations=1-163,215-666,688-713,745 -827,929-949,972-1040,1062-1113,1136-1515
atggatgaagcgcaaagattgatcaaatcggaattaaatgtgccacacgattgcttcaccgatgagaatggnaaattcaaattggaatatganattgagaataagagcagagaagtggcacgatggcgtctcccgcctgtgcatttgtacatttttgnggtacattttttanaataatttcactttttattttttttattttaataattanattgcagtccatctatgagaattttaaaaattttaggactcacaatttccggaataacggggaagaatttgatcagtaaagcagccgatttcctgttctggactcaaagttcaattcccaaaaaatataagtatcgagatccggtttccaattttttgatcgccataaactaagaagactaattaagcactctaattgatcacgtaaatcttatcgattactcagtctttaaaataatgagaattcaatcataagtgtcgtaacgaaaaattcttcatccacactaatactaatattaaaaaggcatttaaatttttaggcaagcgtttggacaaaagaatatgtgcatgtgacagattggcatcatgtgcatatctttgatttgaaaaatgggaaaaaatacgcactttcggcggataaagtcgctgaaaaattatacgaattaagtaaaagggacaaaatgaatgaacgaacaaagttggcagaaacaaatgaaaaaacgaaaattaagttttattatttttttaaaattagaaaaacgaaaaattaaggtaaaagagtccatttttggtcattggtcttatcagctagcttaacagcaattttgagcattctgatttataattaataaaaatgccaaaatattttgtataatattttaagaatattaaaacttaatgaatttttttttttacaaaaaatctaagtaaattttatgaattggttttaaaaaaaacacaattatttacttaaaataaagaaaattgaaagtttctgatcaagcagaaaaacatccggccttgtttttgacgaaaaatcattgatcaaatcaattcaaacccaattctttcttccgataaaaaaatatattgctcctctctaattaacttaactaaattgattttaataaaaatcattttttagtgagatcacgttcacgcgttcgttttgccgattcagacagtgactattagaaatttcgatgtcaccgaagtttttcgctggatgtgttggaacgggaattggagaatggctgatgaatttttggaatttataatcataaacaatttgttagattagagttcaagaacatatattaactaagtgtggtgtcctcatatatgtctgagtcattatgttaaaattcaaaaaaaaaaattaatcaaaaacacgcaaattcgaatttttacaacaatttttcagaggactgactgactcttttttcataaaaaatcataaaaacgaatttctaaactgaaaaagtattagtcattgttagctccacaaatgttgaattcaataaa

SEQ ID NO: 62281 - DNA, 213 bp, Heterodera glycines
  Genomic contig location: Contig_ID=SeqID_6635; Location=4979..5191; Strand=-
  SCN-specific regions: Sequence locations=1-12,34-160
cgaaaaggaacacattatgaaaagaaaatacgcgttgacgattgggacaatcattacattgtggatttggccactaatgatgtacaagatgtgttaaaacaaaatttggacttggaatttctaaagctaagagacagtgttgccagtggagaaagttggctttaaaaaaattcaaattatttattaatttctaataattataatttaaataaa

SEQ ID NO: 62282 - DNA, 343 bp, Heterodera glycines; identical to SEQ ID NO: 53449
  Genomic contig location: Contig_ID=SeqID_31964; Location=1137..1479; Strand=-
  SCN-specific regions: Sequence locations=1-225,247-343

SEQ ID NO: 62283 - DNA, 371 bp, Heterodera glycines
  Genomic contig location: Contig_ID=SeqID_31966; Location=31..401; Strand=+
  SCN-specific regions: Sequence locations=1-94,118-155,177-371
atgtacgtgaatcaaagtagaaccgaaattcgtatggaaattttaagtgaaaaatgccaaaatttttcaattggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatccgagggatgcttatgccgagggaagaacgatgccattttgtttgtacgcaaaggctaccgaagaaattgagatatcaatgtttgacatcattagtttgtacccctttgtgaattatggtaaaaatctgcttgcatttttaatattgccattcacttaa

SEQ ID NO: 62284 - DNA, 637 bp, Heterodera glycines
  Genomic contig location: Contig_ID=SeqID_31968; Location=52..688; Strand=+
  SCN-specific regions: Sequence locations=1-72,126-193,215-257,288 -341,363-410,432-497,554-637
atggtggtgccaacccaagcaccgccggtgactgctgccgctgaaggcacatttcgggcattgccggtgatcaaattaataatgaattaatttgtgttaattaaaaaatattaattaattttaaagttacctgcgccagcggatcccgacctgcaatcactgactttcgaagcaagcatggcagttgataaagcactgctaaagtggaaagaaattgacccgcaggtggccaattggctgaacaatttcaaagtgagtttattattttatttattattgttaataaagaaaaagtccgcaaaaggaaattatctatttaaaatcactttggattagcatatccattaaattgaatttgtttttgcagttactaatttgattatagaatttttgatttttttgaattgatgaaatgattaattacctaatatctaattaagttgttgccaaaggctgttgcctacccacaaaagaatttttgccaaatttattttcggaaattaaatgattattttaaaaaatgtttacgaaaaaattattatttttttaataagtttgtattaaataggaaatgctgaaccgtcttgggaatgacgccgacaaatatcgtccaagaaaaccgccgcgtgcaaattaa

SEQ ID NO: 62285 - DNA, 1441 bp, Heterodera glycines
  Genomic contig location: Contig_ID=SeqID_31971; Location=10..1450; Strand=-
  SCN-specific regions: Sequence locations=1-21,46-89,119-149,172 -660,683-879,901-1203,1359-1441
  Gene Ontology: Mol. function=protein binding; Cellular component =lamellipodium; Biological process=small GTPase mediated signal transduction
atgctggctcaggtgagtgtgattaatttattttttaattaaattgggtagtttgtcggcaaagtgattttccatatttaaaaaaagaatagattttgaaggaaatgaaacacattctctaatatttgttctcagatatggcagttggctgatgtcaacaaggatgggaaactggaccgattcgagttttcaatcgctatgaaattggtgctcaattgcttgtccggcatttcacttccgtcggtgctgcccgagtcgatgcttcgaattggcggtggcatgccaattccctcaactccgtcgtcatattctctgtctaatggcggtggtccatcgacggctttgccgtcctccgtaagccatccacgtccaatgtccacttatggctcaatgccggcgatggcctcgtcttctcatcgtccctacggaagtttttcagcaggtcacttcactttgaattcttttatttggtaaaaaagctataaaaacttagcacaaacaccagtgaccgcaacttcacccccgtttctcatgggaataaaagaattgggcgactggagcctgccacagccgttaaaattgcggttttctcagaagtttaatcagctcgacaaaagtcgagtaggacttttgacggggcaacaggttgtcaaaaattgtaaaaatgtaaataaagttataattaattcaggctcgtggtgtgcttggagaaagtcagttgccgacgaatattttggcacaaatctggacaatgtctgatgtgaacaaggacgggtgcttgggcattgaagagttttgcaccgcaatgtttctgatcgaaatggtcaaggtcagtgtttttggtcgatttacaattgtgaaatattattttagtccgaatttattttttcactttctttgttaggctggctatgcattaccttccaaactcccaaatgagctccattccttctgcaaccggagcaaaacagtctctccgtctacgatggccacggaggacgacccgtcggctcctccgccgcaaaaaccgggccatggccaattcagaacttttgaagacaaacggaaggataatttggacaaagggcaggccgaattggaacggcgtcggcgcatcctccgagaagaagtgtgtttttcgtgatttaatatttgttctactgaatgttttaaggaggaacgacgaagagccgaaatcgaacggagggaaagagaagaagcagaacgaaaggaacacgaaaggcaagaattggagagacgacgagaggcggagatggaggaggaacggcagagggaattggaacgggagagggagagagcggagcaggagcagagactgaaggcgaggcgggaagagatccgcgagagaatggagcaggagagaattcgagagctggagaagattcggatacgggacctcggggtgggcatacgcttctga

SEQ ID NO: 62286 - DNA, 737 bp, Heterodera glycines
  Genomic contig location: Contig_ID=SeqID_6636; Location=240..976; Strand=+
  SCN-specific regions: Sequence locations=1-215,239-387,428-507,529 -620,643-701,723-737
atggggccgaacccgaagccaggccagaaaaattttgtattaaatttaagaattgcaacgggttgttacgggtggaaattttccggcgaatttgggccaaactgttgggcttcctgttgcgccgaacgaaacggacatagtaagaaaatttcgaagacagatagataacatacattattagttgtaagcgaaaaaataaaaattctggttttttaagaaggaatggaaaatttttgaaaattgttacgaatcggctaccccaataaattcgattcgttaaaaattttaaagaaacgatgaaaagcaattcggtagataattttgtcatcactctttctgacagacctactcaaattttacagaaaattttcccaacccactaggaattttttcgaaaattttcccaatttttagtgtattttatgggtgttaagatgagagatgaccatcaaggagtgatctgatttatgttggtccaaaagacttttgatcggcatcaaaagttatcttagaaggaattttttcagaattttatctcgacataaaatgtcggggcaatttttggctataattagtgcactaattgatgttttttcttttgacgtaaaaaagacctttttgccaccattcatttttgagaaaacgaattttacaaaaaatgatacaatatttttgagactaacagtaattaacatttttcataatttataaatttacaaaaatatcgaaaaaggaaa

SEQ ID NO: 62287 - DNA, 203 bp, Heterodera glycines
  Genomic contig location: Contig_ID=SeqID_31972; Location=358..560; Strand=-
  SCN-specific regions: Sequence locations=1-7,29-203
gcctcgttggacgcagtggggatgacaagtacaaatactccaacgatgtgtccgtggcgcctccaatcgccctgttgccgtcgccgttcccccgcgagttgtacgagcaggcgactgacgcgcaacagtcgctgaacgaactgtactaccgcatcgcatgcgaccacgaatttctgatggaggcgtacaaggacgtgatcaag

SEQ ID NO: 62288 - DNA, 1208 bp, Heterodera glycines
  Genomic contig location: Contig_ID=SeqID_31973; Location=138..1345; Strand=-
  SCN-specific regions: Sequence locations=1-306,328-333,380-904,926 -1208
atgaataactttgaccaattgaaatccgaacaacaggaaaagttggatgatcaaatggccgaaatggaaatattaatgaacggggcccaggaggagaagaacaatgaaggcacagaacaatggcaaactgaggaaaaacagtggcaaagcgtaaaagaaaaaattaaatttaaaaaggaaatttttgaaaatggcaaaatgctattaacaaaagcatcagcaaatgattttgatttgatcatcaaagagaatttgttcaatttgcatgaagcagcaatcagaaaattgacacaattccaaccgtttattgataaactgaaaagtaaaaatcagaataataaaaaattattattattaaaatattatgaaatttattttagttattgaaattgagccaaagcgagttgagcttattttggtgaaaaacactgaaatatttaaacaattatcacaaaaaccagttgagattccaaaaaatgaacaaaaattatttacaggtaaaaagacaatttttaattataacaaactaaattgaagaaatgaaacagtatttcggcccatgttcaaacatttgccctaagaaaaatctctattatctttttttaagaaatttctgtttctttttttttggaaaatttctacgccgatgaaggtgttgccaatcccggcaaatttttccagctatacccaacaaaatttatcgggcaattttctcatggcttttctctcaccgatggtcgaaaaaaaccctaattaaaataattgacctaaattaaccaaattctaacatttaagaagaggcttttgagctgaatttggtgcacaattaccaaaaattgttgagtgaagagggccgaccaattgcacaatcacttttaacacaaattggcaccgatgccatttattttcatcataaaatacttttgcatgattacattaccaatgttagtcaaatgaatgccccaaatgcgcaatttaaagaatcatttgccgccattcgcaagaaaattgacgaattggcactgtccgaagcattgaatgacaacggggaaaaacagcgcaaaatctttttaatgggaatgtttatcaaaaaattatccaaagtaaatttaacaagtttggcaatgtcggacgaattaatgcatttaaaaacggtataacattcattcaaaattatgcaaaattgttgggaactattgtctaataaa

SEQ ID NO: 62289 - DNA, 340 bp, Heterodera glycines
  Genomic contig location: Contig_ID=SeqID_31975; Location=661..1000; Strand=+
  SCN-specific regions: Sequence locations=1-59,81-213,238-283,305-340
atgtccgatacccttcattttttgttcgtacggtaatacggagaattggtgtcccggcgaaaaataaattaaaaatttttcttttctaaaagtcgttaaaaacatatttatagaggttttcagggtcgctgatcacgaatctgccattaattttgacgaatttcgaatcccggaccaagactcgaacaaaaatccaaattcaaaattcaacttaaaaatcaattttgaattgaattggccaaaactaaggcatattcgtgatcagcgactccgaaaactccagaatgcatgctctcatgtttttctacatgaaatttgttttaaaaaatcaactacttga

SEQ ID NO: 62290 - DNA, 884 bp, Heterodera glycines
  Genomic contig location: Contig_ID=SeqID_31977; Location=419..1302; Strand=-
  SCN-specific regions: Sequence locations=1-14,36-165,188-486,509 -521,550-668,691-711,739-754,780-884
atgccgcaaattaattttgtgattattttattcatatttttattcgtgctaattgatggaattgatgaagatttatttgatgatttatggaaaaaccaaaagccatcgacctcaaaaaacttcaaaaaacaaaaattcggagaaataaatgcaataaaggaagaaataattgttaaagatgaaatttataaccaacaaaaggcaaataaaattgaaattgaagacacaaagccaaaagaattgcaaaagattaaaaaggaaaaaacattggaggaacaaaataataatttaaatagaaaactgaaattgccaagaaaagaaatggaattattggaagaagaatcatatgaaaatgagtttaatgaggaagctgatcagaatgtctcgtctactgatcagagcaactctggaaatgatgaggattacaataatttggtaatataatagacaaagcaatatcattccttgaaaaaattcgctgaattctaaaaattttttctcttaaaaaggatttctttagaatacagaagaaataaatgaaatgcaaattgtgaacgagtttaatttgaggaataatgaattgagaaaagaaaatgtttataataaaaggacaaatactcaatttgaatgtgaaattgccaaaaagtttgacacaaatccggacacaatttataaattgaagaaggaattgggacaaaaaagagtgaaaacggaggaaagtgaagaaacaaaaatggaattgatcagaaaatttgataaaatgagaaaagaaaaaatttgtgggtttaaatatgacgagaagaaaagatcagtaattgaacgtgaaattgctaatgaattgggaattaagcggaataaaatttacaatttgaagaaggaatttg

SEQ ID NO: 62291 - DNA, 638 bp, Heterodera glycines
  Genomic contig location: Contig_ID=SeqID_31978; Location=368..1005; Strand=-
  SCN-specific regions: Sequence locations=1-110,133-396,423-638
atgcacgccatacgcgtgagaacaagcgggagcagagacgaaccaaaatggcaaaggcgacaaaagcccgatgggccaaccaaagtgagtttttcaccaatttttaacacaaaaattccatttttcaaatttcagactagagatcggatacggaccagatccgtatacgtacttttacggatccgtagtccgtaatacgtatttttttcggccgatacgtatttttacgtagtaaggattttccgtatttttagtatgtaagtacgtaatccgtatcgatatcaagtacgtaatactgatacttatccgtataaattacgatacgtattacggactatttttttggcgtttttaaggtgaaatggagtaattttttaaattttgtgcagtcaattcgccaaaattttgaaatttgagggtctattccgtaaaattttcgatgaaaatcgaaaaagcactggaaatatgggaaaattactaaattggaaaaaagcaaaattttatgccaaaaactcaaaacctttacgttattaaattcatttcgtttaaattttacgaaattctttttcatttttttccattttgtaaatttttcaaaattatacatagatattttttatgaaatttgttcaaataaa

SEQ ID NO: 62292 - DNA, 140 bp, Heterodera glycines
  Genomic contig location: Contig_ID=SeqID_31979; Location=1013..1152; Strand=-
  SCN-specific regions: Sequence locations=1-140
atggcactggccgtgaacttcgccccgtgtcgaacgccttcgtccgctttgtcgccgctttcttcggttgttacagctattttccctacaacactgatcccgaccctgaaccaatcgctgtcgttgaaaaggaatgagtg

SEQ ID NO: 62293 - DNA, 143 bp, Heterodera glycines
  Genomic contig location: Contig_ID=SeqID_31980; Location=1391..1533; Strand=+
  SCN-specific regions: Sequence locations=1-143
atgggcttcatccgcaaattgattctcaccaatatgccccatgcttatgtgctttcgctgcagttgggctcctcagttgccgaggacattggccgcggctatttcgccaatatgaacgacgaagtggcggccgtgtgccaaca

SEQ ID NO: 62294 - DNA, 51 bp, Heterodera glycines
  Genomic contig location: Contig_ID=SeqID_31981; Location=794..844; Strand=-
  SCN-specific regions: Sequence locations=1-51
atgtttgatagggccagacaagagaaggcaactgtttgtaccaagtttgcg

SEQ ID NO: 62295 - DNA, 187 bp, Heterodera glycines
  Genomic contig location: Contig_ID=SeqID_6637; Location=540..726; Strand=+
  SCN-specific regions: Sequence locations=1-187
cagcccgttaaaaatttattatcatggaattgcagagaaactattggcttgcactcggtcgtgtatggttaattatgtaatttcaatcactttgaaatctgtcaaaagaggtgtcatagggggctacccgacttttggggatttgcaactttgggacccgactgttgatgatcttgacattaggtga

SEQ ID NO: 62296 - DNA, 107 bp, Heterodera glycines
  Genomic contig location: Contig_ID=SeqID_6639; Location=350..456; Strand=-
  SCN-specific regions: Sequence locations=1-107
ctcgaaaagtagcttaacaacagcccaaaaaaacatgtttttcgtgcgttttaggccacggggagctcaggaaaaaaatagccttttgcctaaaaattggagcccta

SEQ ID NO: 62297 - DNA, 779 bp, Heterodera glycines
  Genomic contig location: Contig_ID=SeqID_6640; Location=318..1096; Strand=+
  SCN-specific regions: Sequence locations=1-125,147-483,521-779
atgctcatcaactttgggggttatattcgaattcttgtacgatttcatcagttgtcttctcagcagaagaagttgaaattcaataaagtgaggattggatgagttttcggcgtgtgccaacttaaataatttttacaaattttgtttgtccgacccagtttttgcgaggtcatattttttcatgacagcctatttctttttttaccaaatatcgcccctcagttgtttcacagttttgtcattgaatcggggatgtcccaattccgcgcactcttcggcaacttcgcgtcaacaatactcaacattgagaaaatcggaccccattacagtgtgaaaaaagatttcgtgtcttttctcgacagccttaactcaaacggcttagacaacaaacacatctcattttaaacaactctttacgaaatcatttatcactctttagccgcacatttttctaagttatcccaaaatttgccaatttttgacaaacatgtgtttattatttatttccataaaaattcagaacaagcgacaagcctctgcaaatttgttaattctaattggacgacaattcgacgaacttgaacgacaaacgatttatttttttgtcgtgacaacaaattaggtaagagacaaccgaaaaaattgtcgttcgtaattctgaaaggcaccatcagcagtccctttctgccagttcttttccaggtaaacttaagaagccataacttttttctcaagtgatcaacacttttttttgagaattgttaagcaagtctaatcga

SEQ ID NO: 62298 - DNA, 884 bp, Heterodera glycines
  Genomic contig location: Contig_ID=SeqID_31983; Location=180..1063; Strand=+
  SCN-specific regions: Sequence locations=1-30,52-481,504-569,599 -719,741-884
atgcggcagaagaagctgaaggtgtggattttcccggagggcacgcgcaaccgcaatggccacgggctgctcccgttcaagaagggcgccttcaacgtagcggtccgtgcccatttccccattgtgccggtggtcatctccgactacagcccgttctattcccatcggggcaaatatttccacaccggcggccgtgtcattgtccaagtgatggagccgatcagcactgaaaatgtaaaaaaaaacaatttttttggctgagcaaaattttaattgtgagattttttcattggaaaacccttcaattaactatttttgatttgaattatgaataaattcatgttcagtttgaccatgatgatgtgccaaagctgtgcgacgaagtgtctgaaaaaatggtcaaagtgtacgaggcgatcagtgcggaggtccgaacggcgtcaaaagaagcggcgcattgatcgaagcgggagagcgagaaagactgggtggaaaaaggagagaatacagacaacgaaagagtattgggaaagaatggcacggcacagacaaatcgcatttctgatcggggagaaggaagagaaggaggaggaggagggacaaagcgaaaatgagagagacaaaaaatgctcaacaaaatcacttaaatgctctccattgctttcttttttaattctctcataaattgtccagactttaatcgtcttcgttttcttttttaccattctcatattaatgccatacaaagaaagcacgagttttttgaaaatgtgctttttttgcattttccctccgcccctccattttaaaatggtttttttaaatttatttgtcgtaatggctttaccgaaaagcttcttgatattatggatatggctataaaa

SEQ ID NO: 62299 - DNA, 555 bp, Heterodera glycines
  Genomic contig location: Contig_ID=SeqID_31984; Location=326..880; Strand=-
  SCN-specific regions: Sequence locations=1-555
gttgaagcatacatggatgcgatcaggtagcaagattatgtaagaatttagtggtcactcaattttctgtaacgcacaggcttgagctgcaatgttggggaatcggctgtagcatattggagccaggtccttcttgccatttttcgggtttggctaatatcaattcgcttttcttcaggcatgttccgcaccaaattggtaatttctccttattaatgatgaacattaatgccataaatcgcacacttggctatattccaaaattaaaataaggaatattcaaaaaataggatttattgaaattgtcgttcttaatttacaggttacgcgacctacaaaatgacaaattggcatttctaatttgtttctttaaaaaaatcagataaatgccgatgcaatgacggcacgggtggacagagcatggcaaaaaatgaaacccgaaataaaagaggaatatggcgaaaattttaagaacaaatgtatgaatatttgacataatgctttcaaattttaggtcaaatttcagttgttgcttcatggaacaaacttttccag

SEQ ID NO: 62300 - DNA, 964 bp, Heterodera glycines
  Genomic contig location: Contig_ID=SeqID_31986; Location=146..1109; Strand=+
  SCN-specific regions: Sequence locations=1-159,196-207,229-237,276 -340,418-589,618-751,801-930
acgtttctccaagtgatcgtcataagtttgtttaattcaattgcctgcgtaatttacgtctcaatgcaacttgtaagaatcagtaaaacctacatcatcgttggcacttatgcatggcttttttcgcatggtaagtcaaaaatttaagccatgaatttgacaactttgtaaataaattttgtaggatttttaattgaaattttgctatctttaaattaaatcattagtttcatactgtataaacaaagatatcaaattattttaatttctaatatgtgggttatgtttggaattgaaaaaatttgaggaatctagtaattttttggtgcttgaaaatgcgtaaattaattaaataatgaatttcatatttattaaatggtatattctctatatttaaaaaatacaaaaataatttttcaaaaggttgtcctcccctggtgtatttgctgctgaacaaacgaattcgaaatgattgtgccaactttggccgtgccattttccgttttttgcacaattgcaacaacaattcggtgtcaaatggaccaattgccatggcatggacggcaccaaattatgccgtgaacaatgtcaacaggaataataataataatatgccacaacgatgaagaccagccgaaagtttttgtgggaccaattcctcagggataaattccctaaaatccagaacattgccgtttttgatactatccattgctgatttattcaagcgggtttttgggaggaggtatgcaatatattttattgtaaaattttttaattttaaatagtatttttaaattcagctttgtgctatgccgaaacaagtgccgaaatgttgttggcaattaaccgatgcatggaattgttgagaccacagttggcacatgccattttcagtggtaaagttttatcttatacagcatttcattgataataattatatttaaatacaattatttattta

SEQ ID NO: 62301 - DNA, 56 bp, Heterodera glycines; identical to SEQ ID NO: 52733
  Genomic contig location: Contig_ID=SeqID_31987; Location=551..606; Strand=+
  SCN-specific regions: Sequence locations=1-56

SEQ ID NO: 62302 - DNA, 355 bp, Heterodera glycines
  Genomic contig location: Contig_ID=SeqID_31988; Location=1003..1357; Strand=-
  SCN-specific regions: Sequence locations=1-355
gatgaagttgtcaattctcacaacatttctgcttctgctgctgacaattgccttcgcttcgttcacagcgaccgatgggacagaaaacattgggcggagaaagttggtgatcagtgaaaaagcaaagcaaacgaaggatttgaattcgaaacggaccaatcagtgctttgtgatcagtgaaagactcaaaaaatcaaaaaagactgatcagagtgaaattaatagttgaatttaatattttgattttccagtcggcttttggctcgttccaagcgagactgtaaccgagcgaattgccatcccggcttttgcctgttgggccgttgtacggctggctgaacaatcgactgaataa

SEQ ID NO: 62303 - DNA, 1229 bp, Heterodera glycines
  Genomic contig location: Contig_ID=SeqID_31989; Location=278..1506; Strand=+
  SCN-specific regions: Sequence locations=1-93,145-215,271-402,424 -435,457-497,519-548,571-910,970-1229
atgccaattgtttgtcgcagaaaatatctatccgagggaattggggtaagtaaaattaattacctaattaaccttgtcgatttaatggttcccaaaatttatataaaataagttaaattaaacaaataaaaaaatgttttaatactctaaagatagttaataatggagaaaattaccctaaaaaatcatattttattatacaaatgacaattgccaaatttttgaatattttataaattagtaatttctataaattttatgaatatttaagtttagagatatttaagattattttacaatgataatttaatacctaatgagaatatcaaaggattttcaaactccaagagaagtaataattgcatgccaactaatttaccaagagcaattttcgtcttaattaattgttcacactttccattcaaacggcatttatttcccacaattcgcaaaacactcactaattttgtctcacttttgaccatttgatctccataaaattccataaaattccttaattattttttttgcttggcactttctttttgaatttattttaaaaatataattcgtataaaacaaaaaaaaatgtatttaccaaaattgcacaatattctgactcatctgctgctgattctttgaaaattggtgacaatggccattttcacaagtcaatggtttcattaacgttccaattatgtaaaaatgggcaaattcgcaatcttttttaatttctattaggaaatttttcattttttgttcttcaaaagttgtcattttatcagggttttttatttgtttagtaatttcactgcattcaatcttatcattgtccattttagtgaagagttgctcatatattttattgtgtcgttcgattggatacttttgattctctataaaaaattgctttaaaactaatttttattattaataaaagtttaaaaatcatttttattgttaaaattagagcccggaaatttcaaatttggattgcggactgggatcctgcaaaatcctgcgcaagatccggtcctgttccgggctctagttaaaatatcatgtttaactgtatgtggtgattaaatcgcgccaacatttccaaatttggcaatgtgtctcttcatcaattgtttctaattgttttgtcattgcacgaaatttgcctattttttgccgatagatttttgtttgcgattcatttaattcttttaatttaacggcatcaa

SEQ ID NO: 62304 - DNA, 670 bp, Heterodera glycines
  Genomic contig location: Contig_ID=SeqID_31989; Location=1..670; Strand=-
  SCN-specific regions: Sequence locations=1-123,179-249,301-468,490 -490,513-526,550-670
gaaaattgctcttggtaaattagttggcatgcaattattacttctcttggagtttgaaaatcctttgatattctcattaggtattaaattatcattgtaaaataatcttaaatatctctaaacttaaatattcataaaatttatagaaattactaatttataaaatattcaaaaatttggcaattgtcatttgtataataaaatatgattttttagggtaattttctccattattaactatctttagagtattaaaacatttttttatttgtttaatttaacttattttatataaattttgggaaccattaaatcgacaaggttaattaggtaattaattttacttaccccaattccctcggatagatattttctgcgacaaacaattggcattggattacgccatattgttttgcacaaatccaaccgtttcgtccgatgctgagaatcggctgtcaattcgtttgtattttgccaaaattatggcaatttttacgaaaattttcaattttattacaacgagtacagaaaaagaaaacaagcaaaaatatttgcttgtatttgttgaaatttggaacaaatttgtccgcgtattcatacagaactccaacagaatgacatttcatcgactggtggcatactgtacaacatttgggcgggaattgcatcc

SEQ ID NO: 62305 - DNA, 904 bp, Heterodera glycines
  Genomic contig location: Contig_ID=SeqID_6641; Location=462..1365; Strand=+
  SCN-specific regions: Sequence locations=1-84,106-193,216-340,362 -443,465-767,789-881
atgacaagcctatagtaatttacaattttttcatcgtttgccttttataaatcgattaaaagtgcaaaattggttcattttacgacaaaatctgttaacaaattgcaccaattttagatttttctcccggcgaggctccaaaagtttattcgtttcataaaaaatggttcaaattcgcaaatttggccttgtttggataaaatttgtgcacaaattgaactcaaattttaaaaatttttgcagcggcgtctatcggcgcccctggaccccttttcccaaattttttttttggaaaatcataccgcaaaaagacggtatagaaatcaaaaaaattggccgacagagaaattaaaatcaaaattcaacggcatcttcattggaggcaattttctttttaataattttgggaaattttcattcacaaacttttttcttttttgcagtttaaattttaaaatatttaaggtagcacttccggacttaccagtagaagttaccaacacattgttaagcagcgttaaaaaaaagttgatgaacataaaaagtcataaatatacattttaccctgctggccaatatgaaattattgtggcacttggaccatatggtaagtttttggggaaaggcgtttaggaaaaaaatccatgcattttgccaacaagtaaatgtacaaaatattaaaataggtgctagcagctgcaaactgaaaagtttgaatgaagtttcaaaaaactcacaaaaatctatttttgggcaggaaccttttctaaaaaccttacaataacagattgattgattaaggacctacttttatgattatttttcagacttctgggccagtattcagcttgagaacaactatgttctaaagaaattgaaatattttaaaacagtggatttttaa

SEQ ID NO: 62306 - DNA, 1167 bp, Heterodera glycines
  Genomic contig location: Contig_ID=SeqID_6642; Location=365..1531; Strand=+
  SCN-specific regions: Sequence locations=1-105,229-260,282-412,448 -629,653-1167
atgagtgaattcttgaattatgccgatatgacaaagactatggaagacaccaagggccaattgtgcaattctaagagcattaattttaacaaactagcggtatgcttttaaatttaatatgtttgttaatatttgcattaaaagtaataattatttgaaaaaaaactaaattttataaactcattaattaaaaaaagtttctttaatgattattttacaattaattatcaaatgttatcaggttgcaccttatgacactttttcaccagaaaaaatgaacaaaaaattcggagaagtcgaacagaaacttaataatgtgcatgagcaattaattctcaagcaagcggatattgaggaattaataaaccgagaaaaaagtccattgaagttagaaggacaggtaataacaaacaaacattttgtaaaataaaaataaaagtaattaaagaatgaacagcaatcaattgagcagtcggccgtagaaactcagattcgcaatgagcaaactgcagaaccaaagtcatttggccttccggtgcttgttgatgtaaaagatttaaccccgacccatctaattgaacctcccatcgaccaaatcgcggcatctcctaatcacaaagagccgaaattaaagccaagatatcataaagtcataggagacggcgattgcttctacaggtcgttgagcttttattttatttttttgaaagaataaaattttacagagcaatatgctattcgatttttcaagttgatgaaatcgaaaactctgatgctttacgagtggcagcaagcagagcgattgaaaaaattgtgaataacaaagagatattcccgagaaaactgtatgaaactcatgcggaattcatcaaggagttagaattggcacttttggagaggccgtcaactaaggactacaaccaaagtcttagtgcctatgccaaacacatcgcaaaaccggcacgaaatggaaaaggccaatgggcccagcttgaagatgcgcgggttgcttctatccttttaaagcgcaccgttgtaattcttcatccaaatgaggaaaaggagttgcttgaagaacaaaggccaaaatatgacgatccatcgataaagaaacgcattaatgtttatttcccagacggggacacaatggttacgatttatttttaa

SEQ ID NO: 62307 - DNA, 135 bp, Heterodera glycines
  Genomic contig location: Contig_ID=SeqID_31994; Location=501..635; Strand=-
  SCN-specific regions: Sequence locations=1-135
taagaaaaaaaatgctttctaaacaatttattttacaattaacgaaatgcgactgtatgcggctgtcattttttcccgccgttcgtcaggttcatcagatgcacacgcaatctgccgttgaaaaagcaaaaggag

SEQ ID NO: 62308 - DNA, 1063 bp, Heterodera glycines
  Genomic contig location: Contig_ID=SeqID_31995; Location=146..1208; Strand=+
  SCN-specific regions: Sequence locations=1-256,280-657,679-778,800 -1063
accggagattggtgaccacaacgcagatctcagacagcggtgcctcaaatcactcgaagagaacgcaaccttcgaacaacttttggccgagtgtaagcagatcattggccttcgccacagcactgcagctttggctcgtggaaaggagttcaatgctgtgcagctgcgcccgcaaattttgaaggacaaaccgagggtcagcaaatcaccaataagaacacgaacattttcgaccaacacgcggcacaacagcacttcatcaccatcacaaccaccatcggcttgtacgagatgcggcggtaatcactggaactcggactgccgtttccaaagggaagtgatttgcaataaatgcggcagaaaagggcatattgcgaaaatttgccataatcagaacaacactccccaacattcaggctttaaatattcccgcacaggctcaaataagcaaaatgccaacatcatcgactgcctgcacatcatgccatccgactggaagacggaaaatgaaccgtacattgagcggcatgttcggctcaatggaaaagtgcacaaaatggtagtcgactccggctcaaaattgagaatcgtgagaaagctcatttgggtcaaattgggccaaccgtttctcacagaaacaaagctcaagggtcgttcattcacagggaacattttcacatttatggggaagttcaaggtccaagcagcattggacgatggaatgcccctcgatttggaatgttttgtcatcgattcgacggacacacttgacttgatgggacttccatggataagagcatttgaacgcgcctacaaccaagtggtggcgacaactttgtcaatcgaaaatgtgccgacagtcgttggtgcaaccgatcaaacagcacgtcgacgcaattggagatggatttacagaacacatttccaaacatttttgaggaaacattgggactttgcaccaaaatcagggcccatctcaaaattaaagaaaattcatctcccgttttttgtgcagcacgaccaattcccatcggcgttaagcaagaagtggacaaggaattag

SEQ ID NO: 62309 - DNA, 63 bp, Heterodera glycines
  Genomic contig location: Contig_ID=SeqID_31996; Location=211..273; Strand=-
  SCN-specific regions: Sequence locations=1-63
atgcgaatggaattattcaatcaaaatatgtcttcctcagcagctaaaagatcgttcccaatg

SEQ ID NO: 62310 - DNA, 192 bp, Heterodera glycines
  Genomic contig location: Contig_ID=SeqID_32000; Location=32..223; Strand=-
  SCN-specific regions: Sequence locations=1-192
atgttttgcgtggcgatgaattcagataattatgatgaagcactttcgatgcttcccgatcgaaaaagcgaagctaaagtgatcgaagcgtatgcacgacgacgaagtaaaaagcgtaatcgtcggaggatggttgaggaatggaagcgtccgatgctatttggttggaatcgaaaaagtgaggagaaagtg

SEQ ID NO: 62311 - DNA, 820 bp, Heterodera glycines
  Genomic contig location: Contig_ID=SeqID_32001; Location=31..850; Strand=+
  SCN-specific regions: Sequence locations=1-141,165-196,253-253,343 -348,412-425,455-491,519-735,768-776
tgtaccgccttcagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacg

SEQ ID NO: 62312 - DNA, 858 bp, Heterodera glycines
  Genomic contig location: Contig_ID=SeqID_6644; Location=72..929; Strand=-
  SCN-specific regions: Sequence locations=1-135,157-160,187-747,817-858
atgattctcctcacagctgtatatcttctgtctcttaatgaggttcgtaataaataataataggacagctgattctgttatttgtcgcaagctcttattttgactgggacacatttttatggtagaattttatggagccatatctcatatctttttgagttttaactcctaataaagctataaactgatttgggcttaaaattttttccacagacatgtaaaaaagggttcctggacggaggggatttatgaccggttttattattattttggtggttttcagaccatcttgtttaaaagtataataaccattaaaaacttatactctccgagtgtaaccataattacctatcaggcgatcattaaattttttattaacgaatattttgtggctaattatgccaagactccgagaggcgccaatcacaatcacgaacgacaatgacatagacaaacaaatgacaaatttgtcctaaaatattcgacattttcctttatcacaaactcaattaaaaaatgggtcgtatcatctaacaagagaacaaacatcgcgaactgtgagtgtccaaatcaatttttagccacttctatcatgtagagcatagtcgatttagtgattggccgacatttgcggcgcagacacttgcggcgcccagtcaaagcgacacttgcggcgcagacacatgcggcgcccagccaaaaggacatttgcggcgcagaattaaatgaccccaaaaatatttcaacaatttatttaagttaacaattgttattttaatagtttattatttaacaattactaatttaataataattcttgcaacctatttatattctatatgtcttatttctaataaa

SEQ ID NO: 62313 - DNA, 77 bp, Heterodera glycines
  Genomic contig location: Contig_ID=SeqID_6644; Location=2000..2076; Strand=-
  SCN-specific regions: Sequence locations=1-77
tccgaatgggaggcgctgcagctgtacacgcacacgttcaacccgagatagaaaaacggaaagaaaaccgtcgataa

SEQ ID NO: 62314 - DNA, 1205 bp, Heterodera glycines
  Genomic contig location: Contig_ID=SeqID_6645; Location=1754..2958; Strand=-
  SCN-specific regions: Sequence locations=1-16,38-104,137-661,720 -1002,1024-1205
ggaccaaggctgacctggtcgaagaagatggtgttgacgtcaaccatggcaaaaatgacgaagacggcgaagaggacaacggtggtggtggttcaacaccaccagcagcggcgggtggtggtggtggtgcggttactggccgatgccgacggcgggtggacgagttggaggcggaacagttgtgccgggcgcatgccatgcttgcccagctggaggtgtcctccaagaccaacgtcaacattgacacaagtaagcgaaagggtaaagcaaagcgacaaatttaaagggccgggagagggagtaaaattgcattaaaatttgcggattttccagaaaattcccacccccccccctctcaaaatttccaaaaatggtcatttaaaagcaagcgattttggagtgccggggctaacaaataaggtcggactggcataggcaccgaaaaatgtggtcggtcaagctttttctatggcattcattttgtcgcccgagtttcggttgcaatttttcttggcggagagattgggcaattaattggccaaatggcatttcggcactcatttgtcagtggtttatttttttttctgtttttagaaaaaacagtaattcaccataaattttgataatatcgctgtacaattttttccttgaaaattcgtacaaaaaatttttctaatttttttttgaaaaacttttaatttgaaaaattataaaaattacagttttccacgagttggcccaccacctgaagcgtcactacgatgagctgggccacttggacgcgtcgggcacgggcggcgggcccaagtcgacggcggacgccgccttccgtctcggctacccaaacgccaccaatttgtccgcccggtggcgccgctgttgcaactattacgcatgatcatgccgaaacgatgtgccgcgaaacgatgataatgatgaaatggtgccacattcttacgaaaaaatgttttccgtgtcatttccgagtgtccatccgttcgatttcccgaaaatttcccaaaattttttttgtaattttgccattttcccgcccgtcaaatcacaagcgaattgtgtgcccggctctacccctaaattactcaattaggtgtgattgctttcccaatttaccaatattcgcatcgattggcccgtcggtccctacttaaaattggattttgccgaaattgccgtctaaaattaaa

SEQ ID NO: 62315 - DNA, 1147 bp, Heterodera glycines
  Genomic contig location: Contig_ID=SeqID_6645; Location=326..1472; Strand=-
  SCN-specific regions: Sequence locations=1-6,28-100,122-598,620 -725,747-824,854-1101,1125-1147
  Gene Ontology: Cellular component=membrane
atgaccgacctgttgctggacccggccatccgcacatgggtgttcgtgcccattgtggtcagtcagtttgttttgttttgtcgtcgacgggccaccactttggggccttccttttggagccgtttgcacttttcagcgcccgtgccccgaaatgccggccgttttatgccgttttttttttatcaaatccgggttctctaagcacgctccgtgtcagggggctcgaaaatgacattaaaaaattttctaccagtctcatttcccacaaatcgtgcccaaattagtttctgatcactccgcgatcagaattttgcactgtttttccatcccaaaattctcccccccccccccctccttttagttaatcacttttttggttggcattgtccggcactacgtgttcctgttgctggtcaccaagaagagtgctgacctgcagtcagtgcgggacaggtgcgtttttttgtccataagaaaaaatttttaagcatttttttttttttgaaaaattgccagaaaaaattttcaaaaattcttttcctgaattttcttgtttaaaaaatgttttacaaatgaatattttttgagaaattattacgcttttcatttctaccagccctttccgttcgttaagccattggctgctgaaggcgcgtctgttgcgtgagaatgggcgctttttgcccgccgattcgtttgcccagcggcgctggctgctgtgtgacgagcagcatggccagctggtcaagcggcaggacaaacagaacacgcagccgaacccggtacagttggtttagcccgggggcgggggcaaaacagaaaagaatttttagaatttttaaaaaatttttttctccgatccaaaggggtgccattcctctaaaagtcagaaaaatcgggcacttgccgagtttgaaaatcgggcactaaaggaaggggaggtgccgccgacagaggcgccgcgccattgaattactaccatttttgtgcagtttttttcaatttatcccttcattttcctaaaagatgctggacccgtccacgatgacggagatggtcaagggcaacatgctgaacatggtgcccatgctggtcatcggcggttggatcaactggaccttttccggcttcgtcaccacgcgggttc

SEQ ID NO: 62316 - DNA, 867 bp, Heterodera glycines
  Genomic contig location: Contig_ID=SeqID_6646; Location=10..876; Strand=-
  SCN-specific regions: Sequence locations=1-167,197-265,288-371,405 -536,559-640,663-674,696-798,829-867
  Gene Ontology: Mol. function=GTPase activity; Cellular component =Golgi apparatus; Biological process=signal transduction
cgtcgttctgctgctgaagtgccaccgccaaaattgggccgtcaaaagtgtacgacgacgaaacccatccgatggaccctgacgactcgttcgactacctgttcaaggtgagtaaacttcattttccttcgttgtttccacccccccccccctagcagcccctctcgaatttaaaaaaaattgaaaaaatttttttgtcaggtggtcctaatcggcgacatgggcgtcggcaaaacatggtaaaaaagcgtaaatgtccatcacctttaaaattaattaacataattgtctgtatgggaaggcactgagaaaagcaatggcatggcaacccctaaacaatgacacgaaaatttaccgggacaaatccaaaagtttgaaaattaaaaatttaatttccctttcccattttcagcgtggtccaacgcttcaaaaacggcacgtacattgagaagcagggcaccacaattggcgtcgatttcaccatgaaaacgctgatggtggagggcaaacggatcaaattgcaaatttggtgggccaattttcggggtttttcggggaccgggggaattgcaatcaaaaaatgtttaccaattaaattttaaggctgtttagagggcatagtcagaggaaatcaaaccgaaaatttttaaagaatttttatggttcggtttttgataaaaaaaatttttttttttgaaactgagggcagagggggccaagccctcatttttaaatccgtttttcccatcactctccgaccgcatggccactaaaatgtcgtctttcagggacaccgggggtcaggagcggttccgcaccatcacccagtcctactaccggtccgccaacggcatcatcctgagctat

SEQ ID NO: 62317 - DNA, 349 bp, Heterodera glycines
  Genomic contig location: Contig_ID=SeqID_6646; Location=2071..2419; Strand=-
  SCN-specific regions: Sequence locations=1-308,330-349
gcgtcaatctcagcggcgccccgggcgacggactcggccaacgctggcgtacgcccgcggaagcggtggcgcgtgacgcgtgcgacattgtggtggtcggccggggcatcaccggcgcggcggacgtcggcgcggaggcgaaacgctacgcgcgcgtcgcgtgggacgcgttgcgcgcggcccgcgcgtggaccgactgatcaatcaataatttacctaaaatgccattgatcaaaccgatcattttggaaaatttgtcactcatcgatggtttctgttgtttttttgttctgtttcttacatatgcctttttatttaatttaatttatgttcgtttttgttttgtttg

SEQ ID NO: 62318 - DNA, 448 bp, Heterodera glycines
  Genomic contig location: Contig_ID=SeqID_32003; Location=165..612; Strand=-
  SCN-specific regions: Sequence locations=1-57,79-80,103-256,279 -304,344-347,381-448
atgaaagtacccatttcggtcagttccggacacgaattctgacaaaaagcccaaaattttagaattcttaactttttgcttctataacctttttacataaaaaacattgtaccattagaaaatgttacactttcaaatacaaaaatcaaatgaagcttcgaccttttgttcaaattcttgtccgaagttcgaaatttggcgaaaaccacgcgggaaacctgtttcactggcccgtttcataccccaaacatttcactaaaaaaaaaaaaaaaatttttcaggcttctgctgcacccgctgctgcggagaagaaggaggaaaagaagaaggaagaagtgaaggaagaatcggacgacgacatgggcttcggactgttcgactgatcaccgaccgattgatcgatcggacggaatattgtttttgcttcttaccatttcatcaaattaaa

SEQ ID NO: 62319 - DNA, 825 bp, Heterodera glycines
  Genomic contig location: Contig_ID=SeqID_32006; Location=154..978; Strand=-
  SCN-specific regions: Sequence locations=1-92,128-453,525-745,767-825
atgttgattaattccgtttttatgattcctttttttattagtatttttcaacaatttttaattacattttcaattgcaaattcatcggtgagttaattataattttactaatttatttcattaattaggttgaggacaatatgctaattgcatttttgaaaggacagaaagaaattcaattcagtgagtattcaagacaaaaatatgaagcacaccttggcatcatgcattttatgagaatgaattggcaatgtgacaaaattgcggaggaatttgaagaatatgaacggacagaatgccaaaaatatcgcaaatatttggacattttgcacgaatatttgtacagagaatatctcggaatccccacagtgaagccaaaatttgtgtttaaagaacgaattgaaattaatggaccactgatttatgcggtgaattgtctggccaaaatttcgcaattttattttaaattatattggagtaattattgtgaatataaattaaacaaattattcaataattattttgaactaaaattgttgaatgagaagagattaaattataaacaaaaattgccaattaatgaaatgattttgcaattggcaattgaaaaagcgaataattataaaacaaatgaaagtttagacggaataataaaacaaaaatttgatgaaaatttagagaaaatgttcaaaaaagcggaagaaagggcaaaaaaaaacccattggaaatcaatttaataaataatgacaaacatttaataattaagcattcggaattcgataataaatggacatgggtgagacttaataatcaatgaaaataaa

SEQ ID NO: 62320 - DNA, 623 bp, Heterodera glycines
  Genomic contig location: Contig_ID=SeqID_32007; Location=230..852; Strand=-
  SCN-specific regions: Sequence locations=1-623
atggcagcggtaaaaaaggtcggaaaaggacccggaccatttttgccagagatgtgctgggcaacttggtgggaacggttcgaattcttcatccagctgaaaggcgtgactgatgtcgcaacaaagcgtcttctgctgttcaacgaaatgggtcaggtgtacgaagagcttcgacgaatggcacagcccgatgatgtccgaaccatggaccttgctgaaattgagcaattgatggtggaaagatttggcgaagcaaaatcgatcgccgcgtgcaggcatgaattattttcagccaagcagcaaacaggccaatcgataagggactactcagtccaattgagaagtttgatcgcgaaggctgaatggagccgcgacagcattgacatgtgtctttgcgcattgtttatcaatggcatctccaatgatgcaattcgggttgaattgatcaaaaaaggtgacaaggacctaaaattcaaggatgccgtcgaatcagccgttttgttggagcagtccaatttggatgcccaagcaattggctcaaatgcaataccggaggtcgcaaaagttggcactcagcaaagaggaccaagaacgccgacgaaaagcacgagaggttgctttcg

SEQ ID NO: 62321 - DNA, 740 bp, Heterodera glycines
  Genomic contig location: Contig_ID=SeqID_32008; Location=50..789; Strand=-
  SCN-specific regions: Sequence locations=1-11,33-280,302-363,395 -630,679-740
atgctaattggcctgcttctgctcaatgtgttcgccattctgttctggaattttgtgtggaaacgccgaaaattgccgcccgggccaagcccactcccattaatgggcaatttgcaccaattagccaatttcccggaccatggcggtgccggtgcgtacacccattttgccaaggaatatggcccagtgtacacgctgtggctgggcgaagtaattatcatacatcattaattagggtgcctttgcttcaattcatcactaattaaccgctttaatctacaatttccattttaaaccatttaaataaagcaattaaaaggattattagagaataactgattaattactctctaattaactcttaaaccaataattgtaaaacaaatttttgttaggatccttatgtgattgtgaccgactatgagctaattcgttctatttttctactaaatttcaatgagcagacgtcgggacgccacttttttggcatcgcccaattcgtttcgggtcagccattggaatgcataattaatattaaaacaaatctgtgtgggattagtaattataaaataatgtcaaaatatgaaaaataaattagaaatcaattctttctttctttaattgtggcggattaaaagaaaaaaaatttgaaaaaaattaaataattttttaattaaaggaactcatggcctttacggtattacaaaaacgcatggtgaagtttggctgtacctgagaag

SEQ ID NO: 62322 - DNA, 875 bp, Heterodera glycines
  Genomic contig location: Contig_ID=SeqID_32009; Location=608..1482; Strand=+
  SCN-specific regions: Sequence locations=1-276,300-492,533-875
atgggaaaaagaaaattattacctaaaattcacggcaaaaacggagtgaaagagcgtcaaaagaagcgggaggagaggaaagcgcaaacggccaaggcgacagaagctcgtctggtaaagaaaagtgagtttttccatttctttttcataaaatccataatttttcagtttttagccgctgcccagcccaacaccgatgcagaaatggcacaaccatctgaagaagagccatcgacatcagaggcaccggcgcgggataacaacggacgaccaccatcaactccaacaccgatgacaccgcaggaaatggacgtgccgtcggtggagatgatggaaatcggtgttccgttcccttcaacgcctgccgacggcgaccaacaagccgagcctgtgccgtcaacatccacggcacgctgtgacttgctgtcgacaccatcgacttcaaaaggcgccggtaacttcggtctcgatgatggtgagtgaaatgccatcaaaaatttgatttttaaaattatttaattttaattattttcaagtccatttgacgagctacgacggcgttacgtttggatcgaggaggagctgcaatgacagcgccagtcaaacgccttcctccgaaaacagctcaaggcacagcgcgaccgttcgacgagcctcgagcgttcggcttcagcatgccgccagcgtaaagccctttccgacgtgaccaacaaccaacagatggacatcaggctgagcgcggcaaaggatctgctcatcacattggacgcaggcatctcgttcaaagcccgtgaagcattgaagcggtcgtttaccggccaaggacttgacgtttgggcaccgacaagagcagtgaagcgtctgaagacggagct

SEQ ID NO: 62323 - DNA, 198 bp, Heterodera glycines
  Genomic contig location: Contig_ID=SeqID_32011; Location=3..200; Strand=-
  SCN-specific regions: Sequence locations=1-198
atggctgtgatttcggccgtcaccgtcgccggcaatttggtggtccttctgtcctttgtgctcgaccgtgccattcggcagccgtccaattatttcattgcgtcattggcaggtaaaaattcgcaaaattctttaacaaattgaaaattcgtgcaaatttcagtgtccgatctggtgagtatgatcatccgtctgtaa

SEQ ID NO: 62324 - DNA, 957 bp, Heterodera glycines
  Genomic contig location: Contig_ID=SeqID_6648; Location=1599..2555; Strand=-
  SCN-specific regions: Sequence locations=1-365,387-422,445-624,647 -701,735-737,760-772,799-918,945-957
atgggcaaaatgaaaatattcattttgttgatcaattggatggagaaaatggaaatggtccaactgatcaacaaaaaagagaaacaattcaaaaatttgaagcaattaaagaaaggttgaagcaaaaaggaaaatatgaatggaaaaacaataacaaaattgaatgtaaaattgcaaaattattaggccaaaatcgccaaaaaatatacaaatggaaaaaagaattaaatctaaataaaacgaagaaaaagagtttttatgaggggaaaaagaatgaattcattgaacgatttgatgaatttaaaagtttatatggccaacgcaaacagaaagaatttgcgaaggaattgggcatttccaaagacacatttttaaaatggaaaaaagaattggcgccaaattatcggaaaagtaagtgaaatttttagaaaattaattaaattttgtacttatagtacaaaagaactattccaataaggacaagttgagaaagatgaagcaatattttaaacttaaagaacgaaatccaaaaattagcgacgtaataattgctgggaaattgggaattggaagtgaaactttgcgcagatggaaaaagaaatttgcattaatttcaactctgtaatttatgaaatatgtcgattataataattggattgtagttgctaaaatagaaaaaaatcctaaaatttttcatattgtgaattcatttcacattcatcttttttattatccactaattattttaaaaaatttattcaaattaccgcacgaacattgatcagatggaaaaagaaatttgcttatatttcgaaaatgtgatttttatagcgtacaaaatgggtaaagtaaattgtttatacattcatatgtttttctattataattaactgtgagaaagtctttgggcattttacataaattttaaaaaatttcattaatttgcttagaaataaa

SEQ ID NO: 62325 - DNA, 1445 bp, Heterodera glycines
  misc_feature (497)..(497): n is a, c, g, or t
  misc_feature (508)..(508): n is a, c, g, or t
  misc_feature (510)..(510): n is a, c, g, or t
  misc_feature (573)..(573): n is a, c, g, or t
  misc_feature (580)..(580): n is a, c, g, or t
  Genomic contig location: Contig_ID=SeqID_6649; Location=20..1464; Strand=-
  SCN-specific regions: Sequence locations=1-56,83-83,107-270,293 -303,325-461,493-1158,1183-1200,1222-1445
atggaaacgcttaaaaatttcactcttgacgatttattcaaagtattggctcttcaagacaaagaattcgaagaatggctcaaagaacttaagcttctacacaccacccgtttttgcgactgtggcaatgaaatgagctacaaatggaagcaagatcgacaacaaccactttggatatgctattcgaggaagaatcacgacggcaaacggccaactgctggatatttcaccggcactttttttgaaggagcacatctttcgcctaaacaagtttttctaaaaggccaaatttacatgaatcaattttatattaaggtttttaaattttcgtactactgggcccacaaatttgcaaatgatcaaattatgtttcaaatgatattgggaagtgatacagtgaccgattggaaaaacttcatgagagatgtgacatcagaattttacagcagaaatccaatcaaaatcggttttttgtttgtttgcaaatgttttattanatgataagttnangcgcagcaggtgcgacggtggaaatatttcggatttttgtggcgtaagcaattcgaggaccgnatatttnttataatttgtgtcacaaatcgctgaatgtaccccataaaacataaagcaccttttatttgtcatttaaagcaattctgataataaaaaacaaaaaaaaaaacatttgaaaatttctggccaaaatgggacccaaactgcattagtgtacccacctatcggcccaatgttcccaaaaagttttcaaaaaagcgcgccgtaaaaaaagtgactgggtcgtttcggcgccagccaaagtttttgggttataatttttttttcgaccaaaccaaaacaatcttggtatcattcctaaacctttcacacgttctattacaaaaagtataaattttctagcaaccattaagaaaaaacttaatattttctactttttgtcaattttcatgttataacttttttgctaattatctaatcgctaagcattaacatagaaagagcttccaaacaagataagcttttgaatgatactacaattgttgaacaatcaaaaaagctatagtccaaaaaacattgttctggcgccgaaacgacccctccccactcgagtaaagtgtatgggttttgtgctctctgatattgtttatatttatttatttatttttagcgtttatctcattttcgtcttaatctcttcgatttccttcaaattgcctctcatccgccaattatgtcttctcccccaacaccaaatgccgcgctcattttggaggcacaggccgattttgcgttgaatttgctgcgtgaggtgtccaccgacgaccgttcgtgcgttgtttcgccgttttctgtcgccgtcactttgtccatggtttacgcgggcgccgaggaaaacaccggcgaagaaatgggccaactgctggcaaagg

SEQ ID NO: 62326 - DNA, 304 bp, Heterodera glycines
  Genomic contig location: Contig_ID=SeqID_32012; Location=570..873; Strand=-
  SCN-specific regions: Sequence locations=1-304
atgatgcaaaacggcttcggcgccgagcggagttggacgaacatgaaacaaggcagaaaattcgccaattggagagaaggaccaagcaaatggcggaaacccgacggctcatcaactttgcaaagcttcagcaaaggaaagcggtggcggaaaaatgtagagcgcagcgcatcattgacgaactcgaggttcgtgaacactactaacactactaaatttattcatttaccgaaaaaattccaggggcgacgacacggaagaggctgagaggaccgtggaacaaaaaattgaggaggcgttgtag

SEQ ID NO: 62327 - DNA, 934 bp, Heterodera glycines
  Genomic contig location: Contig_ID=SeqID_32013; Location=168..1101; Strand=-
  SCN-specific regions: Sequence locations=1-524,546-607,630-934
aaagccattcattcttccgtcgatgccatcggcaacaacacttctttcaacacttttctgttgtgtgatttggctaatttgctccaatggtctcggcaccctcagggcaaatgattcaatcaattcgagaagagtgccgggatgccctgacttggaagccttccagacaagctcatcattggaccttctcagttccccccaactgacaaaaataaactgtctctgtggcccggaacaatcaatcgacgaaacattggcacaaaaggagttggcttacaatgaagagattatttccatcacttgcatttatggcacgaaaatcacagatttgagaaaaacgctcgaatttgtagcaaaagccaataaaagcgttggaagggtaaatacaaaaaaaagaacgaaggtgtgaataataatttacagatgattctggaccacgtggacttctctgaagaggaaatgacaaactcagaagagcattttcatctgagccacgaaattgcccatttgacgcatttggaagtgaaaaagtgtaaagggattccgaatttggaattcgaaacaaattcgaccgccaaattcgactcacttgttgagttagtgatcgaagaatgcaacttggaaaaagtgccaacgaaactgctgaggaaagggcccaaactgaagaagatttcgttggcaaacaacaaaatatcgacactgagaaaggccgactttgacggagttgaaatggtgaggtgaactaacaaaagacaagcttatagtgaatggcatttagttggagacactgaacattgcgggaaattcgctttcatcttccatcgagaaaggaagcttaagtcagctcaacaaccttaaaaatttggtgattggagaccataattatggaagcttatcattgttaactgaaatcggacaattgaaaaacttggag

SEQ ID NO: 62328 - DNA, 273 bp, Heterodera glycines
  Genomic contig location: Contig_ID=SeqID_32014; Location=397..669; Strand=+
  SCN-specific regions: Sequence locations=1-107,129-186,209-234,256-273
atgaccttccaaaactactcattggtcaatgaagtgagaatgaattatttaataaaacaatgaaaaattagtcggaaaatattttcaaatttggaagggcaatttctaaaacaaattatgctttttattttaaggcgttcaatcgtttcggcgttggcactttctcaatggaattgtttttgacgcattttttccgttggctcgtttccctgcccggaatgttgttcaatgcagcccttttgaacacaatcattcgcgaaaagtgataattaa

SEQ ID NO: 62329 - DNA, 1208 bp, Heterodera glycines
  Genomic contig location: Contig_ID=SeqID_32015; Location=488..1695; Strand=+
  SCN-specific regions: Sequence locations=1-329,351-389,444-535,557 -760,782-978,1000-1208
atgtcgcaacgtctaaccggggatgtgccatattttcgaactgtgccctcctctccgtcaaatgaagacgacggattggcggacgaggatgagccggttgatcaccaaagtcccactgctcaacagcaaaaagcggcacaaaacggtagctaattaagagccaggcttcgttttttggggaataaaatcttttttttttttttttagaaatacgggccaagaaaagacgattctctgagttcgaattaggtcggtctgggtccaggtttatgcttttttttcatggaccaagacgccaagccaatgcatcttaggccgtcggggtttttctttgggtctgaaaacccaggcccagttaaatccaaaaaacctgagtttcctggaccatcatttatttttctatttatttgttatttaaaatgataaatttttgataattttaagtggttcaacattgaattatttttaggtaatttttatatttttctaaacaaaatatttttggtttctgggcattaaaaaacacaagttctagcggtgggttttttcccagaaagtccaggcttaattcaaacccagaccaagacttttcaagtcccgagctctaatcattatcacttattttaccctacaatttttcaattttatttgacccattttttccttttttctagtggaggatgatgaggagacaattttgcgacgtcgacttttggagaaaaagttggaaaaggagaaaacaaaggcagccgcgactgttggccagcagatgacgaaggagcgcgacggggccgaacagaagggggcaaaggatggttccagaaaggagcacccgcaaaaggttttcggcatttttgtgggcatttatacgctaatttgtggttttggtttcgttttaattccgagtcttggtcctaaaaaatgattttaacccaaaaattacacaaattttagagcatttgtgggtgccaaatttaaaaaatcaacagcatttatttaggagaggccaaagcgtgagaaaattgtgtgggacagagaaaaagtgacggcccctaaatcgtcgcgtcatggccaattggtgtcagcgattgcggacaccaaacatgggcaacgttcacaaagccaggtttctgtccaatgatgcgctcatttttggcaatttttttttgtctaaaaaggggaattcttggtagcttatgccacaaaaa

SEQ ID NO: 62330 - DNA, 226 bp, Heterodera glycines
  Genomic contig location: Contig_ID=SeqID_32016; Location=616..841; Strand=+
  SCN-specific regions: Sequence locations=1-89,111-226
aaaagcgttggatcgattgctcatttggtttggttcaattcttatcacaaatgtttgttgaaaattttaccattggaaaaagaagggcgatttgtttgtgaatttttaattctggtgctgatacatagcaaatttccagggagttgaagaaggccatcgaaaaccggaattcacaacacaaatggacaatggcactatttttggtggcaaactcacagaccactaa

SEQ ID NO: 62331 - DNA, 144 bp, Heterodera glycines
  Genomic contig location: Contig_ID=SeqID_32016; Location=1..144; Strand=-
  SCN-specific regions: Sequence locations=1-144
aaatcgtgggttcaacgtgcaaagctttggctccggcaattacgtgaaattgcccggcccaaaagaggacaagccgaacatttacgagttcgactccaccacatatgaacacattttgcaggacctgaagcagaaagacagcaa

SEQ ID NO: 62332 - DNA, 999 bp, Heterodera glycines
  Genomic contig location: Contig_ID=SeqID_32019; Location=132..1130; Strand=-
  SCN-specific regions: Sequence locations=1-404,426-501,631-712,735 -740,763-844,876-999
atgtgggagaaatacgcggtgaacaaattcaagccgaacaaaggcgttggcggtgaatacgaagttcaggtaatttgagggggaggggagggatttggtcgtcgcaattggacttttcctttgtcagtccgggttcggctggtccaacggagttatcctggacctgctgaccacctttggggatcggatggagttcaagaacgacttggaggaggaccccagcgcagtggccaaggaggtgatcaaggcggagccgcccaatttgcccacgcccaacccgaacattacacccgtactcaacggacccttcgtggcggttgggccgcagggcgaaggcattggaattccgaggccaagcggcgcccttcgaacagcgatggcacctcggcacacattgtgccgatggttgtggtggtggacaagcgtactcatggcactgctcgtcactcgcacaattcattgagtagcaacaacaaaggggacgggacaaaatttcgccgcaaaaaaataaaatcaaaaaattagacttagaaattttttaagaaaaaatcatagaatttcttataagaaaatttcaaaaaaaaattagaaaaaattttaaggattttttttgaaatttatgataaattagtaagttttttcgaaaaattttccaaaaaatcactaaaaaattttttcaaaaatttttcattggaatttccatataaaaaaattctaagaattttttcttgaaaatttccaaattttttaaaaaaaaattttggcgaaattatgtcccggcgaaattccgtccggcgaaatttcggcggcgaaattttggggtgcaccctatttaactgtaaggattaaaaataaattattaaatattttatttagcgatcttctcaagcgcaagtgaacgccttcaacatgacgaagcaaatcttcaacgatcctttgcgggggcagaaagaagcaatcgaagcgattgtggacggcactctgatcacaatgcacatg

SEQ ID NO: 62333 - DNA, 841 bp, Heterodera glycines
  Genomic contig location: Contig_ID=SeqID_32021; Location=43..883; Strand=-
  SCN-specific regions: Sequence locations=1-841
atgtcgacacacagtaaatcatgtaaggcgcgctgtgtgctgtgctcacgtgttggacctgcttttccatgtccatcatccgccggcttcttcaaaaaatgtaaagagtgcaacaaaaaattcaccaacaacggctgctaccagcatcatctgcagtcaggcttctgcaagcggtcgaaaaagtgcaaagattgcggtgctgtttgggatgtagcagataacaaaagaaatggcagaaaggggcatgtttgtggtgaacgcttctgtaagatgtgcaacaactaccacaacaccgagcggggatgctacatccaacccatcgagcccaaggaacgcgacccctaccgaattgtggcatttgacttggagactatgcagcacatgccatctgaaaagcccgaaaagcgtgaacatttgcccaactttatcgctgcgcgtgtcgcctgccccgactgcattgaaaatgagagctggcgagaggcatcgggagggtgtgaagtgtgcggtcctaatcgtacggtcgcgttctgccagcgccgcttcaccgaaacaacagtcgacaagcaagtggtggcggaaaaccctttggatgcgcttgtcagctggctgataaacgacttaccgctcgcctacgacacctatgccttctctcactttggcggtcggttcgatatggtgctggtgttccgcgaattgttcaaacgcggatataacccggacatgttgcgcaaagtaataattgactatttttcaaatttgaataattttcaattttaaggggaataaaatgtacgaaatgcggattcgaaggcagaaaaagcgcaaccccaacattggttag

SEQ ID NO: 62334 - DNA, 448 bp, Heterodera glycines
  Genomic contig location: Contig_ID=SeqID_830; Location=1376..1823; Strand=-
  SCN-specific regions: Sequence locations=1-107,130-139,172-191,213 -259,299-315,338-392
atgaaaagtgcacccatggatatcgttgtcctttggtatcaccgtaatctggtttctaattaatttttttatttagttcttgatctgcttcctacgtttttgaagactgcttgaatgttttagatttcattagttcgtgtttttataatttcataaaatttataattatttgcgtttatttcgaaccctatgaaatatcttctttagctgatgttttttcaaaaaaattatttattgctatttttagataacattctgtctttctatattatttcttacatttataaaatttctgtttcgattactaagatcaatgaaatttgtggagacaaaaagtgttaagtaaaaggtcctttagatgaaatatatttgtatgtgtaattttttattcgtaaaaaatttataaatagaaaaatttttggttaattaaataattctttttaataaa

SEQ ID NO: 62335 - DNA, 478 bp, Heterodera glycines
  Genomic contig location: Contig_ID=SeqID_830; Location=6406..6883; Strand=+
  SCN-specific regions: Sequence locations=1-140,226-243,270-306,328-478
atgcgttcgcttcgcgcattctttcattctcgacatggcgaaggtattcgttgttggttttttaaatgaatgatattaaaaattgattatggaaatatttttgacatgctactttatgctttaaggtattactggagatcataaataattataatattttataggacaaaaattaacaaaattattgattgtaataattatacttttatcaaattttatttttttgtttttcaatgactgtgtttaagaattttatttgctaaaaatacttaagcaatcgctgcgtttgcgcacgcatatcgttggaaatatgtattttttatatgtttaaccattttcatacatatgtaataatttctatttacattttggtaaaatttattttttaatcatatctttattttttcagtcaattaattcaaaatattttcgaatcgttttttgatatttatttggttctctttgcataatttttgta

SEQ ID NO: 62336 - DNA, 1069 bp, Heterodera glycines
  Genomic contig location: Contig_ID=SeqID_831; Location=909..1977; Strand=-
  SCN-specific regions: Sequence locations=1-170,214-222,352-503,525 -549,574-622,730-871,930-1001,1023-1069
atgaagtggaataaattaataaaaatggaaaaaagtaaaaaacagaaaaatttgaatttgtttaaagggatttattttttattttttgagatcccaaattaatgggtgtattttacaaaatttttagcggttttacgccaaaaattactattttttaccattttagtctcattaataaaaatcatcattttaataattttatgaaaaatttaagtcgtcggcaatcaaaatacataaaagaaacaaaaatttataaaaaaaaaagcaaaaagaactgaatatacaaataataaaaatttaattaaaatatattaatacatatggaaatataaaaatgaatttaaataaaaaatcaatttctatcaaattctgttaaatgatccatatatttctaacaaaggcaaaacaaaaattaaaaaatagcaaaaatagcaaaaattctttttaaaaataaagctcaaattatatatattaagaatcagaacaaaaaaagtaaaacttgttgaataaaatatatgacaaaataaagtgatatttttaaccaatcaatgttcatttttaatatcattatttggcagtttttttaaaagtttgtgatttttcatattttctctctgaaaacaattataattttattttagatagatcataaaaaaaaatttatcatgcataatctataaattataaatttaatttattgaatataatttgcataaataaaaatttaaaggaaatcaaaatagctaattgttcctcactaaagataaatcaattaagttgaagggaccgataaagagttcttacgtttgaccaagattaaaataataaattcaaccaaatgatgaaaatgaattaaccttgaatacacaagatttttaaatacaataacaaattttaaaaataaatatttatagataaagaaattaattgaaaaacgcagatttgtctaattatttacaaattttaactataacactaatgacgacatagttcatggtgtatttgaaaaatgaatttatatatgccaaaaaaaattctttaaagataaaaaacataaccaaaaaataaa

SEQ ID NO: 62337 - DNA, 663 bp, Heterodera glycines
  Genomic contig location: Contig_ID=SeqID_6651; Location=2688..3350; Strand=+
  SCN-specific regions: Sequence locations=1-146,168-189,211-241,331-663
atgatgataattttatcaaccaaactgctcacaatgtccgttctgctgcttccaattttgcttggcaatgcaaatgccgctggcattggcgaccgacaaaaaagggcggtggaggaggaagaacaaagaattgtgagcgaactgtgtgccaccccacccatgcacagaagttcaaggagttattcaatgctgaaaatggaagtgctgaaaaagaagttttatggatggaaaacattgaaatgaaagcggacaaagaggaggaaaaggaacagcagaaaaaaaatgaaaagcaggaggaaagggaaaagcgggaagagaaagcggcggaagttacaatggatgccaaaaatgaagcatcgcttagcactttgttgagaaatttaactcattcttaccacttcggcttttgtctgtcctcctttaggttgacgaaaatgctgttttggaatatggaaaaaaaattacaaccctagcaaaaaaatttatttccgacaaagttccaaaaatttatccttaaataattcaccagagtttggtaaataaccatttaaaaaaatgaaaactaaaaattttaaacatgaacctgaaaatatctcaataatacatttaaccattaacaaatatattaattagttcgaaataattgcaatcatttttgttgaa

SEQ ID NO: 62338 - DNA, 144 bp, Heterodera glycines
  Genomic contig location: Contig_ID=SeqID_32022; Location=141..284; Strand=-
  SCN-specific regions: Sequence locations=1-144
atggaccttcggcacggcctccgtctgctcctcctcttttgccttgcccatgcgctcgcccaatcgaacgactcacaacaatcagcagactgtgcggatggcgaattttgtgctttgaatgatccggattcatcacatttcatt

SEQ ID NO: 62339 - DNA, 60 bp, Heterodera glycines
  Genomic contig location: Contig_ID=SeqID_32025; Location=1..60; Strand=+
  SCN-specific regions: Sequence locations=1-60
ttcaccattttacgcatttttaattcgtcgatcgcttctttaataaattttgtgtcggaa

SEQ ID NO: 62340 - DNA, 172 bp, Heterodera glycines
  Genomic contig location: Contig_ID=SeqID_32027; Location=1240..1411; Strand=+
  SCN-specific regions: Sequence locations=1-172
atgactacttatttgtttgataaattgaaaaaaaaagaagatctcttgggaatggttagaaccatcgaacaatatgctgatattggtgttttggatttcaaggaatttatgccgtcgaatcaattttcaactgagggtttaaaagtgaatgagattcatgacattgtctcta

SEQ ID NO: 62341 - DNA, 466 bp, Heterodera glycines
  Genomic contig location: Contig_ID=SeqID_32029; Location=298..763; Strand=-
  SCN-specific regions: Sequence locations=1-466
gtttcaaatatcgtaagattgtttgatagggccagacaaaagaaggcaactgttggtaccaattttgcggtaaaaaaatgagaaaaaagagatagccattttttggtcaagaattttttttgtttgcgtttcaaatatcgtaagattgtttgatagggccagacaagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtacaaattttgcggtaaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 62342 - DNA, 152 bp, Heterodera glycines
  Genomic contig location: Contig_ID=SeqID_32029; Location=819..970; Strand=-
  SCN-specific regions: Sequence locations=1-152
aggcaactgttggtaccaagtttgcggtgaaaaaatgagaaaaaagagaaaccatttttggtcaagaattttttttgtttgcgtttcaatatcgtaagattgtttgatagggccagacaagagaaggcaactgttggtaccaagtttgcggt

SEQ ID NO: 62343 - DNA, 741 bp, Heterodera glycines
  Genomic contig location: Contig_ID=SeqID_32030; Location=329..1069; Strand=+
  SCN-specific regions: Sequence locations=1-26,57-70,99-106,133 -139,165-212,234-248,278-285,307-332,354-655,677-741
atttgaaaaaaacagaatgccaagggttaaaataatttttaaatttgaaaaaaaaagaatgccaagagtcaaaataattttttaaatttgaaaaaaatgccgactgaaaataattttaaatttgaaaaaacagaacgccaataatttaaataaattttaaatttgaaaaaacagaaagccataatttaattttgaaaaaaacagaatgccaagaatttaaatattttttaaatgagaaaatggggaaaataaatgcaagaaattggcaagaaataaatagggaaatttggcacaaaaatgtgcaaaaatttggcaagaaataaatagggaaatttggcacaaaaatgtgcaaaaatttggcaagaaataaatagggaaatttggcacaaaaatgtgtaaaaattggcaaaagaaagggttaaaaattgtggcaaaataatgcgaaaaattggcaagaaataaatagggaaatttggcacaaaaatgtgtaaaaattggcaaaataaagggttaaaaatttgagcaaaacaatgccaaaaattggccagaaataaattgggaaataaggggcaaaacaatgccaaaaaattgcggcaaaatggcacaaaaaacggtaccataataatgccaatctggcacataaataataaatggcgaaaattaatgggtaaatgggtaaacaaatgccaaagaaggaaaaaattaaggcataaataaatgataatggattattgattggct

SEQ ID NO: 62344 - DNA, 723 bp, Heterodera glycines
  Genomic contig location: Contig_ID=SeqID_32031; Location=495..1217; Strand=+
  SCN-specific regions: Sequence locations=1-59,83-295,323-366,388 -545,567-572,598-723
atggcagctgaggtggaacggcttaaaggtttgaccatttcttgggtcatgaaaatgggaattttaattttttttttaatttggaaaatcatataccatttatctgcccccgtaacactttcgataattttttagttttcgccttttggggcaatttttgaaggtcttcctttcctccgaaatgatttgggcgcttataactcattgtcagctacagggatattaaatgggagctaatcctgaaactaaaaggctgtcagtgcccaaatttttctaattaaggcattaacagctatttaaaattgcaaaaatattaagttgccaacattgagatcgaccccaaccaaaaatttagtttttaaacccaaaaaaattaaaaaaaaaattctttcttgacagatgccatctttgcccaggacgagttcatcggcatgttggagggcgatctgttggtgtacgaggcccatgtgggcattctgcgcgattcgttgggcgccaccaagcgggaggaccgccagcacatcaagtcgaaggcgttcagcgccaagctgaacgcgctggagatggagaagcgggagattgcgaagcggaacaacggtggggttcaagtttactatttttttaattcgaaaaagattacgaatttttttttaattgcctgtcatatccccaaaattgcaaacaaaatcccaattcaaatccctatcatttcttaaattttaa

SEQ ID NO: 62345 - DNA, 330 bp, Heterodera glycines
  Genomic contig location: Contig_ID=SeqID_6654; Location=1655..1984; Strand=+
  SCN-specific regions: Sequence locations=1-15,43-116,138-183,227-330
atgcttgttgtgactgtgccaccaccaccacaatcaccatcagcagttgcggtaacgacagtagctgctgtcttcggagaatggtcgtctactgtagctgttgtgtctaccgtattcccaaccaccaacaccaaactgttactggtgttgttgttaccgcaagcatttgcagctgttgctgtgccaccaccaccaccaccaccaccaaaaccaccaccaccaccacagcttggacccattgaaaatgtgccggccgtactcattgatggacgctgctgtgccgtcagcatatatttgatgcgcttaaatgattattttttcaaacactaa

SEQ ID NO: 62346 - DNA, 920 bp, Heterodera glycines
  Genomic contig location: Contig_ID=SeqID_6655; Location=458..1377; Strand=+
  SCN-specific regions: Sequence locations=1-485,517-707,795-920
atgccaattcccaacaaattgcacatttttttttctcgtattttcatcgaaaaatttcgttgggcaaccggaaattggaattccgagctcaaaaagaaaaccggatttcgacatatccctgctggtgtgtatatggcttcaactatagagatttaaaaaaaaaacttgaagatagtttactaattttccaaaaaatcgctgaaaactttttcaagaatttttttctagaaattctttaaaagttttttttaattccatctttcgagggggggggggggaggggtaagaaccagtgaggtggaaacccctatttccaagccaaaatcttgggcagcctgtctatggccaaaatctagaaaattttgctaaaaatcgcaattctgacataacaaaaaaaaattttgtgctaattttactgggcacagtgtccaacagcagcgccaatagaggcccgggtagaagccgagcatcgagtggatgtcctgaaattttgtaaaattttttaaaaaaaaattagtgaaaaattgttttttcatttttctttttcttgcctcgctgaaccgccgaataccgtagaaccaacagacggcaatcatttcgcacattacgatgaacagcacggacagtgacacaccgtactcgtccaggaacggtatcacataggagccaccctaatgaggggggggggggagaagaattatttgtggaaaaaaaatttaaaaaaaaaaattttgtatataaattaaatgggcaaaattgtaaaaaaatatataataataattaagaaattaattcagaaaataaaacttcgtaaaaaaattaacttaagaaaaagaatatctatgtaaaccaattaattttcttcgaaaaattatgtgaaatcgaaaaaattagtctaaaccatttaattttaaaaaata

SEQ ID NO: 62347 - DNA, 1681 bp, Heterodera glycines
  misc_feature (11)..(11): n is a, c, g, or t
  Genomic contig location: Contig_ID=SeqID_6655; Location=127..1807; Strand=-
  SCN-specific regions: Sequence locations=1-26,48-232,283-388,449 -556,644-834,866-1342,1364-1389,1413-1479,1501-1681
  Gene Ontology: Mol. function=dopamine transporter activity; Cellular component=integral to membrane; Biological process=synaptic transmission
tttgcatatantgtgtgttcataatgttcccccagtttccctgcatcgaagcattcatcaccggcttctgcgacgagtacccgcgactgttggcacgtcggcgcgaaatttttgtcgcatgcgtcatcgccgttcattacgttggctcattgccggccacaacttacgtaaaaaaaaaacaatgaaaattttgctattatttttagatgtgttggaaaatgtttagttttccaataaatatttattcatttttttgttaaatttttcaatttaattttaataggccatttatttcttgctttaattttcataaaaatttgtttttctattttagctatttttttaaatcatcgaattttatgccgttttaggctagacaatttctaggaaaaaatatttttattttaaatttttcgctcaaaaattttattattttttaaaattaaatggtttagactaattttttcgatttcacataatttttcgaagaaaattaattggtttacatagatattctttttcttaagttaatttttttacgaagttttattttctgaattaatttcttaattattattatatatttttttacaattttgcccatttaatttatatacaaaatttttttttttaaattttttttccacaaataattcttctcccccccccccctcattagggtggctcctatgtgataccgttcctggacgagtacggtgtgtcactgtccgtgctgttcatcgtaatgtgcgaaatgattgccgtctgttggttctacggtattcggcggttcagcgaggcaagaaaaagaaaaatgaaaaaacaatttttcactaatttttttttaaaaaattttacaaaatttcaggacatccactcgatgctcggcttctacccgggcctctattggcgctgctgttggacactgtgcccagtaaaattagcacaaaatttttttttgttatgtcagaattgcgatttttagcaaaattttctagattttggccatagacaggctgcccaagattttggcttggaaataggggtttccacctcactggttcttacccctccccccccccccctcgaaagatggaattaaaaaaaacttttaaagaatttctagaaaaaaattcttgaaaaagttttcagcgattttttggaaaattagtaaactatcttcaagttttttttttaaatctctatagttgaagccatatacacaccagcagggatatgtcgaaatccggttttctttttgagctcggaattccaatttccggttgcccaacgaaatttttcgatgaaaatacgagaaaaaaaaatgtgcaatttgttgggaattggcatgcttcctgtatttatttttttttaagatttgtactgatcaatttaaaaattaaaaattttttgactgaaatatatgctagaccaacaaaaaaaaatttaattttggagaaatccgcgaaattttttaatttcaaatttttctcagttgttcatcggcatcatcttcgtgttggcactgtactccacctcgttttcgcccatgcaaatccccaactacacatatcccgcatggtccgtgtggcttggctggctgttccgcttgctctcctgcgcgtccgtgcccgcctatgccctgtacctgttcatcttctcacgcggcaacgtgatgcag

SEQ ID NO: 62348 - DNA, 1114 bp, Heterodera glycines; identical to SEQ ID NO: 32032
  Genomic contig location: Contig_ID=SeqID_32032; Location=1..1114; Strand=+
  SCN-specific regions: Sequence locations=1-373,395-500,522-780,810 -1114
  Gene Ontology: Mol. function=ATP-binding cassette (ABC) transporter activity; Cellular component=mitochondrion; Biological process =transport

SEQ ID NO: 62349 - DNA, 104 bp, Heterodera glycines
  Genomic contig location: Contig_ID=SeqID_32033; Location=1179..1282; Strand=+
  SCN-specific regions: Sequence locations=1-104
gcgcgaagcgcccgtcctgaggctgcgatgaattgctaaattaacgcactttctagcgacgcggcgaagccgcgtccctgagcgcgaagcgctttctcacagca

SEQ ID NO: 62350 - DNA, 1261 bp, Heterodera glycines
  Genomic contig location: Contig_ID=SeqID_32035; Location=172..1432; Strand=+
  SCN-specific regions: Sequence locations=1-192,216-358,380-988,1010 -1142,1169-1261
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcgagtttctgaaaaaaaagttaagcctaaactttttggcctgtttaaaaaggaattaaaaatttttaaaaattttattcatctccctttttgatagaaaaagcatcagagtgcctaaactaacgtgtaaataaaatttggtgcgtttcagaaccctttctgaaaaaagacc

SEQ ID NO: 62351 - DNA, 956 bp, Heterodera glycines
  Genomic contig location: Contig_ID=SeqID_32036; Location=148..1103; Strand=+
  SCN-specific regions: Sequence locations=1-130,154-225,247-336,388 -649,694-877,899-956
atggaaattaaacaagataaatgtcagaatctactgcaatgcttggaaaatgtggcatttgagctgacggagcatgtgtgccaactgccggatgtgccgtcatcgtcttcggtggaaaaggtgggaaatgaattttttttaatttttaaaaatcatattcggcggtgccaataaaaaaaggcaaaggaaaatttaatgtgtattttaggagaattaataaaccaattttttattttgtccaaaaaatggtcaacttttgcaaaaagtgtgcaattttgtgggtgatcgtgatttgtgaaggtttttgtttaacaagtcaaaatgctaaaataactgatttttagatttttttttattttgtattatttttatttactttttaaatttcggcatctttttttaataattttagaagaatttttttgcgaaaattttcgcgcaatatttattttgattttttctcaactcagtccctcttttggcacaggaagcgcctcaggtgcaatgcgtgcgcaaactgcaagcagtgattggcaagctgacacaacaattgcagcagttggacagtgccgaggagcgccgggcagtgcgggacaaatttgttgtaagtcaattataaatatttaaataacaagggaacatttcaaaaagagagagagggggggggagagagagcgagaaacagagagagagcagtcgattttaaattttttttttgctactacaccaaaaatgatcaaaaaaaagtaatcaaagtttcgaaaaaccgataaaagtgatcaaattttcagaaatttctaaaaaatattagaaaggagctgagaaccacaaacttttttaaaaaatgatcagcaaaagattgagcaaaagaaattgccagcaaaaaatatggtaattttaagcattttttttcaagattgcagaatttaagagtgattaatttttttatttttgta

SEQ ID NO: 62352 - DNA, 206 bp, Heterodera glycines
  Genomic contig location: Contig_ID=SeqID_32038; Location=889..1094; Strand=-
  SCN-specific regions: Sequence locations=1-88,113-206
atttataagcatttgtagggttctcagcagtttccctgcaaaatttggtgagcttctgatcagtctagaacgttgggtgatcaaatgcaaaaaataatttaaaaaaaataatgctggtgtggtaagtgtgaagaactgtgttcctccaggcaaaaaattctaagaaaatttataagcatttgtagggttctcagcagtttccctgc

SEQ ID NO: 62353 - DNA, 853 bp, Heterodera glycines
  Genomic contig location: Contig_ID=SeqID_6658; Location=2634..3486; Strand=+
  SCN-specific regions: Sequence locations=1-233,263-419,442-610,632-853
  Gene Ontology: Cellular component=microtubule; Biological process =cell organization and biogenesis
atgccagtcaacaactttttgcaaaaggatgatgtaagtcttttcatatttgaatgactgtactgaattagttctttaagatttcgctgagtggtgagagtgctggagaggaatacgaagttgaccaaattctcggtgtgcgcgttcttgaggacggaacgaaggaatataaggtaaggcgaatttttgggttctcaacattgctttgtattagtactatatttgtcgaatgattgctaaattatttatttttgttgagtttaggttcgttggaagaattacggaagcaatgacgacacttgggagccgatggacaatctcgttggtgcaaaggatgcattggacaaatttctcaaagcgaataaacaggccaaaaaaacgccgaaagcatcgcgaacgccggtgagcacatttagccgaacaaataaaagaaaagcccaatttaagaaggcaacgaagctaggacgaaagcgcggtgggggtgacattagtcaggaggccgaagacggggagaacaatcggagcagcaacgaggacgagtcggacgacgacttctcggtgtcatcggccagcaagaagaagaagacaacgtaagtgcgggagaagaacaacagcaaaaagggctgctggtgacaattggaaaatggggcgacagaaaaacagtcaattaatgtgggaaaataattatggaaattgaagggataaaaagtcgaagaaggctcccgtccgccgtgctgtcactgcctccagcggtcgtccgtcctctcgtccgaccccccacaatggggactcactggtgccgaccgattccgctttgccccctgcatttgttgtcacttccctccacccttag

SEQ ID NO: 62354 - DNA, 514 bp, Heterodera glycines
  Genomic contig location: Contig_ID=SeqID_6659; Location=270..783; Strand=+
  SCN-specific regions: Sequence locations=1-108,130-305,327-514
cttccaaagcgtccgaacatcacctcaaattcgacggaatctatttcgacaagaatggtgtgcttaaactcgtcgaaaagggaggaacgcagcgggtgtttaccttcgaaggtaattttttgcttcaaactaaattcagattagtttattgattagcattacaattctttcctttttcagaggccaaggataagaattcgagtgccttgtgcgattacatgtgcgacatggtcacattcacggaaaagggcaagccgcaaatccaagtggcaccgcaagaaatggagacggaggagggacagcatgaggaagaggaggagaaagtgttggaacggacccatgacgacgacgggaaactgaacttcgacgattaaaagggcagagacataatttgagaagtttgagacggcactttacttcattcctcacggattttactcaatgatatattatcttcaatgtttgtttgtagccccacccaatgaaagtgaactcacataaaaccgaatttgga

SEQ ID NO: 62355 - DNA, 786 bp, Heterodera glycines
  Genomic contig location: Contig_ID=SeqID_32042; Location=33..818; Strand=-
  SCN-specific regions: Sequence locations=1-113,136-243,283-432,456 -580,602-786
atggcattcattggtttagaagtgcctccgaatccgaattttaatccggctttgcttgggtttgatgatgttgggcttcagccgcccctcgaccagcagaacggtggtttgtcattccttttgttccattaaagtcattgtcagttctttccttgaccacacaacacgaaaaataggaatttgcatgttgtttttggcaaacaaaaaaattgaatttaaaatttagacttttccaatgtttccttaatatgaaatttctaatttattaaatttaaaaaaattcatgtggggaaacgagctgctccctgttaattcatccatcttttccaaggggcactgaacaacaatggccagcaataattctccctcaaaatcagcaacagtacgaaagaataagcggccggcacatccatccaacttccaattttgtcatttgttctttttaaatattatgttttgtctgataatgagaataaaacttgacaacacattttgatttcaactttgacattaatattatttggtcataaaacatcgatatattaatttttctctgtaattgtctattgccatcacccgagacccaaaattctccccatttacctatccacataaaaagacccaaaagcgctaattatcggatttgattaattaagcacattgttgattattttggtttgtaactttcttgaaatgttagaattctcttgttttctcgtattattacattattcagattttgtgctttcgaatgataccaaaaagatagggtttgttcgaacatga

SEQ ID NO: 62356 - DNA, 1487 bp, Heterodera glycines
  misc_feature (622)..(622): n is a, c, g, or t
  Genomic contig location: Contig_ID=SeqID_32044; Location=1..1487; Strand=-
  SCN-specific regions: Sequence locations=1-291,313-450,481-630,669 -894,929-1122,1157-1436,1459-1487
  Gene Ontology: Mol. function=somatostatin receptor activity; Cellular component=integral to plasma membrane; Biological process=cell-cell signaling
ataccaattcgcctctgtttatgctttacactttcggcgttggctttttggtgcccgcccttctgatcactttcttttaccttcgcgtcatcctcaaactccgtgccgatgccatttccgtgcgaaagcattccgacgggcaaaattgggcgctgtcttccgcgcggtttcacaaagtttgccattcgccaaaattataaattaaaatgctaaaaaatattcactctttttgtttaggtaactaaacgaattgtggcggttattctattttatttcctttgtaagtcagccaataattatttaattaatttacccttaattaccccctccctctaatttttaggttggactccctactggacgctgaacattatgtcccaatttggcattatcattgtaattgaacttcaatatttaaaaattgaaaaatattaggcacggcattttcgcataaattaaaaaatattttttcatttaattgtggtgactcagaaatctgtgcgattaattttaatcaatcaaattgtcataactgcagaaaagtatcatcatagtcactgttttggttggggtttgaacccgatacgcagaaagggaaggcattaccaactgagccatgttnggcaatggaatttaaatgattttatctaataaaataaaataaaaatgatcctctgcctatcctcctaaatttgtcaggtcagttggtccactttgacgctcagttcggtgtttttcgtcgcccatttgctcgtctgtttcaattccgccgctaaccccgtcctttacgcgctgatcaatcgcgaacttcgccagcaaaatgcgcaggcactgcagaaaaggcgccgatcacttaatgtggccacaaataatgcgaagggattcatcgaaaaacagtgggaaaatggggaaaagccaaggaaaaagccaagagactttttatcgcttcgattggcctaaggtttccaacggcaccggtgagaaaggagcagcagaggggcgcttcggtgggtttttcggacgattcgcaccaacggctgttgaaaataattggaatgaagaaagggccgaaggcgacggacagcgacaaaatgttggagaaaaagtgagactaatgagagaagagagggagggggggagggggggggggcgggagtgcccatttgattggagtgactctttggacgggatggacggagtgccgttatttaaacgagatgccgattttggtccgattggagcggatggcgtttcgttatccgtgagttggcccgtgaagttatgcccgccccatttcccttctctttgagcgaccgtttccttctccgaatttcggcgcccgcccttttcccgcctttttacgccgaattgcgaagagggggcggcgattgttccggttgcgaatggccgtttttctgcgtcccttcggcggcgtcgggggcgggaagaaaaagcggcggcccatttgtccgaatggaaaagaagga

SEQ ID NO: 62357 - DNA, 372 bp, Heterodera glycines
  Genomic contig location: Contig_ID=SeqID_32046; Location=932..1303; Strand=-
  SCN-specific regions: Sequence locations=1-5,184-199,221-372
atgagaaaaattataatcaaaataaaaatgaaagtaaacaactttttaaactaataatatattatttaatatttaaatttataaagtatttatttcagaaatgcatattactaaaactattaaaataattaaatacccattttaaattttatattaaaatgaataactaacaataatttttatggaaagtatactaaggatcttttattaaaaaataccagttttgaaatatttaagttcttcaatatttaaagacattaagcaaaataatataatgccataaagaataattaaaaatgctgaaattttttaagaacaatgttggaatttttcattaattgtaaacaacgcaggcaattatatagcaataaa

SEQ ID NO: 62358 - DNA, 279 bp, Heterodera glycines; identical to SEQ ID NO: 58736
  Genomic contig location: Contig_ID=SeqID_32048; Location=760..1038; Strand=+
  SCN-specific regions: Sequence locations=1-153,196-279

SEQ ID NO: 62359 - DNA, 217 bp, Heterodera glycines
  Genomic contig location: Contig_ID=SeqID_32048; Location=114..330; Strand=-
  SCN-specific regions: Sequence locations=1-64,94-169,191-217
atttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaaatttggggcgatttgaaagagaaatagaaagaaccaggttcgatgaagttttgttaagcca

SEQ ID NO: 62360 - DNA, 364 bp, Heterodera glycines
  Genomic contig location: Contig_ID=SeqID_32048; Location=484..847; Strand=-
  SCN-specific regions: Sequence locations=1-86,116-247,281-364
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaagaga

SEQ ID NO: 62361 - DNA, 739 bp, Heterodera glycines
  Genomic contig location: Contig_ID=SeqID_32050; Location=204..942; Strand=+
  SCN-specific regions: Sequence locations=1-167,189-497,520-523,564 -574,597-635,694-739
atgaaaacagtgtcagtggcgctggtgctgtgcctgaacatcggcccccgacccgccccgacgtgcagaagccgcagccgtgcgcgcgcaaggaggcgtgggtggacccggcggagccgagcgtggcccacgcgcagcagcggccggcccaacgcattgcgcaaagcctgcagaaaatctacgaaaaattgcatccccgagcaaggttcaaatctttatttgttttttaggaaggtggacaacataaatatgctttatattagagaccggacgggatcgggatcccgcgggatttcttcgggatcccgcgggattaaattcgggatcccgacctcgggatccgtcccgaacgattttcaaattcatcgggattgatcgggatttcatcgggatcccgaagcgggatccctcccgaccattttaccaatcccgcgggatcccgcgggattgaagtcacgataatttttggaaaaaatctcattttttaaattaagaccttaaattttaaattaaaaatttgcttattttttctttaaattcccttaaaatcccaaaaaattttcatgagtctcaaaatacttgtgaaaattttcaaactttgacacaaaggttggccattttgtgacttttattcctttaaaaaaagaattatcaaaaattattttttttaattccttaaataatattttaaatcttattaggtagtttcatgcacaacaatttctaagaattttgtcta

SEQ ID NO: 62362 - DNA, 61 bp, Heterodera glycines; identical to SEQ ID NO: 61697
  Genomic contig location: Contig_ID=SeqID_6660; Location=4502..4562; Strand=+
  SCN-specific regions: Sequence locations=1-61

SEQ ID NO: 62363 - DNA, 924 bp, Heterodera glycines
  Genomic contig location: Contig_ID=SeqID_32052; Location=39..962; Strand=+
  SCN-specific regions: Sequence locations=1-174,202-239,261-306,336 -500,523-577,599-608,635-924
atggatgatttattcgaaaatctttttgaaaataattcacaaaatttgaaacgattgaaatctgacgaacaaccggaaaagcagcaacaaaaactgagtgtaaaagctgaacaaaacaaaaaatgggatgaatcatcgcaaaaaatgacgaaaaaattaaaaattgaaattaaggaggaagaagaagaagaagaagaagaatggcacacggataaagtgccaatgggcgaacaaattcacaaaatcaaaagcgaaccaaattttgatcaaaatgaaattgccaatcggacgcaaaaattaaaatttgtaaagaaagagccaaaaatggaaaatgatgaccattttattagcaatgatggcactgttcaagctgaaaatgaaagtgatcagcaacagaacgagtgttcttcaccctctcaaaatgatcaaaacgcctcttctgatcaatcaatggacgaaaagcaagacgaatcggaagatgaaagaaagttgaagcaaattgaaaagtttgacaaaatgagaaaggcatattgggccaaaaatggccataaaagagaagagcgaatgaaagtggaacgaaaaattgccagagaaatgggcatttatcgaacacaaatttataaatggaagaaggaattgggccaaaatgcatatgacaaacgggaaagtgaggagacaaaaaagcggacaatttatttgttcgaagagataaagcagcaaatgaaggacaacaaattgtacatttgcaaatatcggaggaaaattgaacagaaaattgccataaaattgggcacttaccattgccaaatactgaagtggaagaaggagtttgtgatcagcagagggagaaaagtgattgaagaatcggaccaagatgatcagtcttcttctgcggatgaggttttaatggtactgggaccaggg

SEQ ID NO: 62364 - DNA, 323 bp, Heterodera glycines
  Genomic contig location: Contig_ID=SeqID_32056; Location=57..379; Strand=-
  SCN-specific regions: Sequence locations=1-88,113-246,280-323
atttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccgggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaa

SEQ ID NO: 62365 - DNA, 940 bp, Heterodera glycines
  Genomic contig location: Contig_ID=SeqID_32056; Location=466..1405; Strand=+
  SCN-specific regions: Sequence locations=22-628,650-681,703-780,807 -889,932-940
aaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 62366 - DNA, 222 bp, Heterodera glycines
  Genomic contig location: Contig_ID=SeqID_32057; Location=260..481; Strand=-
  SCN-specific regions: Sequence locations=1-222
atgagcattgcaatggtcgatgacgcgtccgtccactcggaaagcgttgaattgcgttcgcgaaacaccaaaatgcatggcccaatcggtggaacggaaatggcgtatcggaacgacaattgcacgacgagtggcggaaacggcggcagaatgccactaattgaacatgtggtgaagaacggggaaagtctgatgcaaatttcgctgcaatattcagtgccg

SEQ ID NO: 62367 - DNA, 291 bp, Heterodera glycines
  Genomic contig location: Contig_ID=SeqID_32058; Location=593..883; Strand=+
  SCN-specific regions: Sequence locations=1-291
atgggactcgacccgaaagtgctcacttcggtgatcaactccagctcaggccgttgttggagcagtgacacgtacaatccgtgccccggcatccttccgaatacccccgccagctccaattacgagggcggattcggctgcaaattgatggccaaggacctcggactggcgcagaattcgtccactcagttcaaagtgccaactccgatgggttcgctggcaccaaatttaccttttgctctccgctcaaccaaaattcgcgaacaaagacttcaccgtggtctaaaaaat

SEQ ID NO: 62368 - DNA, 53 bp, Heterodera glycines
  Genomic contig location: Contig_ID=SeqID_32058; Location=1..53; Strand=+
  SCN-specific regions: Sequence locations=1-53
attcgtgatcagcgaccccgaaaaccccaggaagacgtttttgacgaattaaa

SEQ ID NO: 62369 - DNA, 279 bp, Heterodera glycines
  Genomic contig location: Contig_ID=SeqID_32059; Location=1101..1379; Strand=-
  SCN-specific regions: Sequence locations=1-25,48-56,78-128,150-279
attttctaagaaaaaataggagttttgggggcccggcggtgcccataggcgctgccggggaaaaaattggaaattttggtcatttataaacaggttttcactgaaaattagccaatttataggtaaaattttgaaaaattttgtgggaatttaatccaattcttaggggtgtaaaagtcgcatttcgcgccaaaaagcgaaatgcgaaaagcgaaatgcgaaacgccaaaaaatgcgaaaggcgaaatgcgaaaagcgaaacctcggcccatccctgct

SEQ ID NO: 62370 - DNA, 252 bp, Heterodera glycines
  Genomic contig location: Contig_ID=SeqID_32060; Location=185..436; Strand=+
  SCN-specific regions: Sequence locations=1-114,209-229
atgaatggatgggaagaagcgataatggactatgaaaaaaggaaaacaaagcgaaaaaattggtttctggaatttgaaaggcgatggatcaggatgcacattcgtatgatgagtaataagataaagaaaaaaatgttaaaaaataatgaaagcaaaaacaaataaagtgaataaaaaaagcaaaaaaaaatccagaatatgaaaaaaagtacaatttggtagatgaatgaattatttttcaaattctaaaaa

SEQ ID NO: 62371 - DNA, 77 bp, Heterodera glycines
  Genomic contig location: Contig_ID=SeqID_32060; Location=1545..1621; Strand=-
  SCN-specific regions: Sequence locations=1-77
ttttttcctgagctccccgtggcctaaaacgcacgaaaaacatgtttttttgggctgttgttaagctacttttcgag

SEQ ID NO: 62372 - DNA, 457 bp, Heterodera glycines
  Genomic contig location: Contig_ID=SeqID_32060; Location=820..1276; Strand=+
  SCN-specific regions: Sequence locations=1-79,106-200,229-382,404-457
atgaaaattattaacaaagttcaaaaaatgtgtcaggtgaagactactggattgattgaatatgaacaaaaaattggttatttctatttaaatgaagaaatatttaattcgagtgaactctttttatttctttgttttgtaaagtgttttaaaaattatccttatggtattatcttattgacagcggtatgtatgtattgataatttaatttaaaaattatttttttagtactgtaatgtctagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaa

SEQ ID NO: 62373 - DNA, 1230 bp, Heterodera glycines
  Genomic contig location: Contig_ID=SeqID_32061; Location=139..1368; Strand=+
  SCN-specific regions: Sequence locations=1-339,361-445,467-880,902 -1230
  Gene Ontology: Cellular component=focal adhesion
atgggcattgccaaccatgaggagtactcattggtaaggggagcatcgccggaggggacggacagcggagcggagaacggaatggccaagggcgaaagggaaaggacgccgtactcaaacggcggaacggacgaagcgcggccgaaacagcgcagcgggttggagcacacgttcatgaacacaatcggacggaagaaggagcggcaaattcagcagctgaggtgcaaagccatgccgaacattgggccatttcgccgccttaattaagggccaaattgcacacggacgccgaaattaattgggtggactattccaagaccctcagggaacagaacatcggggaggaggaggagctgactctgcgcagaaaattcttcttctcggacacaaatgtggacaccagggacccggtccaactgaatttggtcagtttttgttgccgtcggcatcgaattcttggccaaatggtgacggactgattaagctgtacattcaatgccgggacggcgtcttgcgggggcttcatcccgtctcgagggacacggccatcaaattggccgcgctccaatgctacattgaatacggcccttacgaggagggaatccaacggagtgttgagtcagttggccaaatgttaaccgatggaggaccctcgcttttagtgccaaaaatctgttgccgaaagaatatgcgaaggccaaggaattggagaagaatattatccaagtgagcggaagaagggaatggcggagaatgaattggaatgactaatgaatgaatgacctcctaatggactgacgaatgaatcccctcccctaattagactgactaatgaatgccctccccctgaaggagtaccgcgagttgatgtatgaagactcggccgcgcccaaaaagaaatactgcgaattgtgccaatcgttgcccacttacggcgtcactttcttcttggtaaaggagaaattgccaggcaaaaaccgactgataccgcgactgctcggcgtcaacaaagattcggtgatgcgagtggacgaacggaccaaagcggtgctgaaggaatggccgctagaacaggtcgcccccccccctttttaaattggtaattattggacatttcttttttaggtccgtcgatgggccgcctctttcaaaacgttcactctcgactttggcgactataaagacggatattattcggtgcaaacgctcgagggcgaacgcattggacag

SEQ ID NO: 62374 - DNA, 1013 bp, Heterodera glycines
  Genomic contig location: Contig_ID=SeqID_6661; Location=365..1377; Strand=-
  SCN-specific regions: Sequence locations=1-189,212-425,448-519,558 -626,648-654,676-1013
atgctgagtgaagaacaatgggagcaactgctgatgaggcgtgatactgtttttggccgaagagctcgtatcttccgtgatagcaagggcgaatttgggaccataaatctctttgctattgttggcgctgccgatctgatagttcgcaggggcggaagcagtcaaatttcggatattaccgagtgtgagttttattaaatttaaatattaagcgaaaatttaagtcttaaacatattgtttaagtgcggcgcagaatgagaaaagcccagttggagcatcacacgaaccgttttccagacttcaacaatcttggcgaagatgagcaagggcgaattctgcggagagcgcagctgatcggcgcgatttggaacattgcttttggcagtggttctgcggagttttcactccaagaatatttgggaggtttttattaaatatttatttgataagaaacgtaaattaagatatggatttattgggtttgtgggacgtctattttgaagagggggcgcaccaagatcaggaggttttagttaaaattttgcgacaattcttgacgtctttagtttgatgaggactatccaattccgccaggaattgtggagctgattgcacagcaaacgcaaggggtgcctccaaacccccagagtgatgaagttttttgctgctggcggtgtggcttagctgggcatcgagcatctaattgccctattgggggttcatgggctcgcaactcacttgggcagctcattcgcaggggcgggcaaccacgatgttttgtctgttgcctcaataccgatcacatgagcgccgattgcccttatagggctcctgagtctcggcttagtactgacaaaccaaattatcgcggtttataaaatttacaattcaggaacaactcaatgttggaattgccacaccaaactgcaagggcgtgcgcaaaagcagaacacctgttggaactgccatgaacctctgcgctgttggaattgtggcgctggacataggctga

SEQ ID NO: 62375 - DNA, 300 bp, Heterodera glycines
  Genomic contig location: Contig_ID=SeqID_6661; Location=2577..2876; Strand=+
  SCN-specific regions: Sequence locations=1-154,176-300
atggtccatcatacggacagaattggcaactacaatgaacttccactgtatgagcaagggcgaaaactgaacaaagcccaaattgttggattaatttggaatatttggtttggaacggggtcaaaaccattctcaccggaagaatatctgagaggtttaaaaattgaaaaaaggtaatttaacaatttaattctattatttagaaatggaccgtcataatttatgggacgtctacttttaagcaatgggcgttgtccaaatagcaggggctttatcaacttggttgttgacatttatata

SEQ ID NO: 62376 - DNA, 438 bp, Heterodera glycines
  Genomic contig location: Contig_ID=SeqID_6661; Location=3289..3726; Strand=-
  SCN-specific regions: Sequence locations=1-288,311-438
atgtgcaaggattttgcggacaaatgggccctccgtgggcaagctgaacttatcccattagcccaaaaaatgaacaaagccaagtacaaaaatcaggtaaactagattataacaaaaaatttgcttacatttttttagtgggatactttgcctgcaggggcgatcagaaaaagaatgcgtctcgacagtgataaggatcttatggtggtctaattctgttaagcacaataatcgttacttttctattaggatgcgcccctgcttgcaggggcgtctgggaccgattctccacaaatggataaaaacatggtggaataatattttattttctttactaactattgtttgtttaggaagataatatgcccaacacttaaggagtggcctccccaaaaacagcttttgactctctaagtgcaagaaacttaccttaataaa

SEQ ID NO: 62377 - DNA, 1432 bp, Heterodera glycines
  Genomic contig location: Contig_ID=SeqID_6662; Location=417..1848; Strand=-
  SCN-specific regions: Sequence locations=1-352,375-494,516-1062,1101 -1432
ttatttataaataggtaaacttatctatacaattccctgatccgttggtgcctcgctggaaagccagaaattgatcaaattgctaacaataatgagcaagggcgaaaggtatgctataacgactattttcatctctgtttttgtttcagctcctaaacggcacggtgctttcagcagcaagcacaggaatcgccgcgttgttgctaattggtggtggaacggtacatcgacagttctccgtgcctaatgacattgatgatgattcaccgccgaaaattgcgtttgaatctgcaagggcgaaacaactacgcgctgtagaactaatcataatcgatgtaattatcacttccgctttaaataaacaaattaatttttaggaaataagcatgttgagcaaaaaagtccttcgctacgtcgatcgtctcttgagggatgtttgtgccgttgacaaaccgtttgctggaaaagtggttgttcttggcggagattggagacaactgacccctgttgttgaacacggcacgcgcgaagatcaagtgcaggagagcattaaaatggagacacttttttttgatcattttaaacagctcaggtgttatttttcccttatttaataagttcaatctttttcagtttaacgcaaaacatgcgcgttgttccaggacaaattgaatttcgcgagtggttaaacaccatcggcaacggcctccatgatgcaggggcgaacaaacagtttcgtctcaaaatcccaaaggaaatggttgcgcgtactttggaatctatcatcgatttttgttttccgagtgcattgttttgcgatccaaatcgtcattcggatatcatcaaagattcagcgatactatgccccactaacaatgatgtgcagagaatcaacgacctcgcaatcgatcgtttagcaggggctccgatattgtacgagtcaatagattctccactcgaagctcaagaggaatttggcacttttcgctcggactttaatctcgaagcgattcataacgaaaccccttctggagtaccgccacataaactcattttaaaggcatttatttttttattttttagtttcattttttaaattaggcaggggctccagtgatgcttatcagaaatctggatgtaacgtgtggcctttgtaatggaacgcgtttgcaaatcaaaacgatgacggatgaaaatttgcactgccgtattctgacgggctctcgcgaaggacaagactttctcattccacgtgttaagtttgaatacgggcaggggcgtcatcatcgaggcttacgtttccgccgtatacaattccctgttcgtccatgctttgctatgacagtcaataaggtgttgtacattctattttttttaattttcgtatttaagtcgcaagggcagacacttcaaaagatgggtcttgtgctta

SEQ ID NO: 62378 - DNA, 1308 bp, Heterodera glycines
  Genomic contig location: Contig_ID=SeqID_32062; Location=391..1698; Strand=-
  SCN-specific regions: Sequence locations=1-558,580-646,668-1308
atggaaaagggtggcaaagtatgcgacttttggtgccaaacggcgaaaaagggaaggactgaaatggcaacaaagggaaggactgaaatggcaacaaagggaaggactgaaatggcaacagagggaaggactgaaatggcaacagagggaaggactgaaatggcaacagagggaaggactgaaatggcaacagagggaaggactgaaatggcaacagagggaaggactgaaatggcaacagagggaaggactgaaatggcaacaaagggaaggattgaaagtgccgaagagatggtgccgtgccattaaatgaagggatcgccgctgatttgtgagcagcaaacactcaatgttgtgttgtgactttggactgagacttctgctgttgacgacgtcactttgcgttgtgatttgattgatcattcttccttttccctcccctttttttgtgcttcgctttccctcccgcaaaattcgcttatcactcattgccttggatctcattttaacaccttataaatgtgaaagattgtcgtaacaacaaattgactgactatataatggcaacattcacaaaatacactgacaatttgcactgaaaatggaatgtttggcaaaatgtacaaaaaaaaacaatttgaatatttcctattgccccagggacaattgtccgattggtgcgatgctaacgtaattgacggccgccgttgtttcttcgtgccccgacagctgcgtttgctcggctccctcgtatgcctccgtttcttccgacgctgcgccgccgcccaaaaggccctccgcgctgctcatcgccgacgaaccgccgtggcccgagctcgacgagtccactgaacgacttcgccaatcgccaaggcgcacctccgacgacgagccaacgaccggcgaacggcccaaattagtggaggaagtgccggtgccgaatactgagcctttgcccatgccctcctgtcttcgacttggccactctcccgacgctttaaaatttggccaaccctcgtccagttttaaacatggcacggaaaacccacccaaattggcattttgctgtgaaattccggtaaagagtgcgccttggacacgcattttgtgctccgatgccaccgactttttgggcctttgtttgatgggctgagaagagtcggagcagccaccagaagagggcggaatggcatcggttgaggaggacgggcccaaacggtggtgaagcggagaaagtgccgtcggggaacaaggcgaaggcgtattggcatattcgttggaccgtgttgcttggagctgataaataaa

SEQ ID NO: 62379 - DNA, 959 bp, Heterodera glycines
  misc_feature (62)..(62): n is a, c, g, or t
  Genomic contig location: Contig_ID=SeqID_32063; Location=1..959; Strand=+
  SCN-specific regions: Sequence locations=1-139,171-199,319-388,410-959
tgcctccaaccaatcgctgcgataggtgtgccgtgttcgtcttcggcacaaagtgcgcttcncaaggggcagcagagaaaggcgaacaaagaaaaggaagaaactgttcaaactgtatctgatgaagtgaattattgagtttatataattaatgttattaaaattaaattgagaagattctgcccgagtccgatgggtcagagaaaggaaaaagggagggaaagagtacgaaacggagaggagagcggcagagaagcagagaagacagaaagaaaaggggaggacaacagaaaggcaagggaggagagcggcggagggattttgttctctgtccgcgtctacagtatccaattttgcatttccctactctacagtatcctttgggctgacaaacgaagaaaaggcacaaatccgcgcgacggaagcgaacggcgaacgcgcggaagggtacagctgctgtcgatgcggcaaagtgttcagctacgaatattacaggtgggcagagtaaacaaacttatcattttggcttcttttttttttgcattggctttcccttcccaattaccctaattattcattaattaagtgttaatgacccatttaagggacaaacatttgaaattcactcgatgtgtggacagcggaaatcggtgagttttgtacggtcgaaggccgatcaaattcatacggaaaattggacaaaattaattgacaacaaattatcccaacaattattaggcgcttcccctgctctctgtgctcacggtaagcattaaaattcacccctaatgaggggtggggggtagttaggtgattatatgccattccatcggtcgctcagttccttcgaaaaacgcgaccgcctgcgcattcacattttgcacgtgcacgaacgctaccgaccgcacgaatgttcaatgtgttcgaaggcattctcacaatcgtcgagtctaaacaaa

SEQ ID NO: 62380 - DNA, 499 bp, Heterodera glycines; identical to SEQ ID NO: 60789
  Genomic contig location: Contig_ID=SeqID_32064; Location=541..1039; Strand=+
  SCN-specific regions: Sequence locations=1-107,134-263,292-499

SEQ ID NO: 62381 - DNA, 662 bp, Heterodera glycines
  Genomic contig location: Contig_ID=SeqID_32068; Location=42..703; Strand=-
  SCN-specific regions: Sequence locations=1-359,381-662
atgcagcatacaaagcgctatttgctagtccccgaagagatttatcagagtttggcagcaccgccaccgtcagacggtacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgacgccatctcaaggttggacgtgcgcgaaaagaaaatgttgaacaattagaagatactgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgtttaacaaggacaagcgtgaaaataaagagccaacggcattcaaagaatttgttgaaagggcaaggcagaatccgctcttgagtaggcatttatttcccgaaggccaatcccg

SEQ ID NO: 62382 - DNA, 152 bp, Heterodera glycines
  Genomic contig location: Contig_ID=SeqID_32069; Location=115..266; Strand=+
  SCN-specific regions: Sequence locations=1-152
gttcagagaatccgtttcttatattcatttcgagccttgaaaatccgaactcgaacaaaattcgaaaattcattccgcaactggagatactttttttgatgcttacttcctcgagacgagcccatttgtataccattaactatcctcaataa

SEQ ID NO: 62383 - DNA, 996 bp, Heterodera glycines
  Genomic contig location: Contig_ID=SeqID_32070; Location=172..1167; Strand=+
  SCN-specific regions: Sequence locations=1-563,586-996
atgccagcaccaacggatgagcaaacattacgctcttttctcggcgcaattaattattattcccgttttgtcagccaaatgcacgagatccgtgcaccgctagacgaactgcttaagaaggatgttcaatggcgctggggaccggatcaacagcaggcatttgaaggggcaaagaaaatcatcacttcagatttgctgctcatgagttacgacccggccaagccaatcgtcgtcgcagcggacgccagcaacaaaggactaggcgctacgatcagtcacacattcgccgatggcagcgaaaaagtcgtcgaacatgcgtctcaatcattgacgccagccgagcgcaattactcccaaattgagaaggaggctctggccatcatcttcgccgtacagaagtttcatcgcatgttgtatgggcgaaaatttagccttttaacggaccataagccgttaatcagcatttttgggtccaaaaacgggatccccatttacacagcgtctaggctccaacgctgggcattaattctgtcaaattatgatttcagcataaggtacatctcgacaaaaaattttggccaggccgatgtcctctcgcgactgatcaaacagcatcgcgacacacttcaagaggaggacaaagtcattgcttctgcacagatggcacaaaatttggactattccgagaacgctaacattgagttttgtgccgcagcagtcgactacatgtttcaaacaacaattgatcaactgccagtcacggccgacgaaatcgcagaacacattgaacgtgacgaagaaatgaaaaaggtcattgaacattgcaggaatggatggccaaaaacagcaaacgaattgaccatggcagcattttatacgcaccgactgcgaatcagtgaagtcaacggctgcctgctcatgggcgatcgcgtcatcatcccatctgcattgcgttttcgcattttgaaggcacttcatttcacccatcccggcatg

SEQ ID NO: 62384 - DNA, 203 bp, Heterodera glycines
  Genomic contig location: Contig_ID=SeqID_32071; Location=879..1081; Strand=+
  SCN-specific regions: Sequence locations=1-203
atggctgattttaataatgatacagtaagtgaagaataccaaaattaattttggcgagtaatttgttttttttagttttatttgacgttcaaagatgcaaatccaagctggtcgctcattgggtgcgcttcagtacttggattaatcgctttatttggaatcatttccaattcttctgtaatttatgtaaccattatgacaaa

SEQ ID NO: 62385 - DNA, 805 bp, Heterodera glycines
  Genomic contig location: Contig_ID=SeqID_6663; Location=1..805; Strand=-
  SCN-specific regions: Sequence locations=1-38,60-188,210-805
gcatttagtcgaactgcttagaaaactcattcagtttagggccacaaaataccctatttgggccgacatagaaaaggcttttctgatggtaagtctgaaagaatcggaccgtgaattttcaaaatttttgtgggtaaaaaatatatttgcaccactttctggggaaaatctcctcgttttccgctttcggaggataacatttggaatagtgtcttgcccttttctattggcagcgacactccaacatcatttggaagcatttcccagtgagttagcagaggaaatccgggaaaaatctctgctttacgttgataaccttctgcttttggctgattcgcctgaggaagcacgcagaaaggcagccgaagcacaaaaaattttcgccgcggctcaaatgcgtctgtgcgaattcattgcggctgatccgtcaagtttggacgaaatacctgaaaatgatcgcctccgaaatgaggcacctctcggactaaaatggactatttgtgaggacaatttgtctttgacttttcctacggttcctagtccggacggtttaacccggagttgcgtcattttttgaccccttagggttatgttcgccttgtttggttggggcgaaattgtttttccaaaaattatgggatggttcaaaaggctgggacgatccaatcccagcggaagagaccaaagaatgggatgaaattaaagccctctgggcggcaaaaacgatgcacatagcgcgcttcacgcctcgaattaacactggaaaagattcaattacatgttttcaccgatgcatcacctaatg

SEQ ID NO: 62386 - DNA, 2043 bp, Heterodera glycines
  Genomic contig location: Contig_ID=SeqID_6664; Location=2142..4184; Strand=+
  SCN-specific regions: Sequence locations=1-1268,1291-1811,1834-2043
atggcaatggagcgggggctcggagaagtcaagcgaatttttgaagggcattttgagaagggcatagccgaagcgggtgcagcacccgaggagcggcaggatttcttctatgattccattgccgcccctttgccagctgcaacgaaataccttcgactgcgggagcacccaactcccgccgaactccttcaaattgcggccgagcacctcggggatctgcgagcaatgcggcaaacattcgaggacgaagaaagggagagcatctcccgatcgagcagatcagtcgagaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagcggaacgggtggccacacccgtaatgtcaaacatggccgcgcttatccaacgacgctcaaatgctccctcggtggccagtgttcgtgtgaacaatccggtcagggagtggatggcaaggaaccaaggggtcgggaacggacccccggcacaggcccaacaaccaacacaagcgcaacgcccgctacaggccgtacagcaacgcctcgaacaacttacgctcaacgatccaagagccaatttccctcgggcagcacctcatttccatgtccgacgggaggaacctcccactcgggaccgtacccgagctcagggggtatttccttcacggcctcatcgcccagacgaatcagctggcatgttaacgacctttgaagcagtgcgcctacaaccgccgacattttcggggaggccggaggattggaccactttttgggcctacttccaacgggccgtggacgacaagcaaattcccggcttcgagaagcagcttcatctgctgcggtgcttaaaagaaggatcgccggcacggagagcggtggaagtgtacccaccgtcggatggtaattatccggtcgtggtgcagctgctgaaggaacgatttggggacacgaacgacttgcaaagagcgatccgagctcagcttctacacttgcagccagcaaaggacaacgtgtcgagcttgacggcagtgatcgacgaattcgagagaggagtgtgccagctcgaacaactgggagcgaacgtggacgacgagtcgttcggcccgttgttggaggccaaactcccggtccacatcctcacagaattgaggatccgggagagtacgatgggagcaaaatggacagtgcgagagtttcggaaagcggtgggagtgcaagtcaagtgcatgagggccgccgaatccgcgttggcagcaatgaaaggacccgaacgccgacatgagcagcgatcggagcccgaacgaggcggacggaacgcccgaacaggacaaggattccagcgggcatttatgatcagagatcagcccccggagaaacgaacgacgaacgaagcacacaccaggaccgaagtcgcgatgccacccactcgaccagcgaatccgaatcgtgtgccgctcgggagttactcccgaccgatgggagcgcattcccaaacacagaatggacaagaaggacaaccccgacaagggtgctcgttgtgtggacaaacgggacaccaaccaagccggtgtggcaaatatgggtcagcacaagccaaaaggaggagactgatcgagcaacgccgttgtctcaaatgcctgggatccgatcacaccgcgcagcagtgtacacggaaaaccgcctgccggacgtgcgaacaaatggatcaccactggctgatatgctggaagggggagagaaggaacgaaccccctagccactcgagaacggaagatgcacaacaaaatcggacgatgatcattcgggaaattgaagcgaagcacgtgcgcactccccctcccaccgagtccagcaaggacgggatgggggctaaaggggaggacccccctttgctcgacggagagcagagagcattcaccaccgtgggccagcaactcccggcctatttaatg

SEQ ID NO: 62387 - DNA, 348 bp, Heterodera glycines
  Genomic contig location: Contig_ID=SeqID_32073; Location=512..859; Strand=-
  SCN-specific regions: Sequence locations=1-63,104-138,160-163,186-348
atggaggggcagctgaagcgcaggaaaattttgaaaactttaatgcacttaataaagtgagtcaaattttaaaaaattttagcctttttttaaatttttatttcggcggagtggaaattccctgctctaatgtaatttaaaccaccataaaaaatacaagaccataaaaaatttaacagaactaattctttgaaattttgcagactaacagaggattcttgggacaatcgaatcatattaagatattttgtattaaaatttgggttcaactacaattttaagcgtggaactggcccccagggaagacgtggaactggcccccagggaagccgtttgtctgccaactga

SEQ ID NO: 62388 - DNA, 1351 bp, Heterodera glycines
  Genomic contig location: Contig_ID=SeqID_32074; Location=25..1375; Strand=-
  SCN-specific regions: Sequence locations=1-427,449-597,619-669,691 -704,726-993,1019-1177,1199-1351
ttccacttcaacaaatacacaaagaaatgacgggttaaaagctcccggaaaaagcggagaactgaataaaagggttaaacgctccctaaaaaagcaatttgaacaaattggtgactcaattgaattgaataaagatgaattggaagtcaatgattgtttgtttaagcgaagaaaagtagatagagaactgattaatttggatgaagtttcaaatgatttttttgttggaacatctaacaaacaaaatagtgatgtgaaattttatgaactcagtgattttaattttaaatgccttcactgtccagcagttcattttttggaagagaggaatacgtcaaaaattaatgttgaattcgggaattgttgtagttatggtaaattagcaaatttggaagaaacaattcctgaatatccgcatgaatttgaacttttatttgatcaaaataattttgataaaaaaacacacgagctttttatgaaaaacatacgattgtttaattcaagtttttcttgcgcatccttagggtgtatgagattttgttacccgaataaaaaaataccaatttttaaaattcaaggggctgtttatcactcatacaatactgctgcttttccagaaaatgaagatcttcctaccaatggacaattgtatttcattgatacagatcaatctttgaattatagaatgcaaatgtgtaatgaaaatccaaaagaaaaagagaaaatgggatttttaatgtcttacattgaaaattatttaagggaaaattacattttcgccaaatcttatgaaatgatgaaagacgtaattgagtcatcaaaaaaaacagaaaatgaatttgaaattcctgatgtgacaatgctttttagtgtaagagaaggggttgatttaagaagatataacattccaagatcgaatgaagtttgtgcagttttgtttagagatgcaaatgaagaaattcctgcggcaaacattgttgtccactcaaaaggacaaaaacaaattaaaaatatatatccgttagataaattagtcgaacccttaatttatcctattttttatccgaattattatgaaggatggcattataaattaaaagatcaaaaaggaaatccaatttctttatgtgattttacaaagtacaaattattttaccgaaatgaaggaaaatttttaccacatcattttgctcgaaaactatttcaacaatgggtggtcgatcaagctgctcggattgaatggaatcgtttaaattatataaaaatacaccaaaaggaaatctgtaaagaatcatatagtaacatcggaaaaatattagaaagtagagcaatagaagaaggaatttcttaa

SEQ ID NO: 62389 - DNA, 931 bp, Heterodera glycines
  Genomic contig location: Contig_ID=SeqID_32076; Location=391..1321; Strand=+
  SCN-specific regions: Sequence locations=1-192,215-521,543-685,707 -821,843-931
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttct

SEQ ID NO: 62390 - DNA, 85 bp, Heterodera glycines
  Genomic contig location: Contig_ID=SeqID_32077; Location=232..316; Strand=-
  SCN-specific regions: Sequence locations=1-85
atgcttccgaattgggaccccgtgcttcaggctttgttcgcctctctcttcacttggggtgtcactgctcttggcgcttctttgg

SEQ ID NO: 62391 - DNA, 350 bp, Heterodera glycines
  Genomic contig location: Contig_ID=SeqID_32079; Location=755..1104; Strand=+
  SCN-specific regions: Sequence locations=1-33,55-93,116-123,145-350
atgtccaccagtttttttgtatgccaacacggcaaggaaaaaggccaagggaagtttgttcaatggaatggacaaagtctgccgaattcggcaccaaatgggccccaatttgggcgtacactaaaaatgccattttttatgaaattatattgttaatccatttaattactgactttcccgcgtgaaatttgcaggattgcccaacaaattgaacatgctcagccatacgttcttcgcaatactcaaatggccttggaaaatgttcgcagaatcgtcgacggaagtgccaaaaatgcgagtttcatctaaatttgattgtagtaaggttatgtccaattcggttagcagta

SEQ ID NO: 62392 - DNA, 512 bp, Heterodera glycines
  Genomic contig location: Contig_ID=SeqID_32080; Location=158..669; Strand=-
  SCN-specific regions: Sequence locations=1-512
  Gene Ontology: Biological process=pronuclear envelope synthesis
gaacatcgacactgggcaccgcatcgcagaagaccgcagcggcaccggctggaggaacatcgccactgggcaccgcatcgcagaagaccgcagcggcaccggctggaggaacatcggcactgggcaccgcatcgcagaagaccgcagcggcaccggctggaggaacatcggcactgggcaccgcatcgcagaagaccgcagcggcaccggctggaggaacatcggcactgggcaccgcatcgcagaagaccgcagcggcaccggctggaggaacatcggcactgggcaccgcatcgcagaagaccgcagcggcaccggctggaggaacatcggcactgggcaccgcatcgcaaaatttgacatatgattttcctctggattacctgaacatgagttcgcagtggggaggcggacggccggtaaagccggcagcggcaccaaaggcgggacaggcaccacatggaggaggcggaccggcacagacaccaagtgaaaaaatgccgaaattttaa

SEQ ID NO: 62393 - DNA, 656 bp, Heterodera glycines
  Genomic contig location: Contig_ID=SeqID_6665; Location=3126..3781; Strand=+
  SCN-specific regions: Sequence locations=1-379,409-656
atgtcccttctccgtcctcaatcgctgcttcttctggccgctctttgcctgtcctttgcgctgctctttgtcacttcgtcggaagagggagggcgagtgaagcgcggcggatggccttgggattgggccggcaaacaactgtgcaaaacatcggcaaattgcaagtgcaagtgagtcgaagagagtaattgcgctaaaaatagtttggaatgggaataagggagggaatgggcgacgacgacgatggcacttcacttccctttttagggatggcaaaaattgggccaaatgtgtaaagtcggaaggctacgcggccagcaattgttgcgacaaaaattacgtgtgggcatgttgcgggaagaagcccaaacattaacgaggagagaagagaaagggagagaatgagaagcgagttcccataattcattctgttttggatttttagtctttttttctttttgggtttttttggtaaatattttctttagttattataaattgtttggcctaaattatgccattggaaaaaaatgtatttgttttctattacttttttctcttaactccttgggcctgtacgaaaaactttttttaattgctgctgtttaaattactttttgagttatttcatcttttttagcgcatttattttttag

SEQ ID NO: 62394 - DNA, 1559 bp, Heterodera glycines
  Genomic contig location: Contig_ID=SeqID_6665; Location=3018..4576; Strand=-
  SCN-specific regions: Sequence locations=1-647,681-681,703-715,743 -753,775-1043,1073-1559
  Gene Ontology: Mol. function=structural constituent of cytoskeleton; Cellular component=ribonucleoprotein complex; Biological process =epidermal differentiation
atgaagaacattctgctctcaattctcttggctcttctcgtcttttctgtgttggctgacgataaagcgcaaaaaacggaggacggacagaaaaagtcagtgacgcatcaacattaaacatacttttcggcatttgatttaggcaaaatttatttttcattttttaagccctgcgattgctcgtccaaaacgaggccacggctatgggtacaataattggggaggcaacggtggatatggatacggtggcggatggggcaacaacggtggatggggcaacggtggatggggcaacggtggatatggatacggtggcggatggggtaacaacggtggatggggcaacggtggatatggatacggtggcggatacggttacggttggaagtagagaatgattgatgcccatgctatttcatgatcatcatcaatgatgctaatgcattttataaagccgccaaatgggcaaaaatgaaaaaaaaacattttttattaaaagcataaaaaagttaagttctctgacaataagctattcacaaaaatgaataaactatttttgacttctttgattaaaaatgagctgcgcgtttgcgttgaattctaccgaaatccgttaaaatattttaggatttaggaccggaaacaccaaaattattcttaaaatttttaaaattatttttggttgcattttacagtttaaaagtcaattttcagtggtgtacatttttctttagaaattttcggcaaatggcaaaatttgacaataagaattttcaaaatttaggagttttgtacctaaaaaataaatgcgctaaaaaagatgaaataactcaaaaagtaatttaaacagcagcaattaaaaaaagtttttcgtacaggcccaaggagttaagagaaaaaagtaatagaaaacaaatacatttttttccaatggcataatttaggccaaacaatttataataactaaagaaaatatttaccaaaaaaacccaaaaagaaaaaaagactaaaaatccaaaacagaatgaattatgggaactcgcttctcattctctccctttctcttctctcctcgttaatgtttgggcttcttcccgcaacatgcccacacgtaatttttgtcgcaacaattgctggccgcgtagccttccgactttacacatttggcccaatttttgccatccctaaaaagggaagtgaagtgccatcgtcgtcgtcgcccattccctcccttattcccattccaaactatttttagcgcaattactctcttcgactcacttgcacttgcaatttgccgatgttttgcacagttgtttgccggcccaatcccaaggccatccgccgcgcttcactcgccctccctcttccgacgaagtgacaaagagcagcgcaaaggacaggcaaagagcggccagaagaagcagcgattgaggacggagaagggacattttgcggattggcagatgaagcgaatgatcggatggatggatggctttgcttttgagggaatgaatgcatttgcgcttcttttgcgattatttataaggccaaaaaag

SEQ ID NO: 62395 - DNA, 544 bp, Heterodera glycines
  Genomic contig location: Contig_ID=SeqID_6665; Location=2065..2608; Strand=+
  SCN-specific regions: Sequence locations=1-149,171-480,503-514
ttgcttcccttcgtcacaaatttaactttcgtttcgtttccttttccaaaatgaattggtgcgccgttttgtgctttttgcttctcatcgaagtcgcctttgtgccaattgtgaacagtgcgccactgtaagcactttctgtgcttaattgcctcttctatcccatttttgccttttccaaaaagtgagcgggaaaaacggctgactgccagccaattgggcaaaggcgccgtcgtcggtgccggcgtcggcttagtcggcgccgcactttacgccggcggcaaaaagttttggaacaaccgaaaagcaaatgctgcggcaggtaaaaaatggactgataaagcaaagaaaagtaattggaatttaagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaagttgagaatgttttaaaataagaaataaaaaaataaaaag

SEQ ID NO: 62396 - DNA, 381 bp, Heterodera glycines
  Genomic contig location: Contig_ID=SeqID_6666; Location=897..1277; Strand=-
  SCN-specific regions: Sequence locations=1-5,27-381
atgccaatggaaagaatgtgccgaaggaaaagggggaagcgacgtggagaagacatggccagaaacacatcagacggagaagtgaccagcgatggtgggatgccactggtaaagaagcgcatggtgacgaggcgacaagccatgaaagaggccacaacaaccgctgctcgtccccatcggatgaagcgatttccatcgccgacttcccccgttgcatttgtttcttctaatgatttgcttcaccagctcgatttcggcattgttagcattcagccgccacttttcagtttaaatgatgccgcaactttttctgttctgaaacgaatcggagaagagcaaaagctgtctttggaggaaaggaggttaatctcggacgattag

SEQ ID NO: 62397 - DNA, 981 bp, Heterodera glycines
  misc_feature (641)..(641): n is a, c, g, or t
  Genomic contig location: Contig_ID=SeqID_32084; Location=593..1573; Strand=+
  SCN-specific regions: Sequence locations=1-26,114-122,144-257,280 -525,559-981
atggacggggaagagaccacctccacggaggaagaggaggcggaagaagcggcgggtgaaacggaggaagagcatgaggaggaggaagaagaagaggaggacgaagaggaggatgacacgggggaggacattgacatgttgctcaactcgtccgaagggaacaaagcgtgagttttcaattacattccaaaaaacatttcgaacttaaaccgaaatgaacaaaattatagtaatataggaattaattacccatgcaattttttggtgaaatttcttttgcgattgtattttttggagagccgatgccattagttggcactttctcattatcggcctaattttgagggaaaatgttcgtttcagcttagaaattagtcaatattttccattaatttttggtttttgggtttatttgaaagcctcaatttattttaattaagtttaattattgatatgaaaatttgtttcagtggcttcgattccggttcaactgcatgtgtcgtactgctcttcaaagtgatttgtttactcttctttaaaaaataataaattttcaggacaaacttgtcgttgccaatattggggacagtcggtgagtgaaattttatggcatttgtttaaaggtaattaacttattattnctctcggttgtgttcaacagatgtgtgctttgtcgcgcgggaaaagccgttgaattgtcggccgaccataagccggaagatttgaaggagaaggaacgcattgaagcggcaggtatgcaaggcgctcagcaaattagtctatttttatgaccatatttattcgttgtaatattctttatttggcacaacattttcaggcggatccgtgagcgaagatggccgagttaacggaggtaatgagagcctttttatcaaaaatagagtaattggactgaaatttttgaagtcagtttgggaaaacccgttattattatttcatccgaaagaaccacattattga

SEQ ID NO: 62398 - DNA, 827 bp, Heterodera glycines
  Genomic contig location: Contig_ID=SeqID_32086; Location=154..980; Strand=+
  SCN-specific regions: Sequence locations=1-192,215-827
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgatttttt

SEQ ID NO: 62399 - DNA, 296 bp, Heterodera glycines
  Genomic contig location: Contig_ID=SeqID_32086; Location=1066..1361; Strand=+
  SCN-specific regions: Sequence locations=1-296
cggtctccccataaatctgggcgcatcggttcggggggactgccccgaaaacaaaaaaatcgattttttcaagtgtccgtttggggtactcaaacaattatgggaagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaacaattatggggagcaaaaatccaacgcagaattaaag

SEQ ID NO: 62400 - DNA, 360 bp, Heterodera glycines
  Genomic contig location: Contig_ID=SeqID_32087; Location=399..758; Strand=-
  SCN-specific regions: Sequence locations=1-1,24-258,281-360
acttcttccatcccaatgggccccgttcttccgtgcattggccaaaacaataaaaaggacgaagtgatgaaaaagaaggagaaaaatgacgagaaaatgaccttggaaacgaacaaaatggcgagtgaaaagcgaaaaaggccgccgagtttgtccgagaaaagttttccatacaacgccggactggagaagaacaaattgtttgtgaagaaattggattggtcgtgtacgggcgaggaactcaaagtaagtaagaaaaagggaaatggagtaagattatgctttttaagaaatttttcgagaaattcggaactgtagtggacgcgcgaattgtcaccaaatggaacggtcgctccgagg

SEQ ID NO: 62401 - DNA, 926 bp, Heterodera glycines
  Genomic contig location: Contig_ID=SeqID_32089; Location=80..1005; Strand=-
  SCN-specific regions: Sequence locations=1-132,157-188,214-238,264 -320,446-475,497-843,873-926
atgaccaacgaaaaagactctatttggttttattttgacaaaattcacaattcttcttatgccaaatgtaagattgagcttaataatcgcaaaaaacaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctaattcgaacactcaaatttgtagatctaacagacaatgggtaagacaaaagcctgttactatcccattttattatttctagggcttccatttttaagcataaaaaatcacgaatagacacctaaaaaaggctgaaaaaataacaaaattggcattaaatagacataaaaacccctcgaataggcataaaaataggcaaaatttttgtttttataacacaaaaaattaatcaaaaaacttattttggctatatttcactttttaaatgaattattaaaaattttaaagtttttcttcgaataaggataactctttaacaaaaaatattatcaaaaaataaa

SEQ ID NO: 62402 - DNA, 327 bp, Heterodera glycines
  Genomic contig location: Contig_ID=SeqID_32090; Location=283..609; Strand=+
  SCN-specific regions: Sequence locations=1-18,40-67,92-121,235-327
atgaaattatgcctaatattttctttaattttgtttttgctcattatatttgatcaaatcggagcagaaaagaaaaagctacaacaaaaaacatttgatgaaatatttggagaaaaatgggaggaaaaagaagaaaaagaaagaaatgagaagaaaaaaagagaaataatcagaaaattttataaaataaaagaaaaaataaagcaaaaagaaagaaaataaacaagaaaagaatgggataaaattgaaggaaaaatagcaaaaaaattgggaacaaatcgccaatatatttatgaatggatcaaagaatttggattaaatcagaga

SEQ ID NO: 62403 - DNA, 324 bp, Heterodera glycines
  Genomic contig location: Contig_ID=SeqID_32091; Location=379..702; Strand=-
  SCN-specific regions: Sequence locations=1-324
aaagcgcacggttgcgcacgggtgtttcccgcacgaacccatgcctatgggaggggcgcagccctttgatgttgccgccccgcacgaacccatgcctatgggaggggcgcagccctttgatgttgccgcccagaacccaaagcatatgggaggggcgcagccctttgatgttgccgccccgcacgaacccatgcctatgggaggggcgcagccctttgatgttgccgccccgcacgaacccaagcctatgggaggggtgcaatcctttgaagttgccgcccgtggacccatgcctatgggaggggtgcagccctttgatgttgc

SEQ ID NO: 62404 - DNA, 232 bp, Heterodera glycines
  Genomic contig location: Contig_ID=SeqID_6667; Location=675..906; Strand=-
  SCN-specific regions: Sequence locations=1-232
atggacggagggatcgcgtggccgggaatggcatgggtcacggagtgccacggggaaaagggggtcgaatcaggcacacatgcagggaaatcagcaacggcgtggcacggaagtgcagcagttggaaaaggagtcgaattgcacgggttgttaagttggcacaattcgaagggttttaacggtgcggaggaaatgccaaatgatcggccgaaggggcacactgaaatgggag

SEQ ID NO: 62405 - DNA, 566 bp, Heterodera glycines
  Genomic contig location: Contig_ID=SeqID_6667; Location=43..608; Strand=+
  SCN-specific regions: Sequence locations=1-230,252-353,376-385,407-566
  Gene Ontology: Mol. function=transcription factor activity; Cellular component=nucleus; Biological process=regulation of transcription, DNA-dependent
agcagtgaatcccttcccattggcagacaatggacaaattcaattgtggcaattccttttggaactgctctcaacgggcgattcgtgcattacgtgggaaggcacaaaaggtaatttagcaaaaaaacgaaggaaatgggaaaacattttgaggagaattcaaactgttgaagccggacgaagtggccaaaaagtggggagaacgcaaaaggtaaggcgaaaagagaaaaaatcagcaaacgaagggagagcaattaaatggaattgattcatctgttaggctttacggattcggcttaatcacccgccgtttcagcaagccgaacatgaattacgacaagttgagtcgcgcactgcgctattattatgacaaacagttcatgagcaaagtgcacggcaaaaggtacacgtacaaattcgacttggacacattggcaaaggcatgcgaagcggcggcggagggaccgaaagaaatgccaaaagaaggacgaaaagggacggcagaaacaatggcagaggacgaaagggcagcgaattggggagggacaaccgcaggtaaaaattaa

SEQ ID NO: 62406 - DNA, 306 bp, Heterodera glycines
  Genomic contig location: Contig_ID=SeqID_6667; Location=1322..1627; Strand=+
  SCN-specific regions: Sequence locations=1-306
atggaggtgaaatttgaggaggaagaagaagcggacggacgagtggcgatggcattggcattttgggcactgttaagctgctgttggacggagtggtgcagggaggacgagcgggacaaaaagctttgcccactcatgctttggttcattctcgcactgaaaaaagccaagaaaattaatccgaaaaacggagaaagtgattcaccgcagcttcgcctcgtgccaaatgtaaaaacggagatacaaagcgcggaaacagaggagggcactcagacagaaacagaacgccaaaagaatgccaattga

SEQ ID NO: 62407 - DNA, 1678 bp, Heterodera glycines
  Genomic contig location: Contig_ID=SeqID_6667; Location=1141..2818; Strand=-
  SCN-specific regions: Sequence locations=1-21,43-85,108-328,351 -471,495-819,848-1678
atggacagagacggtggaaaaggaggagacggagaaggaaaagagggagggactgaatggacaatgccaaatgggacgaaactgatcggagatgagcagagacagcacggaactgatcaaaaggagacgaaggacgaaagtgccaaaaatgtggcagcagcaacgaacgcgtcctctgctggagacgtaaaaccgactgatcggcccaaatggaagtcccttttagccgatcgaagtccgtccgtcatcccctcccactgatcagtctgccgatctccgccgtcgtgtccaattgcgcagtccgccggtgttttcttcgccccttttcgactcgccttttcttggctctgtccatccgtcgctctttcaactgaaggtcgtttctgagcactcaaactcgtcaaaattcctttttttgtccacactttcagcttaatcgtccatccccatcgatgccaatttcgacgaacggtgcccaaatgccacggccaaagtcaaggattcaagcggacggagagcaacttcggtttgaagtgttggtctcagaagtgcgtttagtttttgacaatttcggggactgggattgatactaattaggccaacaataatcattggccaattagcccatcaaatcatttggactgtttgattgacttttttgaggattccggcaattacacgtgtcgcgtgaatggtgctgtggttgtgcttcggctactcgttgaaaagcccgtcattgagctcagtgccgttgaaattggctctcattacgttgctttggcttggaatgactctttgaaggtcttttcttcccattgctattgcttttcttcattttccacctttgtcatcagattcgagctgctgagcgagtccatttgtcgttggaagtgcgcgatgcgatcacccaacagagacggaccatccaattgtcgctgcacaatccctggcgcagttacaacgtcgtccgtctccgtcccctcaccgtctgttttttttcttcccactttttctctgccctccaatgtctctccaatgagtgtattatttcagaattacactttctgtctggagtaccatctcgtccattttctacttcatttggctgattcgtcctcatccattttcaaaacttgcatcgacgttcaaacggaagaaccgctcggcttttggacttcgctaagtccgatttcaattggcattcttttggcgttctgtttctgtctgagtgccctcctctgtttccgcgctttgtatctccgtttttacatttggcacgaggcgaagctgcggtgaatcactttctccgtttttcggattaattttcttggcttttttcagtgcgagaatgaaccaaagcatgagtgggcaaagctttttgtcccgctcgtcctccctgcaccactccgtccaacagcagcttaacagtgcccaaaatgccaatgccatcgccactcgtccgtccgcttcttcttcctcctcaaatttcacctccatttgggaagaacggagttcgccagcccaatgtcttcaaacaccgggaaacgagaaaagaataaaaaagaaacgaaaggacaaaacaacggcacttcggctgggggcgaagaaatcggcggacaacgatgcccgaggggacggagaagggatgggcgtggcggaaagcatcgtcctttgctga

SEQ ID NO: 62408 - DNA, 303 bp, Heterodera glycines
  Genomic contig location: Contig_ID=SeqID_6667; Location=4028..4330; Strand=+
  SCN-specific regions: Sequence locations=1-303
atggctaaggtccaattcttcaattgccggactgaagcgcagaatatgttcactgatagtctaaaaaaggcaaaaaacggtgaaaagattagggaaaagggaaaagccaaccaaaaggcaattagcgctgagggaaaggcgccgcaggcgaaacagtcgaaaggcctcccattcgacgctaacgatgcgattggtgttcaggcgaatttcttcggcattcggaaaggcaatgaaactgtgccgggaaatactctgagagagaagagtgatcggagtttaaacatccaaagttaccgtaattaa

SEQ ID NO: 62409 - DNA, 204 bp, Heterodera glycines
  Genomic contig location: Contig_ID=SeqID_6668; Location=136..339; Strand=+
  SCN-specific regions: Sequence locations=1-123,147-152,174-204
gcattaaaaacgcaatcggaaaatgccaggaagtgaccgatggccaatccgaacaaataaatgcggagagaattgataaaacaacgtcgaggcgaaattcgcaatttgaggacgaagaaagagaaaatgaacaagaaataagaaaggcacttctgccaaaagcacaacagaaagacatttatttatccgaaatttaattaaaaa

SEQ ID NO: 62410 - DNA, 1275 bp, Heterodera glycines
  Genomic contig location: Contig_ID=SeqID_32092; Location=11..1285; Strand=-
  SCN-specific regions: Sequence locations=1-5,27-156,178-589,619 -674,696-1184,1210-1254
atgactgacatttattataaaatagcctcctttgaccattcctacttgaataaaattaatcaatctgaattattctcaatgattgatgaaattgttgaaaattttcaactttgtaatgtagaagaaacgaggtcattatcgagatgggtatactgtatgcttttggttttgttgtggatagctcttgttatgacaggaattttcctctattttaattcattaattagaaatttatgtaagcttatgcatatatgtagagacgaaaatggacacaacgacgataaatcggattctagcgggaaacacaaagaccagagaactctacttgggatgcttcccttgcgacaaactcccaaacataatcaacaagtacccttcaacattggtggcgaataatgatccttcgaataaggaaggaacgcattggatagcaatgttcatcgttgacgataggaccgtctactattttgatagttttggtaggaaaccgaacagatgtatcagccagtttttacggaattatgaaaaagtgatttcgaataagccagctattcagtcagtgttcagtgagaattgcggttattattgcatttattttatttattgtatgtgctcattaggaggaagaaattatgagagtaattttgaaaaaatgacaaaaaagttaataggataagataatccagatttgtttgtcgtgaattttgttaaaaaaatgataaaaactatttaaggaatttatcattaactcatttataaaaatggaccgtttagacacaataattgcttctcttctgaactgtcccgcacgtaacttgtgcgactgcttaaatcacccggatgagatacaaaaagtagaaaaatacctcaaagggaaaactctacagacaacatacaaaaatcaactagatgaatacaaagattttgagtacggtggaattacaagagaaagtgcccgtaagcaaatggcttacaatggtttcaagaatgtgaccgtcgaccagcatttttatgtacggcaccgcatttgtcttcgctacgctaataatccttgcgtgattgagaagcgatagaaatggacacgaacgattctacccacttgagcttgtgaaagtgaaacacggagacgaaagcgatatttatttgggacaaaatttcccaaagtcaatacctttacttgacgaaaataattcaaaatataatgacaatcattatgattcttgtcgcttatggtgaatatttaaaattgcagataatttgataaaattgattaaa

SEQ ID NO: 62411 - DNA, 568 bp, Heterodera glycines
  Genomic contig location: Contig_ID=SeqID_32092; Location=1..568; Strand=+
  SCN-specific regions: Sequence locations=1-4,32-76,102-568
tgattttgtatttaatcaattttatcaaattatctgcaattttaaatattcaccataagcgacaagaatcataatgattgtcattatattttgaattattttcgtcaagtaaaggtattgactttgggaaattttgtcccaaataaatatcgctttcgtctccgtgtttcactttcacaagctcaagtgggtagaatcgttcgtgtccatttctatcgcttctcaatcacgcaaggattattagcgtagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagttttccctttgaggtatttttctactttttgtatctcatccgggtgatttaagcagtcgcacaagttacgtgcgggacagttcagaagagaagcaattattgtgtctaaacggtccatttttataaatgagttaatgataaattccttaaatagtttttatc

SEQ ID NO: 62412 - DNA, 268 bp, Heterodera glycines
  Genomic contig location: Contig_ID=SeqID_32095; Location=1..268; Strand=-
  SCN-specific regions: Sequence locations=1-268
gtttagattaaaggatgagaagtgggcaaggggctaaagaaccagacaaaatttaatggtcacaaatcgattggccggcggaaggctttgggagaacgacgacggctgacgcacctttttgagggggaggcacagacagaaggaaatgtgagagacatgcacactctatgaatccactcgacggcgcgctgtcagaaatgggattgtgcgagaaaagaaagaagctcaaaacaatgggcagatggttttcatttatttgggcagtgat

SEQ ID NO: 62413 - DNA, 406 bp, Heterodera glycines
  Genomic contig location: Contig_ID=SeqID_32097; Location=186..591; Strand=-
  SCN-specific regions: Sequence locations=1-381,403-406
  Gene Ontology: Mol. function=protein serine/threonine kinase activity; Cellular component=nucleus; Biological process=protein modification
atgacttccgcttctcaatatgtgcgggataaagcaaacagaacgcgcttgtcaatcgaaagttattatgcccaagcggtggtccatttggccgaacgagaacaacgtgcagaaaagctcgaaaaacaaatggcggaggaagggctaaacgagttagaaaaggaggacaggaggaaaatccacgctgccaaagaaaacgactttttgcgacagcgaagaacaaaactttcagcgaatgattttcaatccttaaaggttaatcaaattcttgttctctttgcatattgctttgtaggtgattggtagaggcgcatttggtgaagtcagacttgtgcagaaaattgatactggtcacatttatgcaatgaaaattttgaggaagtccgaaatgttggagaaggaacaa

SEQ ID NO: 62414 - DNA, 321 bp, Heterodera glycines
  Genomic contig location: Contig_ID=SeqID_32098; Location=604..924; Strand=-
  SCN-specific regions: Sequence locations=1-321
ttgcttgacccggaagcgagacaacgcgaggtttaccaggccggctacaaagacccgaacgcgccgaaaccgatgcgcgtgtgcgaagtgtgcggaagttttttgatcattggcgatgttcagcagcggtaaaaaacctcattttgtttatgttgcaattattttgaattaagcattgatgaccacatgcaggggagacaacacctcggatatgcaaaaatcactgccactttggcggaattgaaggtatttaatcttaatgttatgtggagaaatgcttggatttattattttggaaaggatttgtatcattcattttaa

SEQ ID NO: 62415 - DNA, 467 bp, Heterodera glycines
  Genomic contig location: Contig_ID=SeqID_32100; Location=1031..1497; Strand=-
  SCN-specific regions: Sequence locations=1-467
acatttctccgtgccaccacttcagtcagttaccaaatgaatttcaaattgaacaattcaacgcaaattgagctatttgaattggtgaacgaacggactaatgagaaactgacactgattatggatgacggtgaagtcattaattattatgggatgttgaagcgatgtccaataattgttggggagatggcggcggcggttcaatgggaaaacgacgaacatttggatgacaatttgaacagtgtccaattttttttgtgggatatcgcagttaatttcattgggtaagtgtaaaagataggtaattcattcaccaaattcaaattgtatttaattttaggccattgtcgcccccagcggacgaagaagaaaaagcgggtcaaagcaacgatgaaatgttctcgacgactcccggggccaagtggaacagcggcggaatgagtgattattttgaaaatgtcgtctaa

SEQ ID NO: 62416 - DNA, 59 bp, Heterodera glycines
  misc_feature (6)..(6): n is a, c, g, or t
  Genomic contig location: Contig_ID=SeqID_32101; Location=38..96; Strand=-
  SCN-specific regions: Sequence locations=1-59
aacatntgccttctctagtctggctctaccaaacactcacacgatatttgaaatgctaa

SEQ ID NO: 62417 - DNA, 59 bp, Heterodera glycines; identical to SEQ ID NO: 52421
  Genomic contig location: Contig_ID=SeqID_32101; Location=168..226; Strand=-
  SCN-specific regions: Sequence locations=1-59

SEQ ID NO: 62418 - DNA, 59 bp, Heterodera glycines
  Genomic contig location: Contig_ID=SeqID_32101; Location=336..394; Strand=-
  SCN-specific regions: Sequence locations=1-59
aacattttccttctctagtctggctctaccaaacactcacacgatatatgtaatgctaa

SEQ ID NO: 62419 - DNA, 59 bp, Heterodera glycines; identical to SEQ ID NO: 52421
  Genomic contig location: Contig_ID=SeqID_32101; Location=466..524; Strand=-
  SCN-specific regions: Sequence locations=1-59

SEQ ID NO: 62420 - DNA, 59 bp, Heterodera glycines; identical to SEQ ID NO: 52421
  Genomic contig location: Contig_ID=SeqID_32101; Location=596..654; Strand=-
  SCN-specific regions: Sequence locations=1-59

SEQ ID NO: 62421 - DNA, 59 bp, Heterodera glycines; identical to SEQ ID NO: 52421
  Genomic contig location: Contig_ID=SeqID_32101; Location=726..784; Strand=-
  SCN-specific regions: Sequence locations=1-59

SEQ ID NO: 62422 - DNA, 59 bp, Heterodera glycines; identical to SEQ ID NO: 52421
  Genomic contig location: Contig_ID=SeqID_32101; Location=856..914; Strand=-
  SCN-specific regions: Sequence locations=1-59

SEQ ID NO: 62423 - DNA, 59 bp, Heterodera glycines; identical to SEQ ID NO: 52421
  Genomic contig location: Contig_ID=SeqID_32101; Location=986..1044; Strand=-
  SCN-specific regions: Sequence locations=1-59

SEQ ID NO: 62424 - DNA, 59 bp, Heterodera glycines; identical to SEQ ID NO: 52421
  Genomic contig location: Contig_ID=SeqID_32101; Location=1116..1174; Strand=-
  SCN-specific regions: Sequence locations=1-59

SEQ ID NO: 62425 - DNA, 199 bp, Heterodera glycines
  Genomic contig location: Contig_ID=SeqID_6669; Location=143..341; Strand=+
  SCN-specific regions: Sequence locations=1-74,118-199
aattaatccagataaacaattctaacttacgtcgaattaaactaatttcacgtttaaaaaatagaagaacagtctaaaaaagaaaaaaaactaaaaattttacttatttataaaaaacaacaccgatgtaaaaaaatcctgttaactctagagaaattttaaaaaaccaaaaagggtcagaaaaaaataaaaaatttta

SEQ ID NO: 62426 - DNA, 1877 bp, Heterodera glycines
  Genomic contig location: Contig_ID=SeqID_6670; Location=920..2796; Strand=-
  SCN-specific regions: Sequence locations=1-470,492-570,592-1422,1444 -1877
atgacgctgaacacaattccgaatttggacggcagtagaggctccgattcggtgaacgccattttcaagcaatttgatattgcgactgaagaatggcctgaacagaagcgagttcgggcgctgcgttccaaatgttttggcaaagctgagagagctttcaattccgcggttgctgaaaatcgccatgactaccaactgatcagaacatcgatcattcggcaattggacgacacggacgccaaacaattgacggcgtttgaccaactgatgaaaggagtttggcttcggccgaatgaaggcattgatcagcttggcgaacgtgtttcgcgcttggtccgttgtgcatatccggggctcagcgaacagctctacgacgaatattcggccatgcatttcattagggcactccctaactcagaattggcaatgaatttggagatgactcgtaaaccgggtgcaacattcgatgagttcatcgcacaagcagcacgagccgaggcagttcaaaatgccgcacgaaattcttggcgaaacagccaaaacaacggctgtttccaaaaccaacgaaggcatattgtttgctataattgtggccgagtcggacacacttctcgaaattgctattcacagccgacacatcagacgcatcagatcagtaaaaactgcaatctccagtcgacaccaccaccactattgaatcaacaaaatgacgaaccgccgaaaaagggaaatttgttagttggcgccataaacttggaacaccgtcccgagattgagaaattcttcggaaaagcaacgaatgagtcggataagggtcgatttttggaagaaagcccggcggttggtataattttgacgaccaaagtttcggtgtttggacgtaagttggatgccatgctggacggcggatcccaaatttcactgatttcggccaaatttttctctcaaatcatggataaagttagcaaaaaggatgtgatctcccgctccgaaagtcaagtcatcgacataaacggaaaggaagtgaagtgctatggaattgtttctctgccaattgagcgcgggcctttaaacacgaaaattcgtgtattcgtcgcagagtcatgttttgggtacgatttgattttcggcacgaatgccttgaatcaattgggcttaaaaatgctcgatgtagtgaacaacaacatcgtacacttcacaccagcttcgaagcccgaaaattcgcctttaatcgttttcaaaacatttgtgtcccatgacaagatcagatacgatagaaagatgtgatcaaaagtcaaattgttgttgatggccaaaatttggacaaaacaccgcgaaactttggagggaagagaaaggacgagtcgggcccaaaaaatggcactaagacgaagaaacataataagaaacatcggcaacagaagcacacaactgtggagaaaacgacaattcaaaatgccacagagaatttaggagagcggaagaagcagcgacagcggaaggaaaacggcgaaattgcttgggcgataaagcgcgtttggagacggaaaattttggaccaatttcagttggggacaactgaaaatttgggtagggggaaggccagcccaacaacggcttcgtcggcaaatgggaggttggatctatgcgatcgccgccctgactctcgtccccaatcatcattccatcgcggcgagactaacaccaaatttggccaaagaattttttatcgtggaggaaaatgccgtaaagagcccgatcgtggaatgctaggagacggacgccggcacaagctgaactcgcccaccacctattggatgcgaatgagcataaaaggcaggggacgcctttttctcggagggtcgggatgtgttaat

SEQ ID NO: 62427 - DNA, 460 bp, Heterodera glycines
  Genomic contig location: Contig_ID=SeqID_6670; Location=4295..4754; Strand=-
  SCN-specific regions: Sequence locations=1-50,72-94,131-161,183 -189,211-284,336-460
atggaaaacagaagcaatttgcgaaagaattgggcattcacagaaaaacattcagaaaatggaaaaaagaatttggcatcgaaattggcaaaagtaaaattattaatttaaaattttttttgaaaaatttctcttttcagaagcaaatgcctattcaaatgaagaaaaaacagtcaaaatgaatttgtattataaaaagaagaaagaaaatccttctctaagtgacaaagaaattgccagatttttggaaatcggaagcagcactctaaaaagatggaaaaaggaaaaaaatttcatattttaaatattaattttcaaatctttattttattattgaaggataggaatcggtactcaacagaagaagaaaaaaaaattgagcaagatgagcacaaaacgccaaaatagttgaaaatagtttttttcaaaattttatagttttttagttgctaaaaataaa

SEQ ID NO: 62428 - DNA, 1404 bp, Heterodera glycines
  Genomic contig location: Contig_ID=SeqID_32102; Location=1..1404; Strand=-
  SCN-specific regions: Sequence locations=1-15,38-38,92-97,123-128,150- 219,243-276,298-373,395-491,516-536,602-1332,1372-1404
  Gene Ontology: Mol. function=GTPase activity; Cellular component =nucleolus; Biological process=signal transduction
atgcgtatgcgagaggaggaagaggaacatgaggaggaggcgccgccgggggacgaggcgccgccggggggcgaggccccgcccccgccggaggacgaggaggacgcggaaaatgacggcgggccgggcccgcagcaggcgcagccccagaaaaaacctttgccggattttatcgttcaggaggaccctcgagacggtgccaattagcggcgacgaaaaacttatttcttttttgctgatttgttctgcacatttattcaagctgttctattgtttcatcaaaaatttattggaaaataaaatatgaactctaaaaattgaagattttttctgggactgtaaaggtcgcccgaaaaaacgcaaaataagaaagttttaatttttggctttttgttcggggttcgaattctattcatgatcagtgactaggactagcggcccctaaaattacataaacactttttatgactaaatttaaaaaaaatcgaaaatctaccatgaaatcctccccctaacaaataggcatagaagtactgaaaatttttttttttgcttatatacaatttaaataattttgattttattgttagttaaattttttgtttgccagaattatgacgaaacgacgacacaaaacatgtgagctgactgggttcaacgccgggctggccaaggcgttgttgaacagcaaagcacgcgcacaaacacacagcacaggacggggaaggagtgcaagacaatcggtgggacatacggccacgcaaaagccgctgctcgagtcgaaaacgcacgagtcggacgtgcaggaactgctcaccaacgcggagttggccaattcgacatttgaggcggaacgcggggacatcaaattgttgtccgggttggcattcacccttttttgttctcaacttctcatactgtttgttcttggcacaatttcagcaatggcaatgtggcaatttcttccacaaaacaaatggatttggccaattcgcttgaccgattgaacgccgattatggtcatttgttgcgaatcccgcgtcgtcctcggcccaacacttacgaagatgcagaacagctgaacgcgttggaagccgaggaatttgttgcttggcgtcgacaattggccaaactgagcgaggttagctttgatgggttggcatttaatttctggaaatggcctgctccaatgatatgtcgtattgttagtattgtaaatatcaagtaatatcaatggtatttttgtcccaattttagcgtaatattgtgatcacaccctttgaacgtaatttggaaatttggcgtcagttgtggcgagtcgtggagcgaagtcatttggttgttcaggtcaatttttattttaaagggcattttatcacttaccaaattctgtttttgctactg

SEQ ID NO: 62429 - DNA, 356 bp, Heterodera glycines
  Genomic contig location: Contig_ID=SeqID_32106; Location=678..1033; Strand=+
  SCN-specific regions: Sequence locations=1-286,311-356
atgccgcgttatttatttgcattttacggtggacgagcagtagccgaaccaaagggcacagagcgaagcccaactcggaaaaacgcactgctgcaacccgcagaggcccacaacgatgttgaggacgaagaacggagtccaacagatgaaaaaggaagagaacacgacgatgagcacctcaaaggggccgactcattgccagcctaattaccccctaatactcaccctcgtcgccttttgttccgatgccaattccgccgtccgttttgccctcccccggcggactctgcgccggcggcgctgccgcgcgttcgccgtttgcgaatcgccgctgatacttccggatgattttcgca

SEQ ID NO: 62430 - DNA, 264 bp, Heterodera glycines
  Genomic contig location: Contig_ID=SeqID_32108; Location=5..268; Strand=-
  SCN-specific regions: Sequence locations=1-52,86-264
atgtgtttaaaatatgtgtgtggtgaattattggtgggttactcggctcgctctccccttattccttctcctcttcctcctcctcacaatcggcagcaaagagttggttggggtcagcgaacactgccgaggctgagaatgccaatgcctgatcccgaatgtaacgggcacggcgaaagcacttgtccagcggagacaccgtgtcaccgccttccatttctgtgccaaggagaaaaattagggaatggcatggaaaaaaattaa

SEQ ID NO: 62431 - DNA, 146 bp, Heterodera glycines
  Genomic contig location: Contig_ID=SeqID_32108; Location=516..661; Strand=+
  SCN-specific regions: Sequence locations=1-79,113-146
atggctatctatttttttgagaaattttctatgcaacaaacgctctcgaacatgaaacgaagtgcggtgcgccgtggccattttatttttcaaataatttttaaatttaattgatattccagaaaaatggctatctctttttttga

SEQ ID NO: 62432 - DNA, 146 bp, Heterodera glycines
  Genomic contig location: Contig_ID=SeqID_32108; Location=768..913; Strand=+
  SCN-specific regions: Sequence locations=1-79,113-146
atggctatctctttttttgagaaattttctatgcaacaaacgctctcgaacatgaaacgaagtgcggtgcgccgtggccattttatttttcaaataatttttaaatttaatagatattccagaaaaatggctatctatttttttga

SEQ ID NO: 62433 - DNA, 344 bp, Heterodera glycines
  Genomic contig location: Contig_ID=SeqID_32108; Location=1020..1363; Strand=+
  SCN-specific regions: Sequence locations=1-79,113-203,237-344
atggctatctatttttttgagaaattttctatgcaacaaacgctctcgaacatgaaacgaagtgcggtgcgccgtggccattttatttttcaaataatttttaaatttaatacatattccagaaaaatggctctctttttttgagaaattttctatgcaacaaacgctctcgaacatgaaacgaagtgcggtgcgccgtggccattttatttttcaaataatttttaaaattaatagatattccagaaaaatggctatctatttttttgagaattttctatgcaacaaacgctctcggacatgaaacgaagtgcggtgcgccgtggccattttattttcaataa

SEQ ID NO: 62434 - DNA, 1323 bp, Heterodera glycines
  Genomic contig location: Contig_ID=SeqID_32109; Location=204..1526; Strand=-
  SCN-specific regions: Sequence locations=1-114,152-172,194-309,341 -508,530-737,761-783,1047-1286,1313-1323
acagtctagacccatgtgatgaatacggcgcagattgcgtgccgatcagaaatttgttgttgaaaattgaggcattggcaaactgtggaaagaacgaaagcgaaaacaatgcggtaaaataaaaatttaaaataatatttaaaaataatttcagattttcaaaaagccagactgggccccacttccgccagaaatgccatggaaaaagccatccgaaacattaatatgcgatggggacatggcatgtgacaaacaaacgctgcgagaacagtacaacagattgagggagagtgagttaaatttaacaaataattaattaattaagtaattaaattaattacaaatccaaattaaaattcacagtttgtgggcttaagcccgaagaaatagaaagtcagcggaaaaaacgacaatacaacgcacgccaaaaatggaccgaatccccgatcaaaatcacattcgacgaaagagctcgtaataattttaccataatagtgtagtttatcaaatgttttaagtaggtttacacgggtccgggtattgccgggtccagaaaagccggctccgggtattgccgggtccggatagtagccgggtccagaaaagccgggtccgggtattgccgggtccagaaaagccgtgtccagaaaagccgggtccgggtatttccaggccagggtatcgggtcctaaaagaatccaaaaaaaaattccattttttcattaagaaatgcttatacttttaaaaaagcatgaaaaatattcgggaccagcaggggcggtcttataatttgtatttgtaaattaaattattaataaatttttataagctatatatattaataaaattataatttttataatatacatattaataaaattataattttgtattcgtaaattaaattataataaatttttataatatacatattaataaaattataattttgtattcgtaaattaaattattaatacatttttataagctatatatattaataaattataatttttataatatacatattaataaaattataatttgtgtattcgtaaattaaattataccgagttcaggtcgggtcttgaaaaaaccgggcatccgggtctgagacccggtcgggttccggactcgtgtaaccctagttttaattgcttgattattaattaattgtttagtgccaaaggacgggtaccaacaatggaaggatgcgataggaattggtgccgctttgataatgtgagaatgattttttaagtttggtcgattcttagggggcgggtgtatttttggtttttcttattcatttcagttaataaa

SEQ ID NO: 62435 - DNA, 110 bp, Heterodera glycines
  Genomic contig location: Contig_ID=SeqID_6672; Location=263..372; Strand=-
  SCN-specific regions: Sequence locations=1-110
atggcggtacgaaaacggcggtacgaaaatggcggtacgaaaacagcggtacgaaaatggcggtacgaaaacgtcctggcccgcaacattcactatgggtaccgaaacgg

SEQ ID NO: 62436 - DNA, 66 bp, Heterodera glycines; identical to SEQ ID NO: 53774
  Genomic contig location: Contig_ID=SeqID_6673; Location=346..411; Strand=-
  SCN-specific regions: Sequence locations=1-66

SEQ ID NO: 62437 - DNA, 520 bp, Heterodera glycines
  Genomic contig location: Contig_ID=SeqID_6674; Location=432..951; Strand=-
  SCN-specific regions: Sequence locations=1-26,48-356,379-471,515-520
atgcaggtgaaaatttattgaaattttggataattttttaacaaatttttgttcaaaaatgatcacttttgcgtcataacgccaaatagcataaatggcgtagttttttgcgcgcaaattcaaaaaatatactgctaaatgccttttttgtattgtttattttgatgatctggcataactcgcttaatttccagctaaactgaacaaatttgatattaaaaaagattttgaaatggagaatctttttcaaagcaaatgctaagaaatttaacatttcagaaaaaatttgtgggagtttcaaactttcattacgtaataactagagctgccttttttttctgcgcattagtttcgatatattaagcataaacaacacattttccacttggtttgaggcttctacgttgacttttattattagggctgcaaaaaatatgtacaaaaagtggtctaaatatgtacataaatatgtaagaaaaattccaaaatatgtacaaaaaaccccaaatatgtaaataaa

SEQ ID NO: 62438 - DNA, 84 bp, Heterodera glycines
  Genomic contig location: Contig_ID=SeqID_6674; Location=537..620; Strand=+
  SCN-specific regions: Sequence locations=1-37,60-84
ataaaagtcaacgtagaagcctcaaaccaagtggaaaatgtgttgtttatgcttaatatatcgaaactaatgcgcagaaaaaaa

SEQ ID NO: 62439 - DNA, 271 bp, Heterodera glycines
  Genomic contig location: Contig_ID=SeqID_6674; Location=1600..1870; Strand=-
  SCN-specific regions: Sequence locations=1-179,201-271
atggtgggcggatgttggtcggccaaattcaacggcgatgagcacagtgtgtgatcacaacagctcacagagatttgtcaggcctcggttggcattgttcgaatgatgtccgagtcgcccgggtcagtgatggacagcatggacactcggaacagtttgccgcaagcggtgcccagctcgatgttgttgccatggtactcgtgcacgcccgtctttgacagcatggcgtagtattcaacttcactgcgtctaaaggccatgaacaaataaa

SEQ ID NO: 62440 - DNA, 67 bp, Heterodera glycines
  misc_feature (11)..(11): n is a, c, g, or t
  Genomic contig location: Contig_ID=SeqID_32114; Location=1..67; Strand=+
  SCN-specific regions: Sequence locations=1-67
gatgaaagtgncaatgcgtcggatggccaagcggtgaccaaatggctgttgacgcctcgtccggatg

SEQ ID NO: 62441 - DNA, 73 bp, Heterodera glycines
  misc_feature (11)..(11): n is a, c, g, or t
  misc_feature (63)..(63): n is a, c, g, or t
  Genomic contig location: Contig_ID=SeqID_32116; Location=367..439; Strand=+
  SCN-specific regions: Sequence locations=1-16,38-73
aattactggangtagcatcatagcagtgcttttcttgtcttttgatgccctcgcaaatctggntcgcttctga

SEQ ID NO: 62442 - DNA, 135 bp, Heterodera glycines
  Genomic contig location: Contig_ID=SeqID_32118; Location=281..415; Strand=+
  SCN-specific regions: Sequence locations=1-135
atgcgcaaaggcaaaattcaaacacaacagcacgaagtacacatgcgcatgggattacgtacggacatcgccaaggggagggatcggctgctgttatccgtccgtggaaagctgcgaaaatctgcgcagcatggg

SEQ ID NO: 62443 - DNA, 176 bp, Heterodera glycines
  Genomic contig location: Contig_ID=SeqID_32119; Location=1039..1214; Strand=-
  SCN-specific regions: Sequence locations=56-176
atttttactttaaataaatttaaatttttttaaattttttgaatttttaaaatttcccggttggtccaggttcccggtcccggacaaaaatcgaggtcccggtcccggcttctctggtcccggcaagtcccggtcccggttttgctcaaaattcccggtcccgctctactctagta

SEQ ID NO: 62444 - DNA, 2433 bp, Heterodera glycines
  Genomic contig location: Contig_ID=SeqID_832; Location=1195..3627; Strand=-
  SCN-specific regions: Sequence locations=1-192,225-896,918-1134,1161 -2433
gctctgcccgtgttttacttcgtctcttcggttggtcccttttccacgtccgcgtctccttcgccttctccgtcgtcatcgccggttccttcgctctttggcttcataaacagcaggtagacgaacgcgccggtgaagatgaccagcggaatcagcaaaatgatgctgagcgtattaaatgggcctcctggttcttctttgccattcttctccttgtcttttgctgccagtgacacatcgaacgcacagatgagcagcaccagcactgagcacacacagcggagcgaaaggggccggcggaacggagttgggctgacgacgctcttcatcggtgtgttggtgaagaatttgcttgtttgtcgaggccgtttctgaacacaaatggaggggatgtaaaaagaagacaaaaaaacacacgaaaaaaaagagaaaaaactcacaaaaatgttgcagtgggtgcacttcgaaatgggcaaatggtagtagcgaaggtgaaaaggatgaaaacgcatccccttatatatcaaatgaaatttggcaaaatgttgggtttaagaattgtcgtggctgagattgtataaaaggaacgggcattcgcattttcgctcacttcccaataataaaataatctcaacgacgataattgcgcaacaccttcaaccgatacatcttccacacacgtcaacttcgaccgcgcttgttctccaatcaaccaaatgagcttcttcttctacctgatcgttgctgcggcactgttcggcggtggaatggtgcgtttgctcattccaaatctgttgttccatcaatcattttaacggttttgttttcccttttcagttcgttggcatgtcacttggcggcaaaaagtcatcggatggagcgagcggcggcggggccaagaaggagaagaagcacaaaggatcgaagagctccagcagtgagaagagccaatgatgccgccgcagtacacgaggacggacgaacgatggaatggccgacaacagttcccctcccaaaccgatgctatccccaaaatatatgttgttacccctatcatttgtgttttatcactctgtaagcaaattttgcgctttccataccagcgatcatattgttctaattgtattgatgtgttatatatgtgtacacatgtatttatgtatggtccaatgtaactccgtttcatattgtatgtaaaatgtgaacaataaattgtagttttgatggtaattgtgacacttgtatgggtaatactatagatggtaccccccccccccctttttgaagaaacattttttggcgctatattgaaagtggccctttttgaaaattttttcaaaaggggggacccttttgttttgcaaatttttttttgtgatagtcataaaaatttattctggggtttttggggtccccgatcacgaatccttcaattattttgatcaattccgatttcctaatctgaatttgaacaaaaaatcataatttgaaaaattcaaaattccgatttttattcgagttcgggttagggattagaaattagtcaaaatacatgtcagattcgtgattagcgaccaaaagtcttggaaacatgtttatggggggttttcgaggtcgctgattacgaatatgcgatagtgagatccgaatcgaaaattttcaacgcagaaatgtatttttgagcttctttcttcgaaacaattgagcaaaaaaaattagttaaatcactaaaagtagcgaccctaataatttccattaaatttaattgttaaaacgaacatttgaaaggacgtggacgttgccgctgcaaatccaattactggctactcaaatttaatgtgaatttatatgatgtcatatattttgggatatcattttagctaatctgtttgacacaaacttccccaaaggtacactttccacttttacaccggcactcacacagtttctggcctcggggcaaaactcaagacggcctacacaaaaagtggttcttggggtcataatatttaaaaaaacaatatttgcactaattgccaggtctgcccatttttctgactgagtacggcgcgtgcgaatcgtccggcgacggcacaattgcgaccagctccatgaacgaatggtggtcctttttggacggctacaaaatctcctactgtaactggtccgtctgtaacaagggcgagtcgtgttcggcattgaccaccagcgcatcggcgagcaatgtgaggaaaaatgaaatgtgaagccaaaaaacggaaaggaaatgatggccaccaatggccgagactgtattcgaccaattgcatttctcgaaatggaaacattccaaatttttgtaattttatttaggtcggttcctcttcctactggacaacctcaggaaaactgatccaagcttactacaaggagcaaagcaacggcaagtttttt

SEQ ID NO: 62445 - DNA, 796 bp, Heterodera glycines
  Genomic contig location: Contig_ID=SeqID_832; Location=3299..4094; Strand=+
  SCN-specific regions: Sequence locations=1-105,138-484,506-543,566-796
  Gene Ontology: Biological process=nucleobase, nucleoside, nucleotide and nucleic acid metabolism
atgaagagcgtcgtcagcccaactccgttccgccggcccctttcgctccgctgtgtgtgctcagtgctggtgctgctcatctgtgcgttcgatgtgtcactggcagcaaaagacaaggagaagaatggcaaagaagaaccaggaggcccatttaatacgctcagcatcattttgctgattccgctggtcatcttcaccggcgcgttcgtctacctgctgtttatgaagccaaagagcgaaggaaccggcgatgacgacggagaaggcgaaggagacgcggacgtggaaaagggaccaaccgaagagacgaagtaaaacacgggcagagccaaattggcaaaacaactaataatgtttttcccatttcagaacggagcctcgaattgaatctccagcaactcttttgggcgtgacagtgccgttggagcaagacgaagaagagcagaaaaaggacgacgaggggtaagtgcaaaggtggcggatcattttttactcattaaaatttaccatttttagtggcgaccaaaccgcggagaagaaagaagaggacgcggcggcagcggacgaacaaccgaaagaaggcgccgcggaggcagcggaagcggagaaaagtgcgacaaaggaggagacgaccgaggacacggaggagaccacggaaggatcgaccacagagacttccgacagcggctccggctcgggatcgtcttcagcatcgggctctgaggggagttctgggacttcggacgccacttctgaagccacagaggacgcatcatcttcatcggagggttcttaa

SEQ ID NO: 62446 - DNA, 121 bp, Heterodera glycines
  Genomic contig location: Contig_ID=SeqID_833; Location=2446..2566; Strand=+
  SCN-specific regions: Sequence locations=1-121
ttctttctgtttattacgacagtaaatgaattgtgatcatgcagaggctgcagaatactcaataaagcagcaaaaaaggaaggatctattcgcagattaatttacgagagcaaattgaagg

SEQ ID NO: 62447 - DNA, 1029 bp, Heterodera glycines
  Genomic contig location: Contig_ID=SeqID_833; Location=3662..4690; Strand=-
  SCN-specific regions: Sequence locations=1-9,52-105,136-258,280 -352,374-626,671-798,820-1029
attcccttcacagcgacaacaacaacaacaaacaatcagcaacgacgacaattgcgcaacgcttcaacacagcacatccatcgcccgtgcacacgtcgaatccgatcacttctgctgctgctgctctccaacaacacaatgggcttcctcttgtacatgttcgtggctgcggttgcgttcggcggtggagcggtgggtttgagggtgggggaatttgttttgttgctgcattttttgagtcccaatcaaatttgtatccatttcaaaatttgttgttttaatcagctcgggattgagctttcaaaaaggatgaattcgagactcataaaagcacggaaaatgaatttggcttactttcagcgtgttttttgctggtgtgagacgaaaccaaaatttaaaatccgaaaatttgttttgaggcttttcatttcagaagtgccattaacatatacacggttcattttgaccaatttcggacccgaaaaccccaaatttcatcgttccatgactagtaaaatggtttagttggcccgcttttgcctccgttcgtgttcgttttgtgtctaatttgtttcccatttccttttcagtactgtggcatgatttacaccaccaaaggggccagggcatcggcgggcggcggcggctccaagaaggacaagaagcagaaagcgtgagccccagcggtgaacaatgatcgactcgaggatggcccccgtggatgaacgaacgaacgatggacttcgagcaacaaacgcttctccccttctaactgctgctgatccccacaatatgacgctgttcccctccccccaaattatatcatttgtaggtgctttatcaccctctgatctgttgtccgtgataagctatatgcgctgtccatatcagtgatcaaaccattgtaattgttgtaatgatatatgtatgtatgtcctatatattgtattgtatttgtatgtgctccaatgcaacaaccaatcattatgtgtacataaatatgttgtatgaatgtattcggacaataaa

SEQ ID NO: 62448 - DNA, 618 bp, Heterodera glycines
  Genomic contig location: Contig_ID=SeqID_834; Location=413..1030; Strand=-
  SCN-specific regions: Sequence locations=1-288,310-538,565-618
acttcccaataataaaataatctcaacgacgataattgcgcaacaccttcaacccacacatcttccacacacgtcaacttcgaccgcgcttgttctccaatcaaccaaatgggcttcttcttctacctgatcgttgctgcggcaatgttcggcggtggaatggtgcgtttgctcattccaaatctgttgttccatcaatcattttaacggttttgctttcccttttcagttcgttggcatgtcacttggcggcaaaaagtcatcggatggagcgagcggcggcggggccaagaaggagaagaagcacaaaggatcgaagagctccagcagtgagaagagccaatgatgccgccgcagtacacgaggacggacgaacgatggaatggccgacaacagttccactcccaaaccgatgatatccccaaaatatatgttgttacccccccccccccccctatcatttgtgttttatcactctgtaagcaaattttgcgctttccataccagcgatcatattgttctaattgtattgatgtgttatatatgtgtacacatgtatttatgtatggtctccaatgtaactccgtttcatattgtatgtaaaatgtgaacaataaa

SEQ ID NO: 62449 - DNA, 811 bp, Heterodera glycines
  Genomic contig location: Contig_ID=SeqID_834; Location=1310..2120; Strand=+
  SCN-specific regions: Sequence locations=1-105,138-484,506-543,566-811
  Gene Ontology: Biological process=nucleobase, nucleoside, nucleotide and nucleic acid metabolism
atgaagagcgtcgtcagcccaactccgttccgccggcccctttcgctccgctgtgtgtgctcagtgctggtgctgctcatctgtgcgttcgatgtgtcactggcagcaaaagacaaggagaagaatggcaaagaagaaccaggaggcccatttaatacgctcagcatcattttgctgattccgctggtcatcggcaccggcgcgttcgtctacctgctgtttatgaagccaaagagcgaaggaaccggcgatgacgacggagaaggcgaaggagacgcggacgtggaaaagggaccaaccgaagagacgaagtaaaacacgggcagagccaaattggcaaaacaactaataatgtttttcccatttcagaacggagcctcgaattgaatctccagcaactcttttgggcgtgacagtgccgttggagcaagacgaagaagagcagaaaaaggacgacgaggggtaagtgcaaaggcggcggatcattttttactcattaaaatttaccatttttagtggcgaccaaaccgcggagaagaaagaagaggacgcggcggcagcggacgaacaaccgaaagaaggcgccgcggaggcagcggaagcggagaaaagtgcgacaaagaaggagacgaccgaggacacggaggagaccacggaaacgacggaaggatcgaccacagagacttccgacagcggctccggctcgggatcgtcttcagcatcgggctctggctctgaggggagttctgggacttcggacgccacttctgaagccacagaggacgcatcatcttcatcggagggttcttaa

SEQ ID NO: 62450 - DNA, 2327 bp, Heterodera glycines
  Genomic contig location: Contig_ID=SeqID_6675; Location=2115..4441; Strand=+
  SCN-specific regions: Sequence locations=1-14,39-380,402-555,578 -741,765-1294,1316-1600,1623-1783,1805-1843,1869-2126,2149-2201,2223 -2327
atgtttttcacgatttttcttgaaaatttcaaaaaattagtcataactttgtatgcgcattataaaaaggtgctgtccgggctcaattttaacctcagcgtgccatactccatgcagtttctgcgtcgctatcgcttctacgatttgccgtcaaaggtgtgtgggcgtttgcgaagttgtcatggtctgctacgcgctggcccacatcccaccttccgttgttgccgccgtatccctccatttggctgcgtttgcgtacgcatgttcgctgcggttgcccgagctgtttgtggacacgttccgaatgcccgaggcggtcatggatcgcatttcacgctcattcgtcgaccatgttgttttacttctaaaataatcagcccgggccggccttttttgaaaaattctgtccttaacaggcactacaaacaaattttattttctgccccgacaacgcttctctgagtataagagggatgagagaaaacagcttgaaggcgtgcaggctctgggccaggggtgcaacattgacatgcacctgcccttatattccatagaggaatatggagaaataattcaggcacaaaattttttattcttcgcaatatttatcattaaggactattatgaggtgctccatcccggaatgtttcggcttttctgctttgagacgtttggaaaaatgaagccttcgtggaaatcaactgtggaaaattataaacatgaagtctgcgttatttttatcgacggtgaaggcggtgttgaagggcactacgacccggttaaaaatgttggaaaacttttcagtgcacgcaactattgttttggggtatttatagataattagaaaataattttttttaggctgaaaattatggcactgtgctggacaccatgccaccaattgagaactattacccaggtggactcttcccggcagatcgcgcaaagtttgagcaatggtacgacgagaaccgggaaactgggtttgagctcaccgaagtgatcgcggattattgcaagacaggtacaatttttgaagaaaaaacatgcaaaaataacaaaaaaaattgaagatgtccaaatcctggcacatggtatggtaaagatgaggcagctgtttttgtctgagacgcggcacgacataaccgactcggtcaccatcccgtccggttgcatgaagtattgggtgcagttggctcaccacgacaaagaacgggttgccatcatcccacacttgggatacgagaagcgaggcaaacagagctccatcgccaggaaatatttgaaggtgtatccaaattattttaattttacattttgtcgactctcagtggcgtgccgaagaagaattgcgggagaatggccgagtccaacgccatgtcgaaagccctggaggggagttcaaattcggaaactacagcttggacgggatgatggagcgccctgatgaggacaaaaacttggccatcgaggtcaatgggtaaggaaagaattcgaaaaatgtgccaatttacccattcaaaaggtgctattggcatggatgcccaagctgctttcccgacgatgcggcaattgtgggcggtggtgagacagcaggagccccagggcccgggacgcaaaacgaacccgggacattgcgcgggaattcgaagtggaagtgatttgggagtgccacttgaacgcaatgctggaggacaacccagccatgaaggcgtatttcgacaattgtccggattctggcccaattgacttccacgatgccttctttggcggtaccttttccatttaatttttaactaattttccggcacaggtcgaactgggcccgaatacttgggcgcttcagtgatcaacccagagacgggcgactggaaaagccgaacgatcaaagtgaaagactttaacagtctttacccatcgcggtatgaaaatgcgaaaaaaaataattaaaatctttgaaaattacagaaacatgttcaccaattacccggttggacaaaccggacgctgttccccctctgtcggacgtgttcggaaatgtacccgcgcggcttgatcgaccccgagtacaattgcgatcatcttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaatta

SEQ ID NO: 62451 - DNA, 1182 bp, Heterodera glycines
  Genomic contig location: Contig_ID=SeqID_6675; Location=5714..6895; Strand=-
  SCN-specific regions: Sequence locations=1-777,799-865,887-1079,1101 -1139,1163-1182
ctcaaaatggacaagaaaataaacaaaatatacaccgacccggccaatccgggcgggtatgcgggtgcgagtgccctgtacgcggcggtgaagaagaagcacccgaagttgaagcgtaccgagtttgaagactttttgcagaggaacaccacctacacgctgttcaagccaaagagggagaagttccgacgcctacgcactgtgcctgcgggtttcatgaccggtaagttgtactggggcttatttcgcacaattcagggttcagatgttcaggctgacttggccgatttccaagccctttcgcgcaagaacagcggctaccgttacttgctgttggcggtggatgttctatcgaggcgaatgttcggcgcgcccgtaaagagtaagcgcccagtggacatgaaaagggcgtttgaggagctatttgagtaaatgccaagggtgccggacacactgtacaccgatcgagggctggagtttgtggcaaaaccgttgaaggagttttacgcggagaagggcattcaaaagtttgagaccagttcaaagaaaaaggccgccgtggcggagcgtgccatccgcaccctaaagactcggctgtacaaatatttttccgccaacaacacatcggtgtgggtggatgtgctgccaaagtttttgagtgccatcaacaactcagtgtgccgcgcgaccggacttagaccgagagaaatcagcgacaccaatgcgagggaggtgtggaagagggtgtacggcgaaggactcgcacaatcgaacaagacaccaaaaataagagcaggggaaacggtcaggattcccgagcctaagcacattttcgagaagggtactgtaattcacacattttccggtcattttttaaatttttaaggctatatccccaattactctgatcacgtttacactgtggatgaggcccgctcaaccaacccccagcattatttgctcaaagactattatggcacaaagttgaagagaaaattttatttgcccgaattaacaatagtacaagtggatgaaaacacaatgtatcgaattgaaaagaaatacaaagaacgagtgagagatgggaaaagagaaatgttggtgaaattcattggatttccggaaaaatattgggtcacaaatgaagaaataaatgaataaaaatattacaaatttaatgaa

SEQ ID NO: 62452 - DNA, 431 bp, Heterodera glycines
  Genomic contig location: Contig_ID=SeqID_32123; Location=1..431; Strand=-
  SCN-specific regions: Sequence locations=1-56,83-162,209-209,235 -379,412-431
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgagtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaatataagcctaaactttttggcctgtttaaaaagaattaaaaattttaaaaatttatcatctccctttgatagaaaa

SEQ ID NO: 62453 - DNA, 114 bp, Heterodera glycines
  Genomic contig location: Contig_ID=SeqID_32123; Location=922..1035; Strand=-
  SCN-specific regions: Sequence locations=1-114
ttttagattttttattcatctccctttttgatagtaaaagcatcagagagccttatttaacttttaattaacatttggtgcgtttcagagcacgttctaaaaaatatttatgaa

SEQ ID NO: 62454 - DNA, 512 bp, Heterodera glycines
  Genomic contig location: Contig_ID=SeqID_32125; Location=438..949; Strand=+
  SCN-specific regions: Sequence locations=1-107,134-217,239-242,268 -278,300-512
atggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatatttatgaattaattttgctaaaaaataaataagtagtgaaaaagtcagaattttgaaaaattttaaaaacagaattactggagttagcattttttcaggttaagttagtccttgactttttgaagctctcgcaaaatctgagattatcgcttctagagcgctaggttataaaaaaaaagttaagcctaaaatttttcgcatatttaaaaagcaattaaaaatttttagattttttattcatctccctttttgatagtgaaagcatctgagtgcctaaaataacttgcaa

SEQ ID NO: 62455 - DNA, 543 bp, Heterodera glycines
  Genomic contig location: Contig_ID=SeqID_32126; Location=481..1023; Strand=+
  SCN-specific regions: Sequence locations=1-298,320-543
atgaacgttcaacttcgcaggattgatccatcagtcgtgtacgttatttttccgtcaatcctattgatccactcgcgtatccatgcagagttggatttaattttaggcataagcaaatgtttttctgagggatattaaaaatcggaaaaaaatataccgaaaatggcaaaatatgcaaaaaatcggaatatatgcacaaaaaatggctaaatatgcacgaaatatgcagaaaaagccaaaatatgcacaaaaacctcgaaatatgcaaaaatatgcacataaaagtcccgatttttatacgcaaacacaaaaaagaaagtgttttttcctgctatttagagcatggagaagccaggaaaaaaaatccatttgcatattttttgcagccctgatgattatagtcttggatatgaattgagttacgcttccgacacgaattcgcaaaattcggtgtttttccgccctgattttcagaatccggctcaggggatacgcagtgattcagggagttttctgagtgaaacttggaaaactaacacataa

SEQ ID NO: 62456 - DNA, 638 bp, Heterodera glycines
  misc_feature (15)..(15): n is a, c, g, or t
  Genomic contig location: Contig_ID=SeqID_32127; Location=660..1297; Strand=-
  SCN-specific regions: Sequence locations=1-328,350-481,508-597,620-638
tttttcagtgtccgntttggggtactcaaacaattacccccacgaaaaaatccaacgcagaattaaagtacaggctatagcgtagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcagggggactgccccgaaaaccccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 62457 - DNA, 557 bp, Heterodera glycines
  Genomic contig location: Contig_ID=SeqID_32129; Location=304..860; Strand=+
  SCN-specific regions: Sequence locations=1-151,182-336,358-521,543-557
atgtccgctgttgcgatgtatataaaccgtccttttcaacaacgcttctcattcttgagcagttcgtcagttccattcgtccacgacttccgttggtttttgctcaattttcttttttttttgaaatttccgttccaattaagtcaatgcaagttcatcaccaccaccaccacaagagccaccatcaacgccacaaacgttcatattcttccgcccgccatgtgttgatcaatttcggcttccaatttccgcatgatttcaaacttggcagtggtcgttacagcaaagtgtacaaaggcgagttcgctgatcgtctcttcgccttccccgtttcagtttttccattttcaggattttaccgcgaagcaaatcgttattttgcaatcaaaattaccgacttggaagccgtttctgacagattcaagcataagtttgtgccccgtgaactcaaagtctggcgcgagttgagtcacccgaaccacgtccgtttgtacaaggatttcatgaagaatgactttctgttcgagatcatcgacttggctgttggcggtgatatg

SEQ ID NO: 62458 - DNA, 80 bp, Heterodera glycines; identical to SEQ ID NO: 62154
  Genomic contig location: Contig_ID=SeqID_32130; Location=378..457; Strand=-
  SCN-specific regions: Sequence locations=1-80

SEQ ID NO: 62459 - DNA, 1159 bp, Heterodera glycines
  misc_feature (1129)..(1129): n is a, c, g, or t
  Genomic contig location: Contig_ID=SeqID_32131; Location=57..1215; Strand=-
  SCN-specific regions: Sequence locations=1-24,46-288,310-373,411 -563,585-594,617-898,926-982,1009-1159
atggtgagtgaaattataaaagtgtatttaatattttattatttacctaaattaaaacagaaaaagcacagaaaatgaacaaatcgattagttttcgcattggtttaagtgataactgttaattaataatcacttattttgtatgcatacggaaaatattatcaattaccatcattcccttcaaaaaagtaaaccgccattatcaattaaaggaacgccctccaaatgacgaatgaatgcccttatctgaagggagggcaatcggcatttaacatacagtataataccgtaattaacataaattaattactcttgaaatgtcgaattaacgaattaacaatcaacgaacggtagaagaacaaaggaaacgaattgatcaatgatcaatgatcagtctgaaaaatgccattgaaatgaaaggcaaacgatggaaaaatgaagtgacaaacatttgatcaccattgaggaattgttctctttattggttaattcttttctcaattagcatacatttttcgtaattttctgccattttcttagtttttttcgtcgtcctcccattaattcttttcatttttcagttcattcctccatcacataaatgtgtgtgtggaatatatgaatatttaatcattaaacaaagcaccattcatttgatcagcagattgctcacattttgctcaatgctttttctgttttttaccatttgtccctttgggtaaattttttcttttatgaattttaattccatcggaggatattaaatacataatttttccatttccaaatgccattaatgattaattatttttccatttccaaatgccattctctccctcccctcccccctttccccccaatttcagatcatttcacaatgtttttcttcacattcgtcgccctttttcttcttttcccttcctttaaccaggccaacaatgccgatgagtgcgtttttcctcaatttatttaattatttttaaatttaattttaatttaatttaatttcaaaggtccaccgccgcctgttgccacaaatgctacgtcgcgttcagagattgtttccgcgagtgtttggacaatcagtcggagaatttggtgtgcgtgccgaactgcaaaattgccttgngaaattgctcgaccgacaaatgcggattga

SEQ ID NO: 62460 - DNA, 92 bp, Heterodera glycines
  Genomic contig location: Contig_ID=SeqID_32131; Location=1184..1275; Strand=+
  SCN-specific regions: Sequence locations=1-92
attaaatacacttttataatttcactcaccatttttcattttaaatggcgagtggcgaacgccaaaagttggtcaacaattcgacagctgaa

SEQ ID NO: 62461 - DNA, 360 bp, Heterodera glycines
  Genomic contig location: Contig_ID=SeqID_6678; Location=154..513; Strand=-
  SCN-specific regions: Sequence locations=1-7,127-198,223-226,251 -312,335-360
atgggccaaggaaggaaggaaaaggaagagggaaaagaagaggaaaaggaagagggaaagaaagaaaaggaaaaaggaagaggaaagggaggaggaaatgaggaagaaagaggaagaaaaaggaagttgagcaagagaaaggcgagcagttgtcccactccccccacgttcccgggggaagaacattccgtcccatcccagcaacaacaacaacatccgcaggcactgtgctctcttctcttcttctctgccgcgtcattcattcgaatcgcaaattcacagcgaatgcgccctccgtggcccccgtttgaatgtcctccacgaacagcagagtctgttgcggagcaaaacgattattag

SEQ ID NO: 62462 - DNA, 1563 bp, Heterodera glycines
  Genomic contig location: Contig_ID=SeqID_6679; Location=716..2278; Strand=+
  SCN-specific regions: Sequence locations=1-84,114-315,342-566,588-1563
  Gene Ontology: Mol. function=structural constituent of muscle; Cellular component=muscle myosin; Biological process=cytokinesis
atggccaacttgaccttcctcaacgaagcgtccgtgatgtccaacctgaagcagcgttacggttccatgatgatctacacatattccgggctgttctgcgtggtgatcaacccgtacaaaatgttgcccatttacactgaatcggtcatcaaagcgtacatcggcaaacgccgtaacgaaatgtgagtcgacaattttggcacacttttgcgcttgggctaaacatgccgcttccttttcaggcctccccatttgttcgcggtggcggacgaagcgtaccgcaacatggtgcaggacagagagaaccaatccattctgatcaccggagagtcgggggccggcaaaacggaaaacaccaaaaaggtgccggagggggaatgaatggcgaacaattaattaattgggcgtgccaaatcggaattaattgtgccgcatttgcaaatgctttttcttttcctgcgcgtccgtccctttatttatgctgcttttttctttcatttggtcttatcgcgtcccgttcaggtgatctcgtacttcgccatcgtcggcgccactcagcaggcggcggagaaggagaaaaaggagggccaaaaggggggaacgttggaggagcaaattgtgcagaccaaccccgtgctggaggcgtttggaaatgcgaaaacggtgcgtaacaacaactcgtcgcgtttcggcaaattcatccgaacgcatttctccgccgcgggcaaattggcgggcggagacattgagcactatctgctggagaagtcgcgtgtggtgcggcaggcgcccggcgagcggtcctaccacattttctaccaaatcaactcgggattcaacccgggactgaccggccaactgaagctgaccaaccccctctcctactaccacttctcatcccaggcaaaaagccaaaacgcaaacggaaaactgacaaagcaatggcaatttacaggccgaattgaccatcgaaggggtggacgacaaggacgaattccgagtgacgcaagaagcattcgacgtgatgggcttcacggacgacgaaatcaacaacttgtacaaaaacgtggccggaataatgcacatgggagagatgaagttcaagcagagaccgcgcgaggagcaggcggaagtggacacggaagacggtgagtggggcgggaagtactaattggccaattaattagtcaactaatgattgccaagtggtcgaattgcaaattgaccaattgcactaatgtaaaagcagcagtggaccgtttccaagttcagacgccaaaaatgcgtccttttgctttggaatcgaccacgaagcctttctgaaagcgctggtgaagccgcgagtacgcgtcggcaacgaatgggtgaacaagggacagaacttggagcaggtcagctgggccgtggccggtctggctaaggccatctacgcgcgaatgttccgctggttgatcttccgctgcaacaaaacattggaccaacgttccaccgaccggaaactttggatcggagtgttggacatcgccggcttcgaaatcttcgacctgaactcatttgagcagc

SEQ ID NO: 62463 - DNA, 1451 bp, Heterodera glycines
  Genomic contig location: Contig_ID=SeqID_32134; Location=212..1662; Strand=-
  SCN-specific regions: Sequence locations=1-164,186-238,265-319,415 -460,482-595,619-658,702-773,819-1451
  Gene Ontology: Mol. function=adenylate cyclase activity; Cellular component=integral to membrane; Biological process=adenylate cyclase activation
atggcggccagcggattaactggcaattcgaccggcacaaacagtcacgtggtggcggtggtcaatttcgcgctggcactgttcggctggatggaggagttcaacgagaactcgttcggcaatttcaacctcagaatcggtagggaaattggtggagagtgactggggagtggggttcacaaattagatactaattatatgccaacgaaaaaaaagaaaaggcaagatttgagaaatgatttatataatatttttaaaatttttctcattttttcgaacggatcacttcgctgtcgttgaaaagtttttgctttacaacaaaattttataaaaattttttttttgacattttttaaacatttttaaaaatgttgtcaaaaatttgaataaaattaaaaataattcttaaaaattcgatgacacggattggaggggggggggggggatttctccgttttttatgcctttttcacaattgttattttttaatgtttgtgatcactgataaaattttccttaaggcatcaatgttggcccggtagttgctggagtgatcggaacggaaaagccgcactatgacatttggggcaacactgtgaatgttgccagccgaatggactcatcgggaattccgggacgaattcaggtggagaaatagaattttatttttagtaatttaatcaaaatataaatttaaattagcatacgaatttattccacaaatcaaaaccaaattttctaatcaaagaatattaatccaaatattttattcgattaatattaaattagaatatttatttatttttttcttttattttcattagaatgattttaatttgtcattttgttaaggtgacggatgagacgaagcaaatccttgaaagggaaggcttccatttcgagtgccggggcgaaatcaatgtgaagggcaagggactaatgaccacctatttgctgcggtcggaggaatcccggcgcggcacagtatcgcgcagacggcgatcgagcgcagtgccaccgatcactctgcagcaaagccacgggcacgggatgatgaacggagggacatgttgaaagcggacaaaccaattaaaactaattaatttcctaattagtaatgcgccaaatcgagtcattaagcaaagttgttttgtgtcagtgttaaagcagtagcaaatgcttgtttaagtcactaaatttgattcatttctgacacggcatttcattatttatttgccatacaaatatgtccttttgctactgcttcatttatttgtactaactttttttattctttttttgaattcggaaaacggggctcattcaatccaatgaacttttggctgttttttgtcttcgctattttattattttttgatttgtaatttttgtattcacaatgtacaaattttcccttgctaataatcccgatgatgtcttttaataataaa

SEQ ID NO: 62464 - DNA, 784 bp, Heterodera glycines
  Genomic contig location: Contig_ID=SeqID_32135; Location=600..1383; Strand=-
  SCN-specific regions: Sequence locations=1-144,166-357,428-506,528 -748,782-784
atgagtaataacggtaattcatcaccatcttcgtccgttaatgaatttggagaatccgaccaaatttacgtgtacaccgtttgggtgacaatcattcaacaaattttgtcactttttggcattgccctaaacagtgccatcgtttacatcaccatcaagcacaagtaaaagagaagatttgaaaattgcataggaattgttttgaattttaattttgttttgactttacttttggatattataaaaatgcatttttaattatgaaattaggaaacttcaccggagtttcggctttctgttggccatctgttctttttgtgacgcactcactgaattggccactccattagctaccggtaataaataaataaaaataaaatattttattatttgtttttattattttttcaatttttcatttattttagtcctcgtttttcttcgtgtgcggattcctcttttgacttgcgtttatgcccaattctttgctgtcactgcaaatattaatacttttataaatctgttttggataagcgttgatcgttttgtggcattggcattccccgttttgtaattttataaatttttattcttgaaattaatctaatcttctttaagttttcgtaacatctcaagattttccggaaaatatgtgttaattgccaatgttttttcattgtcaattgcattttacattgtttatttatcgtttgtatttgctctacaacatcccgaaatgtagcaaattataatgaatgaattaattaattaactatttaataaa

SEQ ID NO: 62465 - DNA, 95 bp, Heterodera glycines
  Genomic contig location: Contig_ID=SeqID_32136; Location=36..130; Strand=-
  SCN-specific regions: Sequence locations=1-95
atggtggcggaattgaaacgccggctcagatcatcgcagatgcagctcagaccgagccagcggcggcacccatgccaccgcctccgcctcaggac

SEQ ID NO: 62466 - DNA, 949 bp, Heterodera glycines
  Genomic contig location: Contig_ID=SeqID_32136; Location=532..1480; Strand=+
  SCN-specific regions: Sequence locations=1-317,341-377,400-402,531 -608,671-720,822-854,877-877,929-949
atgtttgatcacgcgggattggtggatttgaaatttcaaaaaaattagtatcaatttccgacggtgccaatacagctgtccaaaatttatagcgtcaagaaacttttcgtcactttacctacttccccaaaactttgaagacaggtaacttattttataggcaagaaaaaatctgaaacatacttacttattttgtccacaaatcactaaaattaaaattttttgagtttttccccttttttcagacatttcgcttaaaaattaattttttgcattttccattttgtcccaaaaggtgtcactttgttggttgaaaattttcctattttttgtgttttttgtaaaaaaaaaaatcgaaacttgtgtttttatagcgaatattctataaattaaatccttaagatattttattataaatatttaatttattatttgcgaaagaaaatgatatttatatttaatcattattttaattttttaaataaatattagttatttatgaatatggatattaattaaataattataaactactctactcttgtaattaatttgcaatgaaagtagggaataaaaaaatatattttttgatcagtagggataacaattttatttaatcgtggaattattttattttttatttatttattatcttcttaaattatttattctaagaaaatatatgaattatatacatttatttgcgatgaaaatgctgtcaaattaaaataataaatttattttttaatgttttaaattttatttgtttttagaaatatatcatctttaaaatgaaattctttttaattatctttttatttggaaaattggatcagtggataaaaaattgcaacagcaaacttttgatgaaatatttggagaaaaatgggaagaaaaagaagaagaaaatttggaagaaaaaagagaaataattcaaaaatattataaa

SEQ ID NO: 62467 - DNA, 539 bp, Heterodera glycines
  Genomic contig location: Contig_ID=SeqID_32137; Location=702..1240; Strand=-
  SCN-specific regions: Sequence locations=1-539
atgctttatgatggtccgaaaaggggactatccacaagcaagagcagcgaactcaactcccattcgttttatctcggcactcgccaacataaaactgggagattttgaaggcaaattcccaattctcgtcagtgaggacgatagctgtccatgcacagccataattggaacggatttgatggatttcatcagtgaacaaggcgaagaagaaattggattgaacttcaaaagaggactcctacgtgttggaaacacgcaactaccaatgatcgccgctgtcagcatcgagaagcaaccgattgaagtacaacttattgagacccaaacattgccaccgctgtctgattcgctcgtttggggaaaaattaaccgaagtttgggactagacgaagttttcatcactgttgagcgagagcacgattatttcccgctgcgagtcggaaactgtctaacaagtccaggctcaacgcgaattgtgccactacgattgcttaatttcggaaacagcgtaataaaagtgtatgagggatcgcgacttg

SEQ ID NO: 62468 - DNA, 52 bp, Heterodera glycines
  Genomic contig location: Contig_ID=SeqID_32138; Location=1003..1054; Strand=+
  SCN-specific regions: Sequence locations=1-52
atggaacatttttaccgctttggaatacgcgggagagcaggaccaattaaag

SEQ ID NO: 62469 - DNA, 1485 bp, Heterodera glycines
  Genomic contig location: Contig_ID=SeqID_32140; Location=413..1897; Strand=+
  SCN-specific regions: Sequence locations=1-25,50-1265,1287-1485
atgggggaagcacaggaccaacgagacgaagcagtacaggaagaggaactcggcgcggttgctgggacagaagccgaaggtcagcccggggaggacaacaatgctccccgtggcttgagtggcagtgagggagaaaaaactgtggaagctgaagaagtcgcgcaagacgaagcagaggaagggcccattccaccgagtttcgttcaaaacgaagtcgggagcacctctcccgtgtcgcagacaaatgagcagatacgggaaaccgtgaaccaaaagacggaagcggagaaagctgactcaccggagggatcgaacagcatgcgagaagttgaaccacgaaggtcgcggagagtccgacgaactcgagaagtatggtcaccggaacgatgtgccacgaaaaggagggggattggtggccccctggtcagcttggccatgatgaccatgttggtctacccgactctgacgtcagggtgtcagccgactatccgacccgaaattgttggacaacagtcacaggaattgccaacaacgatgttgccgtgccatatgcggtgtacggaacgtggagtgaaagtgctgagcgggcagcgactcgaaaaaatggaaatttgttgccctgatggatgctgggcaattgtgcccacttcgacggagatcagctacgagctaccaactgaactgctcgtccacgattaccagtgcagtggtcaatgctggagggggtctggccccccttataacatcacacagcgatgtccagcgagagcagaatgcgacctgatcaattgctccttctgtgggaagcagctggccaacccgacgtgcaacccgcgatgggcatcctcgctcttcgggtttggagctgcaattttgctcgccatcatcggctgcttctgctcaatttttgggcggtttttgtcaggagccaagctgctctcgagagccgtggcatggggagttcgttgccccatcgggctgatcaattgggcaaccggacgcgattttcggaaaccgaccacggagcaaatcgaacggaaagtgaggaaaggagcgagaaaggcacgaacggaaatacgtgagctgcagcagcaactgcaattgggaagacgggctcgggcgatggccagagcgtggcaaaatcccgacgggactcgaaaagcctttcccgcaaaggcagtggcagccctcatcccattgctgctcatcatcggcccggcaacggccaacaaacctttgtccgtcatggtccgatcggaggactgttcgaggacggcggcgggactcaaatgtgcagggacagcagcgacggtgctgacgcttctgccggcggaccagacaaactcattcgtcatacggactcaacaggacgaactgctcggggcagtgaggctcagactggcctccctcaccatggtctgcgtgccaaagacggaaagctggctacgatcatactcaatttcgacgacggcggtcaagcggtga

SEQ ID NO: 62470 - DNA, 875 bp, Heterodera glycines
  Genomic contig location: Contig_ID=SeqID_32141; Location=107..981; Strand=-
  SCN-specific regions: Sequence locations=1-572,594-629,668-875
tgcgctcgcaagttttcgcaagtacgacgcgaccatcgactctcagccgctcctcaacgccagcaggccgctgctccatatgcggccgctcctcgctactatgccgctccgtactaccatgccgctccgcttgccggtcgtcaactccaagccgctcttctccctgccgctcctcaacggcaggccgctgctccatatgcggccgctcctcgctactatgccgctccgtactaccatgccgctccgcttgccggtcgtcaactccaagcagctcctctccctgccgctcgtcaacttcaagccgttcctctgcctgccgctcgtcaactccaagccgttcctctgcctgccgctactcgactctctgccgctctgctgcgagaccctgctggtattatgcacggtaagggatggcttatgagtagggcccggatttttaggtttttatttttttttctgcggctttaacttgacgagaaatgcacgaaaaacacattttttgttcgaaaattttgcgttttaacgcccttattcgaccttagaaatccttatttcggatgttcgcccttaaaataactttttatccatattatggcgttttgcccctattttcgccctaatttcgcggtttttaaaatttttcacataaaattcaaattctttaacaaaatgcaattaaaaaagactttttgacgcgagcacgtttttggcaaattcaaaaatttttcacataaatttgttcttttttgcctaaaatttagtaattttatttcctttcttgaccaaattttggtttttcaaattttatttgttttgaaaaagtattgaaaattttagaatatttttattattggcaactgtaatcaatcaataaa

SEQ ID NO: 62471 - DNA, 569 bp, Heterodera glycines
  Genomic contig location: Contig_ID=SeqID_6682; Location=156..724; Strand=-
  SCN-specific regions: Sequence locations=1-154,197-227,263-442,464 -497,520-569
atgtgccgttttttctgttaccaatggttttgcgtcatttatgccattttatttctgcccacacaaattcggtgttgccacccggagggaagagcaccacgagaaggtaaggtcgaccaaatttgaacattaccaaagagtttaacgggactgggaatttttggaaaaacatggaccagaaaaaccttggccgggattatggattttaaatagggaattggaccaactataattttcaaaaaaaaaaaatcaatttatttttccaaatgaaaaaaatcagaaaaaatcgtttgcttttgaaaacaggaagtacgacaggcatcactttggaaaattttgaaatttatattgttatttgtagggatgcaaattttaggtagggaaaaacgcgaaataagtatttaaatagataccaaaatcccgaaaatggtagaaaaatttgtaaacaaaattttgggatgaatttttgagaaaattttccagatcttatttgttaggagtatattttttgaaaattttcaggtcgattcttaggggttgtatttttggtttttattgtattttcgtaa

SEQ ID NO: 62472 - DNA, 966 bp, Heterodera glycines
  Genomic contig location: Contig_ID=SeqID_6683; Location=562..1527; Strand=+
  SCN-specific regions: Sequence locations=1-210,232-303,360-560,582-966
atggatttgcttcttttccaacgcgataaatacgctttggcgtacaattgtacgaatttcgatgccaatttggtgccaattgggcaacgcattcacactgttcacggcatcatcttaatcattatgtttttcgtgttcgaagtaagtttcagcagaagattatttcaatggaaatatttaaaatgtttgccaattaaaatcttagcattttcatgaaaaatttttattttatggtgaaaaaatctgaaaatgatataaaatttatggtaaaatcgttccaactttttttttttgaattggatcaaaatctgaaacttaaatttcttaaaacagtcaaatttaattgttttcttattggttaaaaaccaagcacccttgtttttacttttttttccttgtctatcaaatccaacaatcttggtatcattaccaagttgttttaaaacgaaaattgaaaaattcggaattcttaagttttttttcttccttttatatgcttgagcgaatagagcttgtaaagaatctccgagtcatgctaagattgttggatttagacaataaagaaaaaagttagaaaattttagctgtcgccaaaacgtcggcacaaaaacgaccttttcatttgtcacatgggcatgagtattttttttccattagttgttgtacattccctgcatgatgtccatgtaccacaatttgacaactggtatcacagacatggtaaataatagagaccggcgcgggacgggatcccgcgcgggattttgcgggatcccagtccgcaatcccgcattttttggaaaatgcgggatttgcgggattaatcccgcgggatcccgtcccgcaaagaattttgagttccaatcccgcagcgtgatccgcaaatttgattttttgtgcgggattatgcgggattttattgattttttgaaaatttttcaaagacagaatgccaaatatttttga

SEQ ID NO: 62473 - DNA, 671 bp, Heterodera glycines
  Genomic contig location: Contig_ID=SeqID_6684; Location=30..700; Strand=-
  SCN-specific regions: Sequence locations=1-177,236-321,365-375,398 -425,461-509,531-534,559-573,595-648
atgtcgagtttttcactcaaaaattacatgcaaattggattaatcactttgaagaaaatgattgcactttattgctttttagatcgcattgttttaaagtgcgtgcaatttccaagaaaaagactaaagttgtattatgaaccattttattataaaaacctttacgtacatataacgaatttatattttaaaatacaaaaaataactcaaaaatatatattttttcataaattaagctttttaatcgctgccagaacaaaaattaatcgcagctaataatgatcgattcccagtttgtcggattttaattttcctctgcggataaaataaataaattttgaaaaataaaaatttttgaatttttcggaaagaaaagtaagtaagtataagttttgttcagatttgcaaagttaaatcagtatccaaatttatatgttaaaacacaaaatcattcaaattttgtaatttctaaaaaaagtggtttggtatccgtcggaaatggctttcaaagagaaaatgaatagtgccacggctaattatttaattatttggcacaaagtgaaaaaaaacacttaacatttaaatgatcagaatcagctgtaattaaattcttatgttttctcccaaacgtaaaattaattaattcccataaatttaataataataataaa

SEQ ID NO: 62474 - DNA, 553 bp, Heterodera glycines
  Genomic contig location: Contig_ID=SeqID_6684; Location=838..1390; Strand=+
  SCN-specific regions: Sequence locations=1-30,54-521,547-553
atgccatctccgtccgtcacaatcgtcaacattgcatatttaattttgtcatttgaaatgttcacagatttatctgtgttggccattgcgtgcctgaatttggccgtgattgtgcccaacaaactgttgcacaccaacctgaaaagcattctgatcacccaaagttttgccgttttgtattttggcattcttcgcttagtaatcatatgccaaagattaatttatgttgagccattaatgtccgacgatgtgattctatcggtaactttttaagatttccaatctatgcaaaatacagtagtcactgaaattcacacaggattactgtaccatataaaaattttaagccgtggtcacatactttttttttcaaattttagatacttatgaatttcaactcggtattccgtcgattgctgggccatatgttgatcattgaacgttttcttgctacttttcgtaccaattcatatgaaaaattctcgaaaacctattttactgtgacttggttcagcattacggtatttattttaatataattgtgatattgtaa

SEQ ID NO: 62475 - DNA, 281 bp, Heterodera glycines
  misc_feature (277)..(278): n is a, c, g, or t
  Genomic contig location: Contig_ID=SeqID_32145; Location=1238..1518; Strand=+
  SCN-specific regions: Sequence locations=1-153,196-281
atgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggtgggttcattatttatttatttttgcaaaattaattcataaatttttttcagaaactgctctgaaacgcaccaaaatttatttacaagttgaataaggcactctgactcttatattatcaaaaagggaganntga

SEQ ID NO: 62476 - DNA, 151 bp, Heterodera glycines
  Genomic contig location: Contig_ID=SeqID_32145; Location=658..808; Strand=+
  SCN-specific regions: Sequence locations=1-57,91-151
ttacagcttaacaaggcccaattaagcttatttccagaaaatctcgcatgaattctcatttttaaattttttatagatttttaaatatttggatatttttttggcttaccaaaacttcatcgaacctggctctttctattctcattcaaat

SEQ ID NO: 62477 - DNA, 364 bp, Heterodera glycines; identical to SEQ ID NO: 62360
  Genomic contig location: Contig_ID=SeqID_32145; Location=962..1325; Strand=-
  SCN-specific regions: Sequence locations=1-86,116-247,281-364

SEQ ID NO: 62478 - DNA, 1849 bp, Heterodera glycines
  Genomic contig location: Contig_ID=SeqID_32147; Location=218..2066; Strand=+
  SCN-specific regions: Sequence locations=1-212,234-236,259-794,816 -1849
atggatgactatctccaatttttccgagaaaattatgaacaaattctgttagagacgtctcaaaatattgctaaggcacaggcaattcaaaaagctcaatttgatgcaaaaagaaatgtgaatccagaaaaatacaaaattggagacagagtaatggtctattttcgtccttcagtcaaaaccgatcacaaaaaattaggttggaatttttatgggccctttttgataaaaaatctcactcccactgcttcatttgtcattcccataaatcatttggatgatgtacctattaaagtgccaattgaacatttggtttcggcaccaattgaaatttccgatgaagttttcctaccaaaccaaaaaaggaaaaaatttctaaacaaaatgccatttttaccggaaaacaaattagaacacagaaaaatccaaatcaacttatttacaaagaaaccatcaattttagacccggaggagaccagtggaatgtgccacaattcgttgtgcagtggaatcgaggagcacagcaattgtgcggcaatcactttggcggatcttcaccctgctttggccgtgatggacaaacttcgaaatgtcaaaattgagatgctcggggagctgatctcacttatgatcgccaaggatgtcccaattgcgcaaattcgaaattgggcaacaaacagaaacacacatggacctgattttcttttaaaattcagttcaaatctgtccccatcttcccaggaattcatctcaatcatttctctttggattgaccggtgcgactttgcttttcacaacctccaggcttcagggtgcaaaaaaataaaatttttaatccccaaagaaaataagagctatccattccaaaaagcgattgaaattgctattgaggatgtgaaagctcgatctgtgttgggtctgtctaaagtaattcgaagtcctttcattgtgttcagtgattcggttggagaagtaatgaaaaataagttggaggcggaaatatttttggagaggagctacacggcactctcaaacgaaattgtcaccacctattttggtgaagaagttaaaaaaattttgattatggccggcaccgatgacattattggaaatgtgccaattgaagaaacgaaaaaggccattaaaaaaatttcatttcatttatccaagttttccatcaaaacttttattattcccctgccattcatttcaaaaaaatcgatggcacatgaaaaatttcttgatttgttggatgaaattgtgccgaaaagtggtaatgtgatcttggcactcacacgaggccatagaagcattgcagaaataactcgttatggagataaagaagagaaccgaaatgtcgatgagagcggtaaattgaaagacggtggcgcaaaaattacgctcaaatttctttgaggcggtatttggtatgaaaacgccgctcaaaatttcgccatttcctgatccacgcggaaaggaaaaaaatgaaaatgaatcccaacaaccaccaaacttaatgaccattcaattttctcatcaacaaaaccggcaatttcacccaaatccgcgccaaagttatcgcggacgaccatttggtggtaatcagcattggcgtggtaatcgcggaaatccccgatttcagcaaaattctcacaacgatttccgttttgggacccatcatggaggcccatacccaccaaaaaggggccgcttctcataaattattgttttattgtcctaatctctcaaagatattgttgctaaatacctcagacaaaattatttttctcccatttgcttctcaatttattattgtattttgcttaaatttgcttaaaataattagcga

SEQ ID NO: 62479 - DNA, 1095 bp, Heterodera glycines
  Genomic contig location: Contig_ID=SeqID_32148; Location=170..1264; Strand=-
  SCN-specific regions: Sequence locations=1-957,987-1095
atgtgcagcgatgtttggatggacattctcccatcttttgaccatgctcaactcggcctcaaattggcacttctttcgccacgtttcaatgttttggtggacaaacattttgacggcaaaaacgaactgacaatttggagacaaatcagaattgccaagaatggaacaaaagcaaaattgtatgttgagaaaagcaatggcaaatctgtgcattttccgttgcccgatcatccgatgcacaacaaaattcggtttaacgacctttggatttggtaaacaaacaaaattcaaagaattattaaatgataaaagtatttcctttcagttacattgatcattccgtcatcgaatttctccgtgccaacgaacaaatctttgacaaaggcatcgatttggatttttatgttgaggccaatgatgtccaaccaatttgggatgtttttgctcgtgaaatttggccaatttttgcgacaaacattcgctatttgaccgtttccgatctccatgatttggacaatttacgtcgccacacatcgccgacagttctcaccgatttcaacattatttcaatccattccggagatttgcccgatgcaattgctgatgatgggccaaatgcaactattggccaagcattgtccaaatggttgaacactccgacaaaagatggaaagccaaagcaattgagttgtcgtgttggtacgtcagaaaccattggattcatcaacaatttcaaagaagtgtgtggccactttcgtaaaatgttggattaaatgccatttgcttttcgttttccattttataggcatttctccgtgccactatttcttctgccagctatatcattcgacttgtactactatttgatgaatcaacgccaattgagccatttgaattgaagaacgaacggaccaacgaaatgctaacactggcaaaagaaaaatatgatgaaagtattgatgaagaagatgatgatgatgatgatggtaaacatatctatttggtgttgaagcgatggcaaattgggaagacaattcaatgggaggacgaaaaattgaacaaaatcacttttgaactttttgaaaattgcattgg

SEQ ID NO: 62480 - DNA, 1031 bp, Heterodera glycines
  Genomic contig location: Contig_ID=SeqID_32149; Location=129..1159; Strand=-
  SCN-specific regions: Sequence locations=1-401,423-677,699-1031
atgtggatgcgagtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaag

SEQ ID NO: 62481 - DNA, 1286 bp, Heterodera glycines
  misc_feature (1177)..(1177): n is a, c, g, or t
  Genomic contig location: Contig_ID=SeqID_32150; Location=36..1321; Strand=-
  SCN-specific regions: Sequence locations=1-191,213-229,252-545,567 -677,700-1072,1123-1286
atggaagaggaaaaaaggcagcaaaaggaaagggaggaacagagcaaatacggtagggaaatggacaattactactgtatttctatgaaaattactactgtatttgtatttaaaaaacctactgtattatttcgagttttatttgttcaaaataacgactcaattttcagtttacgccgaacaattcaacgccattttggagaaaatcagtgacttggaaggtacgaagcaaaaagaagaggagcagcagaaagggatgatgaaagcagcgaaaaattgtcagttaattaattaatgaaacggagagaccaattaaattaattagtgaaacaaattgaaaaaaaagaaaaaattaaaattgtttccatggttaagtcattgtggaaaaatgcgaagcaactaacggacggatgggcgaaattgagaagcgactgaagtcggaaaaaggaaaatacggtaagaaacgcatatggtagaaataagaaaatttgaaaaggaaaaatcattaaataaatttggaaaattaaaaattggccatttgtcgcattttaaaattcccaaataattttaacggagaaacaaaatgccataaataaaccaaaaaattcgaattcccttttcagtgtctgctggtcaatttgagaaagtcttggatagaactgaaaaactcgagaaacaattaaaacaaatgcagcagcaacaaaaacaggaagcgaaggccgccaaatacggtaggaaaacttacggtagccattgggaacacaaacaaataaagttacggtatgtttaagcgactgtggagaaattagaagaaacttttggtcaattcggcgaaatgctaaaacaacagaagcagaaattggaacagttggacaccgcacaacaaaaattatgtgaaaaaatggcgtcgatggaaaattttgttggtgagtaaaatttggcggaaatgactaattgctttactaattaacttgtaattatttgctaattattctctctttgtttagttgatctgttttctcaaatgcaaaatgctcagcaaacggaaatttatgccaaaattgacgaggtgaaaataattcttaaaaaaaattgaaaaattgttttattaataatttttttcaaagttcgcgcaccaattgaagatggaaattgatatgatggcaaatgccaccanaacaaatagttgaagtgttggacagacagcataagaaaattgcgacaaatttttcgtagtggacaatttattggcattttgaagacagatttcaaaatggtaaaataaa

SEQ ID NO: 62482 - DNA, 1705 bp, Heterodera glycines
  Genomic contig location: Contig_ID=SeqID_6685; Location=3181..4885; Strand=+
  SCN-specific regions: Sequence locations=1-151,173-322,344-403,425 -762,784-1577,1601-1679
atgcaacgcagccgacgtgacccaactccaccaacatctcccaaaagaatgagggccccaactccgcgaccaatcgttggactaccaattcctgttgtggagagtgagtttgtgctttgacaatgagagaaacggtttcatggttggccattttatcccccaaaaatttaggcaatcggccagcggaagatgtaagctcagacgatgacgacggttacggcaatgtcgcccaccaaaacattgtgcaaagacaggaactggacattggcgcacgagctgtccaacgtccaattgcccgggtgccgcctgcatttcgtcaaggccctgttcgccgcccctttccaccacttctactgccacgtcaggtcagaaaccaaaggcttttgagctttctttgcccagattcacagctttgggtcttagggtccacaaatgccacatcgtgtattcccagtcccgcaccaccatgtccaacaccctcttctccacgtccgaccacttcctatgccccgtcaggtcgaaatcgaaatcgctttttttgctttgccacaaattgtcaaatttgggctttagggtccaccaatgccatacaacgccctccgtgccccacaacaccccatccggtttccaattgtgaatgttccgccacttccgctgccccctcaggtcggatactgttttttgaccctattttgtgccaacatttctcaaacttttgagttcttagggacaaccaatgctgcgtaatgttgttcctgttcaccaccaccatcatccaatcaacggcctaccacttccactgccccatcaggtcaaaactcatgactttttttcgccttctcttgaccaacatttcccatctttgatttgttaggggccaccgttgttgcgtcatgttgtacctgttccgcatcaccatgtccaacctccaccgaatggtctaccgcttccattgcctcatcaggtcaaaaaatgacctttttttcgccttctcttgaccaacatttctcatctttgatttgttaggggccaccgttgttgcgtcatgttgtacctgttccgcatcaccatgttcatcatccaatgaacggcctaccacttccactgccccatcaggtcaaaactttgaattcttttgacccaaatttctcatctttgatttgttaggggccaccgttgttgcgtcatgttgtacatgttccgcatcaccatcatccaatcaatggcctaccacttccactgccccatcaggtaaaaactcatgacctttttcgccttcttttgacccaaatttcaccgctttgagttcttaggggcaaccaatgttgcgtcatgttgtgcctgttcaacatcaccatcatccaatcaacggcctaccacttccgctgccccatcaggtcctaaacccgcagttttttctaagacaggagaaatttaggctcatcttgtgccgccccaaccatggcatttcccacctgtcatcgttcgcgtcccgcccgtcgcacaaaggaacgaagctcttcaagttcggaactttcaaaacacccaaaatcatcatcgtgaatttatttaggcgcctccaattgtcaatccgttggggcaaaatccacagcaaatgatccgttggccaagacaacaatggattgggagaccaattgacccccgctcacccccacattaatgagaaaaaagaatgcatttgtta

SEQ ID NO: 62483 - DNA, 333 bp, Heterodera glycines
  Genomic contig location: Contig_ID=SeqID_6685; Location=1065..1397; Strand=-
  SCN-specific regions: Sequence locations=1-178,200-333
cacagaaatttacggaaacgcttggaaaaataaaaattggtagtttgagttggtccgtgtacgggcgaccgcctcacacactgagtgatattgcccctcattagatttcgacaacttaagcctcacacccgagcttaatcggtctttggttggtgttgtttcatgccgccaccaaactttctcaatcttctcaatcaccctccagtgccggcaaccactcggcctatctgtccgcgtgtgggaatcaacgtaagcctcccaatccctcctcagcccctgcccggtgttggcaggtaaagccatgcacccggcctatcaatccacagtggtggc

SEQ ID NO: 62484 - DNA, 657 bp, Heterodera glycines
  Genomic contig location: Contig_ID=SeqID_6685; Location=5421..6077; Strand=+
  SCN-specific regions: Sequence locations=1-113,137-172,202-254,278 -337,359-467,489-657
atgtcagaatttctcattttccttttgggtttctcctttgccatgcttctcatgttgtgtttgctggtttcgctggtgctctttgttctttgtgcagcatggtattattggacaaaagaagaagaaccagaagaatttgatgattttccagaatacccaccgccttattaatgaaataaattttttgttgaaatgtgtcatgaaaaaacttggtttaagccatgtacattttttctgctttaaaatttccatttcaaatatctaagctttgaaaaatgttcaactcatccttttttgctgatgtcaaagaactagggcgtattccaacaccgaagggaaaatttagtgagaagaaaaatgaaactcaatttatgaaaatatttaggtatattttatgcacttgagttcgctaagctttatcaaacggttggacgtgaaatttctcgtgataaattccgacatatcatgaaaacagggaaaaaacaacatgaattagcattggttttcatggaaaaggctgggataaatacacaggagaaaacttttgggcttaaacacctcgaatttgtgcaaaacttttgggacaaagaattcccagatatatttcgtatcgttgcgtttgatatggtaaacgaacatttcctaaacttcgtgtga

SEQ ID NO: 62485 - DNA, 1220 bp, Heterodera glycines
  Genomic contig location: Contig_ID=SeqID_32153; Location=6..1225; Strand=-
  SCN-specific regions: Sequence locations=1-267,289-512,544-703,743 -824,846-1220
atgggctcctccgtctctgctccgttcttctccgccatgaccattttggccaattcgaaattgttccccctttttttcgttttggccattggcattccgtctgccgtgctgtactgctcgctgttgctggccattgtcaccaacttcaaacatttttcttcaccatttttcatcctcattattatccgtgcaattttagtaagaacataatcaaaattggcaattaatgaatggccaataattatggcaattaatgaatggccaagaattaattgattttcaattattcagagtttgatcacttatgttgtcacctttttggccatccgattttgcaaaattggccttttcctgcccatttacctcaaatttccgcggattttactggcatttctttattttatgcttcattatgcttttcacttggagaatttgttgaccgcttttttgctattaaatcgactaagcgccattcttttcctgattaactacgaaaaggttttattgagctattttaaaggttatttttaaattcccatttcatttagttatggcgtgtcggcctgccctttgttgtcgctttctctttcatctttccgctgccttttaccgctccaatttttcgtttggacatgtacatccatatccaaaatgacaatgtcaccttcactattgacgatcataagaccgcaaatgtattgactttaataataattattatttatttttaatttaaatttatctaaattcacctttttaggagataaataacagcgaactcgccgctttctctgcccttatttttttcattgtttgccttttgataaatttagccacccttttggcctacaaattgcgcagctattaccaacaaaatggccaagatttggccattgagcgcaaaatgactatttatgcggtggccactttctttggccaactgctcatggcgatacatatggtcattaattaatgaatgcttaaaagctggaaatattgatttactttttttaaataaattcataattcaaatttaagcttttcagttttttgtcgacataactgccacaaattttgttgacgagcacaacaatcgcttttcctatgtccaagcatggttcagtgtctcattggagcaaaatgagatcctttttttcgcaaatttgaaccaaaatccgtgggttaatgacctttccacggtggtcattccagcctggtaa

SEQ ID NO: 62486 - DNA, 1637 bp, Heterodera glycines
  misc_feature (21)..(21): n is a, c, g, or t
  misc_feature (62)..(62): n is a, c, g, or t
  misc_feature (126)..(126): n is a, c, g, or t
  Genomic contig location: Contig_ID=SeqID_32154; Location=46..1682; Strand=+
  SCN-specific regions: Sequence locations=1-539,578-744,778-907,929 -1549,1633-1637
ggaccgggctttttaatcatncatttcctaatctaccacacgctttcacagctccacgacgntggccttggctcgccccattgttcggccgatcgggaggaatggcggaccatgttggaaaactcncaagacacatccatgttgtgccagggcaactgcattccgttcatccgatcgtcgacaccgcctgcaacagcgttgggcacaatgccaatgccgtcgtccgaccatggcactgttgttggggatggagcagttgaacatgaccagcaacagcagatgatgtacacgcgagaggagttgagcaacccaaacttggacagtgtgcaaatgttggtggattatggtggaaatgaattattagacaatacgccaaatgtgtccaagcaggcctattgattttggatgccaaataattttaattaacgcctttctcaaactgccattccccaatttaaaattattgaaaaattttgaaaagctgaaaaatatttaataattccataattaaattttacaagaaattttctgaaatttccaaaaatataatcatttttttaaattttaatatttttatctagaaagttccttaagaaaatttcaactttctctgtgaattttacgttgaaaatttttcatgcatttataaaatgaaattttctcaaaaatttttatagtattctcgaattttttcaagaatttttcctgttgtgaggatgcagttttaagaaacgcgccacacggatataaataataataatttttgatttatttaaagtctaatcgctttttcagcttgggcattgcgctgatgcaattggtccacggcattcggcgtgactgcttctacaacacatttatgatgactataaaaaagaataatggcacgggttggttggtgttggcatttttgcattttgaaattactcatggcttttcagtgctcaaaaggccgaccccctcatttatggaatggcaaaaggggctcaaagcgtgccaaagtccgtcggccgttgcactgttcgaaacgacgctggaatttgccatcaattgggacttcaaggcggaggatggcacgacggttagccaacagcaaaaagcggtgagaaaacaaagggaaaaatatccaagtattctattctatccggatttttccctggtttttttaacagaaatccggcggacgccgtcgacagatgccccgagacggaagtgccaaaacggacgacgaaaacaccgaaaatgaaaacaatgcctcaacatcggcggcgatggcacaaaagcagcagcagagacaacacacgcgacagagggaggtgaacaatttgttggtggaggcgggattcttgggcggcatggcgatcggagcacggacgcgcaagccggtgaccaaatacggtaattattcaaacacttttaggggcaaaacatatcaaaatttttattttccgaccattttttatatttacgtttgtctgttggatacatactaatttccggaacacaatgtttaggtgacgtggaaatggatgtggacaagctgaactttgacgaggcggaggaggaggaagacgagcaacagcagcggagagaagaaaacgcggaagagatggaggaggagtacaaggaggaacaaa

SEQ ID NO: 62487 - DNA, 451 bp, Heterodera glycines
  Genomic contig location: Contig_ID=SeqID_32155; Location=8..458; Strand=-
  SCN-specific regions: Sequence locations=1-39,62-329,356-451
atgttgtacatgacttatgcgggcgcggcaccaacattgctcaaatgtggccaacacgtgtttccggatgccgaaaaggcgaacaaacgatgcgaagcattggctggcatggccaagtaagacgtgaggggggggggaggctttgaattttgacgagcaccccaaaaagtcgccggaaaattttttggaaaaaaaaaattttcaaacagaaattttacaatgaaaaaatttttagaaaatttttcaataagaaaactaaaagaaaaaaaattcagcaatttttttttcaaacttttatgatgaattaattaccttgattgtaaatagccaaattaaaaaaaaaaaaaaattttatcattgcagaagcaaccaagcgaattgtaccagtcaaaacgctgaatgggccattcaatttcgcacagtaaatgtggaatttgatatgcattggtaa

SEQ ID NO: 62488 - DNA, 56 bp, Heterodera glycines
  Genomic contig location: Contig_ID=SeqID_32156; Location=639..694; Strand=+
  SCN-specific regions: Sequence locations=1-56
gctatagcgaagctattcccgaaggattcggtctccccataaatctgggcgcatcg

SEQ ID NO: 62489 - DNA, 268 bp, Heterodera glycines
  Genomic contig location: Contig_ID=SeqID_32157; Location=585..852; Strand=+
  SCN-specific regions: Sequence locations=1-268
atgaacagtcgaaattcgtcggcagttagctaaattaaatgttatgcattgactctcttgtcatagagttgaaaatcacaaaagcatagggaaaaaggagtttatgggaatgataaaacgagaatatttgacactcttccagcttcgtgtcgcaacattttcgcttgttgcaatggcaattggtctttgctttgtgacagtagcaaatgtcgtccaaatgcatttgcttactgcactttttgctgacgaactgactccaacgccttaa

SEQ ID NO: 62490 - DNA, 688 bp, Heterodera glycines
  Genomic contig location: Contig_ID=SeqID_32158; Location=547..1234; Strand=-
  SCN-specific regions: Sequence locations=1-356,399-451,480-533,556-688
gacaaacattagcaacggaagagaacggggctacccgacttttggggatttgcaacttgtggacccgacattttgggacccgacttttggggatcccgacatttggggacccgacttttggggatcccgacatttggggacccgacttttggggatcccaacatttggggacccgacttttggggatccctacatttggggactcgacttttggggatccggacatttggggacccgacttttggggatccggacatttggggacccgacttttggggatcccgacatttggggacccgacttttggggatcccgacatttggggatccaacttttggggatcccgacatttggggatttaataaaacaaaaaaaaattttaaattttatttttatatccaaaattagacaaatttaagtctgctttagccagatttcattccattgcaagaaaaaaaataataatattttttaaataactctttttccggactgagattttctttgcaagtgagtcaaaaaaaaaattaatttaaagcaccgcacaaagtcactcgaaagataagaaacagaaaagatgatctcggcatttgttggacgcaattagacagcaaagtcgtctcgaactttttgaaggctcttgacgaattctgttcccgttggccttgggaaaggtattttaaataaa

SEQ ID NO: 62491 - DNA, 1213 bp, Heterodera glycines
  Genomic contig location: Contig_ID=SeqID_32160; Location=67..1279; Strand=-
  SCN-specific regions: Sequence locations=1-336,358-814,836-1213
  Gene Ontology: Cellular component=secretory vesicle
atggcggcgatgttcttacccgctgacggacaataccaattatgcccgtccaaaccgacagaagggattactgttactatgagctttccggaggaacaaaattgcactcttccggtggaaaagcctccactgacggtgaagtcaaatctttacataccaattcggatttcgcgagtgtttcccacatttaaatgctggaatgtgacaacagtcacatgcaccgagtcttttctccgaatcatgacgttggatcatcctgacaagaaaattgaagccgaagcttcagtcgaggactgtcaggcctcaatacaccattcgccaatgaacagagtgagcgagacaagatgggaaagtttggcgccaattcgaaaagagtacggatggtacggcgtgaattgtttcaacaatgtacagacagtgattgaagaaggaaaagcagagattttggatgggaaaaggctgataacttcgtggggagactctttaaaaattgataaaagcctgggggaagacggcagctggatcagactgccaggagctgtggaattgctcatgtggaaaattccatcggatgaattttggcattcacattttgtgattggcccagtaatcacggaaatttggccaaaaaaggcagtgatcgtggacgagctccaatacacttttccaataagccgaaatcaggaaagaaaatttcctgtgtttggagtgcctgaagatgcgctaaaaacggacaacaatgtttttgtgcatgtcattggtaaagtaaactcaaccaagggagcgcgtccaagacgagagaccgcgagtctaaaacctggacaaagaaaaccaaatgtgccgagaattgaaccaacaagaaggccgaatttgcgaagaggtcaaattgctgaaatcgccatgacaacccgtccaactattactaccactaatattccaccgacaattcgtcccgtctctacaacgcgtattccatcgacaattcccataatcgccactcatactccaccgacaactcgcccaattattacgactaatattccttcgacgattcgcccaattactatgactaatattccttcgacgacccgcccaatcgctactactaatattcctctgacaatccgcccaatcgctatcactaatattcctccgacgattcgcccaattactacgactaatattcctccgacgattcgcccaatcgctatca

SEQ ID NO: 62492 - DNA, 2252 bp, Heterodera glycines
  Genomic contig location: Contig_ID=SeqID_6686; Location=2703..4954; Strand=+
  SCN-specific regions: Sequence locations=1-12,34-1383,1406-1748,1770 -1939,1961-2252
atgaccgaagaatctgtaatcctcagtttttcctgtctgtgagtaaataaatacctatttaatttacactttatatttgaaaacaaaactttacaagaaatttgccacttgaatgttctgatggctgccgattggtaattacagcgcgatcggataatgacgcaaattttgttgaggtgtctttttttgaatttaatttccttttttgattagcctacctaaaattgtttcgctgttcaaagattggccaaacagaaacacggaatggcattaacccgaaattcgaggcacgggtttcgttgcttctgcggttggacaaatgccaacagttgcgcattgttttgtgagtccacttgatttgcaatttacaattcttttttcaatttcttatttattaaatcaaaaatgcaggtactccgtcgatgttcagtctggtcttctgcggacactgctcgccgacgcgcatgttttgctgctggcattgctttgtgccggttctaagccggtcgctgtgccgctggcacttcacttactacaaaaagccctacaccaacagtcgttggtgctggccgaagccgtgcagcaggaggaggcgagcggaagcgccggcggaacgcgtgagacattgacatttttaaataaacatccaacttttaaaatgaaagtttttgtctcacaatcagttttccaatttgtcggccacaatttggaaacgcccggactgctcaccgccccttattttgtgttggaattggtgccaaaaagcgaaactgacgagcgaatgccagtaaaaattagtttttctaattctgcaatattttcattctatcatcagattttgctctatcgcagtgaagtggcgcaccaaaacgcaaatccccgctggcgcgactttgtgcttccgtccaaatttttccccagctctttggaatggatcttgcgaatttcgtgccacaatttcaattacaatcgcacaaaggacgaactgatcggaagcgcaaccaccaatttcttccaattgctcaattcgaacacaaaatatttggtcagcgacgagggaggcacatagtcggtgaaaaacgaagataatttattttttgaggcttaacttggcaatttgtttgaataatttgtcgtctttccccttcagttgaggccgggccaaaagagcaaagacccttccgccagcattgaacttgtccgcgtgtgcggtgcccccgtgccgacatttgtgagccgactgaaattggggtgcaatttgcttaatttagttcggcatttacctaatgctgtttcagtcagcaattccattgcacaatcgctgtcgacttcacttccaacaacggcggcccaaatgaccccaattccctccatttccgttagtttattttaagaagaaacaaaataagtaattgtcccttttacccttttcaagtgcatccccatgccatgaatatgtacatgaatgcgctgggtgccattgccccgccgttggctcgactcgaaaagttggagcagtacacacgacacaatgtcgctttgtctgatatttttctgattttccaggctgggcagactttcactgctcggattcggtgccaaagtgccgcccacttttgcgttttccaatatttttgctttggtccgtgtctttatatattttttattgaatgaatttctgatttttcagaacggaacattggacaattcctatgtccgtggagtgagcgacgcactaaacagttacaggtggaagatttccctgaaaatgtttaatgggtcaaaaaatccctcagaaaaatggcgatgtccgtcctcccatacgcacccactgaatacgcccaagtgattcaccacgtcgtaaagtgtgcttataatcaacccttttaatctgtgcaacaatggacggacgttttccaggttagcaaaagcatccgagaaggcacagactggccacttctttctgctggtcattctgacgaacggagtgatcaaagaccaccgggatacggtggacactatcgttgaggtgagttacggtacgacaccgtccgtggagaaacactcattttggcataatccatggggaaacttcaaggagtacaaattgtttgctttttgtctaggcctcttcgctacccattgccattgcatttatcgccgtaagcaacgcgcaccatccatcgcaggtaaatgctggagaaaaacgcccaatttttttttattttgattgtttttgaaatgactgacta

SEQ ID NO: 62493 - DNA, 503 bp, Heterodera glycines
  Genomic contig location: Contig_ID=SeqID_6686; Location=7503..8005; Strand=+
  SCN-specific regions: Sequence locations=1-7,29-503
atgggcgtcgatggaggcaaactgcgtgcggtgatgcgacacatcgaaataatgcgacgggaggaagcgcagctgcgcaatcaacggcactatcagctgcctgaaagaaaggtggcgcgaacaatcgatggattgggggggggggggaggaaaaggattctaaactgatcagggtgatggaaccgactgagaagaccaatgagcaaatcttgagaccgaaaatctccaaaacttgatattttctcggtccaataacgagactctcgaattgtaataggcacaaaaatgcaaaagtgctcaagatggtcagaaatgcgctttttcgcagaatcacacgccgtcagtgtcttttctggtcgaccgtgattcgtttcaccgttccgtcgacgtcatagacagcgagaaagtccagtcgaaaagtccattcgcagccaacacaaattcacacgcaaaatttcaaaggaatgatgacgggtcaaccaaactgatggcgagggaagagt

SEQ ID NO: 62494 - DNA, 259 bp, Heterodera glycines
  Genomic contig location: Contig_ID=SeqID_32163; Location=1439..1697; Strand=+
  SCN-specific regions: Sequence locations=1-20,42-259
  Gene Ontology: Mol. function=glutamate transporter activity; Cellular component=integral to membrane; Biological process=dicarboxylic acid transport
gttttgcgccgttccctcaaactgtgccgtgcccatttgctcctctcgctgacaatttcctccgtttttgtcggcctttttctcggattcgctcttcgcattttccaactttcccctgaaaccgttcgtctcgtcaattttcccggtctctccttcgcctaatgaatgcccttttcaatccgtccgattaaaggcgaaattttcatgcaagtgttgaaaatgatgattttgccgttgatcttttcgtcgctcgtctccg

SEQ ID NO: 62495 - DNA, 133 bp, Heterodera glycines
  Genomic contig location: Contig_ID=SeqID_32171; Location=76..208; Strand=-
  SCN-specific regions: Sequence locations=1-133
atgggcgtgctcactttgaacatcgaatgtcgcgagaagggcgtcaaaaagacaatgcaattcgaaccgcgcactttggtgcacgacgcgtgccgactgatcagagacaaattggggcatatgccgggcaatc

SEQ ID NO: 62496 - DNA, 1336 bp, Heterodera glycines
  Genomic contig location: Contig_ID=SeqID_6687; Location=246..1581; Strand=+
  SCN-specific regions: Sequence locations=1-262,302-537,560-672,712 -748,770-915,938-1035,1057-1189,1211-1336
acatcgcccgatgcatcgctggtgaagtccctcctctaaagaagcccaaacatcgtgccgccgatgcgagaattcttcgacttttgcaggaatacaatgccatcaacaataacccggctatccaaaatgaccacaattaccatgccaatgttaatcccgataatatcatcaatttgctcgttggtattctcgaaattatgaaatgcgcccgtaatttttcaatgcttgttatttttttgttgttgttaacacattgataaatatgttatgttattaattttaaacattttttcggaaaaaatcagtagaatctattttggacaaaaacagcttgccgtactaaactgaccctcgtactaaaccgaccctcgtactaaaacggccgtactaaaacggccgtactaaaccggccgtactaaaccggccgtactaaactgacccggtccgcctttttttgacgtttttttccgattttagtgcattttttggcgttttttttccgaaaattccatcaaataaaatacacctttaagaaatgacttgaaaaattttcagaaaaaacatccctaagaattgaaaaaatttcagaaaatacacccctaagaattgaaaaattttctcaaaaattgatcgccaaaattcattttttttcttgataaaaaattctcggtttaaaaattttccttattcgaaaaacattataaaatatttaataaccatttaaatgaccaaaattaagtttttggttaagttttacgtgttttgctccctaaaaaaccttagaaaaattttttaaaatgcctttttttcatgcctttttcgcgattttcgtgccttttcatgcctttttttcaattttttggtgcctattatagtgcctttttcgcgatttttggtacctttttatccgagctctaattataaaattaaaaaataacacacgattaaaatgtcttttttcaatatttttacattattttcagtaccgttaatttgccattaattcgacttttgttgcgtaagggccatgtctttcttccacttctgcaattgtcttgtcttggcttatgctccccatttcatcgttttccggtattcatcgctttccgaatataccaatatttggaagtgcggccaagcagcgattggtaaaattcttttccaattatattcctaattaccccattaatttaagtttatttaattactcaattcgtcaaaatggtatttttttcaatttttcaaataaaatgtacgtctttttcagttgacattagcaacattttttccaattgctgaaaatggcgagtacagtttcacttatgtaagtgcatga

SEQ ID NO: 62497 - DNA, 628 bp, Heterodera glycines
  Genomic contig location: Contig_ID=SeqID_6688; Location=190..817; Strand=+
  SCN-specific regions: Sequence locations=1-85,115-628
atgaagcgatgtgcggcggaatacgagcgaaagtactgcgttgagacggacaccaaactgaaacagcagacgacgaagaacaaggagaagaagcagcagcaacagcaagacgaatcgccggaggagtattacccgaccaattacgaggtgggcaccggcgaacatggacagataagaccgtcttcacatcaggcttttcctaggaccaagccatgatggtcctaggggggggggttactaacccccaagacccctccacacgaaattttatgcgaaaaaagcatcatatgcttaaaattttcgttttttttgataattacataaacgcttgttttttcttggatttaattttcttttttagcccgccttcaattatgacaaattgcatgtgtccgatataatccttccgtaagtctattgcaatctatttaaaaaacacacatattacgtacaattagacactaaaacttcattttgtagactgacaattcatcaaaaggataaatatcaagcccaaaatggaccgactaaatacgaaccgaaggcggaaggacagcacgtgacgagttcagtaacaaccgcaggtgttcaatacaataatatcctgacgtttcaaaacattttttga

SEQ ID NO: 62498 - DNA, 923 bp, Heterodera glycines
  Genomic contig location: Contig_ID=SeqID_6689; Location=646..1568; Strand=+
  SCN-specific regions: Sequence locations=1-163,193-280,305-517,543 -547,570-923
atggttttccggcaacgttcatcaccaactgaagcacagcatcaacagtctgccgaagatcagcaaaaggcaatcgaagaaaagaaggaacaaacgcggccagaacaagcgaaaaatgttccccccgaccaacaaaaggaagagcaaacggaggcaatttccaagcaggaacaacagcagcagcagaagaagggcacggacaatgaacagcaacaccaaacaacatcatcatcagcaacatcatcttcaacttcaactgaggtgcccaaacaacagtcatcatcgccgccgccacctcctcctttcactcagttgacggacaatggctcagcgcgacggcaccgtcgtccgtcccgctgtgtgcgcaaagcggtggagaaatgcagttcgttctccaggtgcgcggacggaacgggccgagtgcaaaactgttggcacaaagggaacgacatggtgtttgacgaaccgacgcaggaatgccgaagtttcatgacattgccggactgtcagagaggcaattttggcattttctaattttatgccattttgctgttgtcctttttagaatcgtattgtgtcaatcgtccgttgggtccaacttcgttgggcggtgtttgctcaaaggtgctaaaacgattaattatgacttgagtatctgaaattggaatacatttcccgttttcaggtggccatcatttgtgggattccgcggcagcaagacggcactgacaccgcgcccttcgtgtgccgtggcgtacgggtgctgcatccgcggaacaaggagagatgcgtgaatgacatcatggtgccgcaatgtgctgaactgctttcttagcagattcattgttgatcaattacaaaacagatttatcagtgatcaatcagattatgatggcacattaccaaatgtttttttaaccgga

SEQ ID NO: 62499 - DNA, 489 bp, Heterodera glycines
  Genomic contig location: Contig_ID=SeqID_32172; Location=83..571; Strand=-
  SCN-specific regions: Sequence locations=1-17,40-275,306-321,343-467
atgaaatcgttcggtaataaattttaaaatattcatgaaggataaattattttaggactgtcttccgctgatcagatcaatcgtcgcactttacgatcacttttttgtatcatcgctgtgaatattggtggatatttcatcaactcattttatatgaatctgatcaaatcctcaatttcatctccgatcactgcttggtttgatcaagtaatctccgcaatccctttgaacattggcgcggcatcaaacggaccaattttatacttaacgaggcgaattaaattttaattaaatttttaaatttagtacggagtatcgactggcattccaaacgcagttcccatttgccttcaaacaaatttccaatcaaaatcaagtgataccactccagcagcagaatggacatccacgcaattagtcactacaaattctcatttgatttccatttatcctgatatatatataaaaaatagagaaaaagttaattaa

SEQ ID NO: 62500 - DNA, 48 bp, Heterodera glycines
  Genomic contig location: Contig_ID=SeqID_32174; Location=1156..1203; Strand=+
  SCN-specific regions: Sequence locations=1-48
atgaaaatgattataaaaaagccatggaaaaacagagagaatttgtcc

SEQ ID NO: 62501 - DNA, 449 bp, Heterodera glycines
  Genomic contig location: Contig_ID=SeqID_32175; Location=1185..1633; Strand=-
  SCN-specific regions: Sequence locations=1-100,123-166,191-222,258-449
ctgataaattggcatgaactgtcagcatataaaatcgaaaagaataaaaaaacatatttgtatattgtaaagaaatctagctaccaagtggattgtaagtttaaagtaggaaaacatgaacaaaataaaagataaatacaaagtgaggaaattatggatttctaacaaaaaaaattattattattatattgagctacaaacagctgaaaattttattatgcgattatatttatcaaaattacataaatataaatattgctcaaatctggcgaataaaaatttaaatatcggatttaatatttacttttaggttctaattataatgaatgaaattgctaaatgtcttggatttaaattttttgcaaaaatgttcaagcacgacgttgagatccatacttttaacgaacgacacgaataacatcaacttcgagcgaatggttataaataaa

SEQ ID NO: 62502 - DNA, 1092 bp, Heterodera glycines
  Genomic contig location: Contig_ID=SeqID_32176; Location=351..1442; Strand=+
  SCN-specific regions: Sequence locations=1-68,90-668,691-919,941-1092
atgactgtggggcacagcgacccgctcgtgttcgacggatgggccgaagcggacgcggacgcactcggagtgatcgcggacacaatttgcagggtacaaaaaacaatttgttgatcagtggcgaggagacaatttgggcaccagaagattgagttccgcccccttcagccaatgaaaatcaacaacaaaaatgccgtctttcaggtcattcctcaagctcggggtgaacagccggagacggcgatcagttggccaacccgtgccaccagcgcgccaagcagtgcgacaacggtagaaaaaaaatatccagatttaatttggcattttataaaattgcgtttaaattgcgccatctttcaaaagagtgacggagcgtcgcgcgactgcactcgaattgaacacgcgttggacttggtccttgtggtggactcgtccaccttcagcgctgaacagttcgcaaaggttgttgaagggctggccacgttggttgacgagtcgttcgacttggcccctgacgttgttcgagttgggctcatcgtgtacaggtcgagtcgtcgatttgggaaggaaaatttaaacgaaaatcgacatttttcagtgaaatggtcgctgtgccggtggcacttggccattacgaggacaaaattgagctgttgtccaaaatggtgtctgccacacacaaaattaatggtcagtgtgtgctattttgcccgagggaattcgttcacctcattaggccaattaaggcacaatggcaattgccctgcgcgggttggaagcagcgcgtcaacagtttcagttgcacgggcggcaaggtgtgccaagagtggttctgctgctgaccaacggcaaacacaggtgggtggatggacattcgcattggcccacgtggtcttgttaattataattttaatctctcgaattcaaaaccatttcctaattgatagaggcaacgcggcccctgtcgccgccgaacttcgcgaacagctcggcgtccaaattgtcgccgtcgctgtcgccccatcgttggaccagctgaacacgctgacgcgaattgtcgccgacccgaccagcgttgcagcggcgacgacg

SEQ ID NO: 62503 - DNA, 231 bp, Heterodera glycines
  Genomic contig location: Contig_ID=SeqID_32177; Location=787..1017; Strand=+
  SCN-specific regions: Sequence locations=1-231
atgaagtcaactttcttccaattaacattctctgttaaaaagggttttctcaattttcttcaacaaaattcttttgtatggcctgaaatcagcactctctcatttttgcgttgtgtaagtctcctgattttttagcgccaaaaatttttttaaaaatcactgcaattaattttttttcagggtcgcttctaggggggggggaagtttgggcaccaaattaaggatttaaaa

SEQ ID NO: 62504 - DNA, 91 bp, Heterodera glycines
  Genomic contig location: Contig_ID=SeqID_32179; Location=1038..1128; Strand=-
  SCN-specific regions: Sequence locations=1-91
agccgattgggacaacgacggaacgccatcgccgccgctcattcaaacggcgaccattgcgctccaatcgttgctccgacttttgcaacaa

SEQ ID NO: 62505 - DNA, 108 bp, Heterodera glycines
  Genomic contig location: Contig_ID=SeqID_32180; Location=819..926; Strand=+
  SCN-specific regions: Sequence locations=1-108
ggtgtgcaacgacccgtttggacgcgttcgcaactgccgccggcttttgtcgcaaaaatggaattatttgaacgccaacacgcggccattgcgaaggaatgcgaaagg

SEQ ID NO: 62506 - DNA, 813 bp, Heterodera glycines
  Genomic contig location: Contig_ID=SeqID_6690; Location=143..955; Strand=+
  SCN-specific regions: Sequence locations=1-93,148-186,208-687,709-779
  Gene Ontology: Mol. function=choline transporter activity; Cellular component=membrane; Biological process=choline transport
atgtcttcagcagattcatcaattttgtcagctgcttcaatgtttgcgcacaacatttggaagctgaccatcagaccggaagtgtgcttaatcattaaatttgaatttaaaatttaataataaaatataaattctattaattaaattgggggctttaaattggtttatgtgtgaatttgaaattttaaattttttataactcaaggccagcgagcgtgaggtgatcatcatgatgcggttcggcataattgctgtcagcatattggccaccgtgatggcactgacaataaattccatctatggactgtggtatctgtgcgctgatctggtgattattttgatgcatttaatcattattgattggatcagttagtctcatgtcattttaatgattgctctaatccgagcataattacgtttgtctgatcactgaacaaatgcaacaaatgactgtctgtcatccatttttctctagtctcatgtgtatttgtctgatcccggacataattaaagtttgtctgatcactgatcaaatgtaccaatgactcacctgtcatccattttttgtcccatgtctttaacgattgatccgatccgggcataattatgtttgtctgatcactgatcgaatccagtcaatgactgactgactgcctgtcatccatttcccctttaatcccccttcaagatctatgtgattctgtttccgcaactgctttgtgtggtctacttcaaggagagcaacacgtacggatgtctgtgcggatatgcgagtatggatttttaaatatttgttttttaaaatttttttaa

SEQ ID NO: 62507 - DNA, 1090 bp, Heterodera glycines
  Genomic contig location: Contig_ID=SeqID_6692; Location=39..1128; Strand=-
  SCN-specific regions: Sequence locations=1-203,225-859,881-1090
  Gene Ontology: Mol. function=ubiquitin-protein ligase activity; Cellular component=ubiquitin ligase complex; Biological process =nucleocytoplasmic transport
tttcaatatttgtgcaaccagttgaaaaaggtgaagaaacaacggaagaaagcgcaactcaaaaaaaaaaaaaagaacaacactgagaaggatggagccgcggcacagcagcaggcaacgacatcgaaacctcaagccgacacacacgcgaaggaggaaagtgacgaggcaacactggtccggaacatggtcgatgagctggcgccactttgggaggagctgagcaattgcctgtcccttctcgagaaggccgaagattcgcaacctgcggttttgtatttccaaaatggtcgggtttttttcattggataaataacgcaccaaataaataaataattttgtcctttagctgccgaggcgtttttcctctcttattcgttggtgataccgcaaactgctcaattggctccatctgcactccctgaaactgcaccaactggcgattcttcacctcagttggcctcctctgctgcgggcggcaactccggcgaggatgagctgggccgataccagaaggaaatgttcacttttgcgggttagaattttcgctgccaattgattttaattacactgtttttattttttacagaaaaacattaggggaagggtcgatccccccgcttcgaattttctgccgaaagtttacttaagctcgccaatgccttcccataatccccccccccccccctcccttacaaagctcacgtatttcaaactagctcattttaaattggtattagatatcgtcacgaagacgttgcaatccgtgtgcgccggtctcatttgttcggtgacagttttcgcgagctctatcgattgcgcccgaatgattggaaggcgagactgtacatcattttcgaaggagagaaggggcaagacaagggtctaatttttttgcttttgtttttttgccttgtaataccccagaaattctgttgaaggtggtctgttgcgcgaatggtactcattgatcacaagggaaatcttccacccggattacgctctgttcatcactgctcccggcgaccgagtcacttacatgatcaacaagaactcttatgtcaatcccgagcatttgggcttcttccgg

SEQ ID NO: 62508 - DNA, 879 bp, Heterodera glycines
  Genomic contig location: Contig_ID=SeqID_32182; Location=557..1435; Strand=-
  SCN-specific regions: Sequence locations=1-8,40-40,98-103,167-180,210- 246,274-490,523-531,575-879
ccgctaaatttgccaagcccgttcccttggctgtggctttgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 62509 - DNA, 267 bp, Heterodera glycines
  Genomic contig location: Contig_ID=SeqID_32183; Location=1125..1391; Strand=+
  SCN-specific regions: Sequence locations=1-126,151-267
attttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaacgccaaaaaaatgcgaaaggcgaaatgcgaaaagcgaaacctaggcacatccctggt

SEQ ID NO: 62510 - DNA, 1304 bp, Heterodera glycines
  Genomic contig location: Contig_ID=SeqID_32186; Location=161..1464; Strand=-
  SCN-specific regions: Sequence locations=1-761,783-1304
ctgttcacttcatccgctggcgtgcctcttcctccaagcgtgtcgttgaaaaaggccaatcagttggatgcctctgcgttaaacttggcaatgcaaatgcatccgttcgatgcctttgccagcggcacttttcttccccctaacggtccttcgctgtcaaatgggggcgatggcgggtcagtcggtgccgtccttgcctttctgctgatgcgtccttttcagagtgtcccccacctccgctctgtccatcccggccctgctgatggcctgtgcttctggccaacttccccaaggctgtttggcctgtacttatcgtctgaaggatggccaattgtgcggctccattttcccaactgaggagcagttatttgctcactacaaaaacgcacacatcggcaagcagagttcccccaacgtggtcagttccacgacttcccaaggggaacagtcggctggaacggtgacagtgccatcgactgctgtgacgacttcggctggcaaaaagggcccggctggctcgccaagttcatctcgctccacaccgactcatcagacaaacaaagtgtcgcagaacagcgcaaagggcgccacgccaaatgcaaaaccacactcaaaccccggggcaatgttcaacaacaacggaaccgcttggccctcagttgggctgcccccaggaatacttccgatgggaccgccgctgtgcctgcagcagcagacggcacaacaatggaaagattgtgagttttgtgaaggggtgcgggtgaagagccttggcaacaaatcaattagcattaatgagttgcttggttttcagcctccccattgccttgccaatccgccggcggcggcgcttctgccagccatcgcttccatccgtatgctcagcagcccaatggtggcaagcagagttcacagactcatcagcagggagtgaccccaaatttacaacaaatggcgatggcaatcaacaatttggtcggtgttttgacttgcattgctcttcgttgatcaatagcttttttcagggactgttcgccaatttgggggcattgccaaccggcggctttttcccgccgggcgttgacttcgccatgctggcacagcagcagttggggcagtcgccggcaggggcccatccggcaacgccgccggccacgaccgtccaccagcaacagtcgcagctggcagcactcgcagctatggcaaattccattggatcgaaaggcggcacatccaatgggacgacaatggcacggcaacaacagacgggcggaattgcgactttagaggcggtcgacggatga

SEQ ID NO: 62511 - DNA, 1383 bp, Heterodera glycines; identical to SEQ ID NO: 32188
  Genomic contig location: Contig_ID=SeqID_32188; Location=1..1383; Strand=+
  SCN-specific regions: Sequence locations=1-105,130-681,703-724,759 -986,1008-1383
  Gene Ontology: Mol. function=protein binding; Cellular component =nucleolus; Biological process=growth

SEQ ID NO: 62512 - DNA, 146 bp, Heterodera glycines; identical to SEQ ID NO: 56264
  Genomic contig location: Contig_ID=SeqID_32190; Location=112..257; Strand=+
  SCN-specific regions: Sequence locations=1-79,113-146

SEQ ID NO: 62513 - DNA, 146 bp, Heterodera glycines
  Genomic contig location: Contig_ID=SeqID_32190; Location=364..509; Strand=+
  SCN-specific regions: Sequence locations=1-79,113-146
atggctatctctttttttgagaaattttctatgcaacaaacgctctcgaacatgaaacgaagtgcggtgcgccatggccattttatttttcaaataatttttatatttaatagatattccagaaaaatggctatctctatttttga

SEQ ID NO: 62514 - DNA, 146 bp, Heterodera glycines
  Genomic contig location: Contig_ID=SeqID_32190; Location=616..761; Strand=+
  SCN-specific regions: Sequence locations=1-79,113-146
atggctatctctatttttgagaaattttctatgcaacaaacgctctcgaacatgaaacgaagtgcggtgcgccatggccattttatttttcaaataatttttatatttaatagatattccagaaaaatggctatctctttttttga

SEQ ID NO: 62515 - DNA, 219 bp, Heterodera glycines
  Genomic contig location: Contig_ID=SeqID_32190; Location=868..1086; Strand=+
  SCN-specific regions: Sequence locations=1-79,114-219
atggctatctctatttttgagaaattttctatgcaacaaacgctctcgaacatgaaacgaagtgcggtgcgccatggccattttatttttcaaaataatttttatatttaatagatattccagaaaaatggctatctctttttttggcaaatgttagggacagaaaattggacatgccaggttggcaaacacattttcaagcagaagttgccggtataa

SEQ ID NO: 62516 - DNA, 277 bp, Heterodera glycines
  Genomic contig location: Contig_ID=SeqID_6693; Location=1407..1683; Strand=+
  SCN-specific regions: Sequence locations=1-44,66-277
atgtcaaacaacgaaaatgaaaatgtgatgaatggagaagccgtgggaggggtggaaatcaaagtggaagccaatgaagaagtgaacacggaatcgcaggaggacggagaggaggcgaaaagtgagcggaaaatggcatgaaatcgcttacgcttaatttgttaattggaagttctaacaaattcgcaaataagggatgttttcagttccccagttcagcaaagagcaaatggaacgttcggtgatgtgctgcacaaacgaaggcgaaattgtcaat

SEQ ID NO: 62517 - DNA, 557 bp, Heterodera glycines
  Genomic contig location: Contig_ID=SeqID_6694; Location=118..674; Strand=+
  SCN-specific regions: Sequence locations=1-78,104-557
atggacaaatcggcagaagaaattcgggagatgctttgtctggaggatgtgagacttttcagtctcaacgacttcttttctgtttttgctcatttttaaaattttaggatttgaccgaggaagaaaaggcggccatcaccagggaatacgacattccgcgcgactttcccaccattccgttgccggaccaacccgagctcagtgacgtgccggggacgagcggaacgtcgtcaaattcgtcgaacaatgagggaaagaaaatgaacggctacgcgaaaaggtgaccgaagggaaagggcatcgaaactgaatgaatttctaagaatttttacatttatcgttcgcgtttttcgtgcgaaatttaaattcttttatttttagcgccgggggctcccgtcagtcgtaaattttcaattggatgaaaaaaggaccaaaaaacattttgattttgacgatttgtacaacagcaattgaaggacggcttggattctcttaatgactttgtattgttttcatttgtttctcattttgatttgcttcttcttaatttaacaaaa

SEQ ID NO: 62518 - DNA, 1570 bp, Heterodera glycines
  Genomic contig location: Contig_ID=SeqID_6694; Location=862..2431; Strand=+
  SCN-specific regions: Sequence locations=1-326,348-1115,1137 -1284,1317-1319,1417-1424,1463-1463,1518-1518
atggcaaactttccgcctaattctgacgaagagttcgaccgtggcaatttttcatcattgtcgggaatggtcggcatgaaccaacgacacttggactggttaatgaagtgagtcattacaaagttcgggtgagcactgacagtttcaattcttcagaaacatatcccgcgaagacatggccgaactccaacaaaggacggggcaatgcgcccgaaaggttggaaatgtttttgcggcattttgagtgaccttacaattagcaaaaccatttgaattcgatttcaaaatgtgctttttttagtgacttgcgccttcgattgtccaacttttatttattttttcagtgtgctgtgacgtatggaggtccgatcgtcgtcgttaccatcggtttcctcgagtttttgcgccgtaaacagaaccttccgatcacagcgccgcgctttttgatcggctaccccattgtttgtccgtttcccttccatttggttttttgagttgctaagttttcagatgtgtctcacttcggtggcccttggctcttccatcggcttcaaaaggtcgggttgcggtgcggaaatgcgactttttctcgacaagctctacgccaaagttagacatccaaagacaatttttttatgtttaaaacatacagatggatatttcctcgttttttcagtacgactcccaaatgaatgccgctagcgctcagatggcgccaggcgttggcggtggcacttcgccaacaaaaacctacgcccaattgcgcgaggccaaccgcgccggtcgtccaattgaattgggacagttgaagcaacagcaaacgcgacaacagcagaagaaaatggtaggcaatcacacaaaaagatgagggagtagttgctaacaattaaggacctataaatgaatttcaaacgcaaaacagttttaatacattatttaccagatccatggcgaaggggagggtccccaaaatgcaatgttttttgggtcaattttctttgtcatattagccaaaaaccaaaatgtgttatcctcctccgaatactttctagttaggctcctttttctgtacccatatacttacaatcggtcatatttaaccaaacatatacattaaggaaagggggcgggcagccaaattttttgcgaagatggtccagttatataaaccaaaaaatgatgaaatttcgtaactttgaattatttttgaaagtttgataattgatgtatttttaaggaattttgttcaaaatttcctcataaaaaaacttaattttttttttaatgaaaatctaagattcccctccctccctcaatgcgaaaaggtcccacccccattttgggcatctgcggcgagcaacaaaccttttgtttggtggaaataaattaaccaaataaatgtctccaggacggcaggaaagcgacgacggaagggactgagggcagcggcggagtgccctccgacgagtggggccgtttcgggttggacggagtgttcgccccctctccgcccgcttcgtcttccgccgatggcaccgccccttctccaccccgtccaaaatcgttctga

SEQ ID NO: 62519 - DNA, 735 bp, Heterodera glycines
  Genomic contig location: Contig_ID=SeqID_32192; Location=743..1477; Strand=+
  SCN-specific regions: Sequence locations=1-91,113-157,179-190,223 -363,385-735
atggcagcgattggagacgaaaaagagcgagctcatttcgaaaggcaaattttgaacaacagcgaatttaggggagaattgaaaacgatggaagaaaaagaaaaagccatttcaaagggccagcggaaaatggagccaaatgaaatagcagaattagtggaaaagcatttcaaagtgatgggcgaacacaaaatggagggcgaagaagaagaaaaagcggaaacaaaggtccaatcgagaggggtggccaaatgagaggcaatttggccaaaaagaaacatttaaattatgaaaaataaaaccacaaaagcattttaaaattaacataaaacagctagcgattgccaccaccaccacaatttttaggtaaggcttcttctgctgatgctattcggcattatgccaaagaataagcacatggaaggcaaaaaaatatgggaagagaaaatttggggaaaaaaatggcaaaaacatttaaaagatttaatcaaaaaaagacaagtcaaagtatcaaacaccaagcagttgggcacggacaacttggagaaggtgaagaacacaacggtacacctcagttgggctgtcacgtttgggccggcacggttgggcccagcatgtttttccagtataactttctttaacttttttcgttgtcatccatcctccaacattgttgatatcattcggaagcataacatgtttagaagcttttctaagctattgagtcgcgattag

SEQ ID NO: 62520 - DNA, 81 bp, Heterodera glycines; identical to SEQ ID NO: 58971
  Genomic contig location: Contig_ID=SeqID_32193; Location=1581..1661; Strand=+
  SCN-specific regions: Sequence locations=1-13,47-81

SEQ ID NO: 62521 - DNA, 480 bp, Heterodera glycines
  Genomic contig location: Contig_ID=SeqID_32194; Location=7..486; Strand=+
  SCN-specific regions: Sequence locations=1-480
atgcccgcccctgggcaatgcctttgtcgccgtcttccgtttgctcttccgctgcttctccttttgctgtttcctccgcctctcattccgcacttgccaatttcttccgcttccgctgatcagtgccaagcgccgcccctccgcatcggtgtgctccttccggacgcataccggcgccgcgtggagccttggctggcattggcccaacggcacatccgccagttcagcgccgcaccgacgccaaagtgccgtaaatggggcagtgttttgcgtatcaattcgctaatcagtcagcttttcctcggcagttcgtctgcccattttcttcgtgcccattgcctccaaatgatccccaaaaacacggactgtcgcccgtcgttgggactgaaggcgcttttcgatctgatggccgtctctgaaaatgacaaagcattggtgggaatgggaagtgatcagtcggcacaaaaccatcagaattga

SEQ ID NO: 62522 - DNA, 1187 bp, Heterodera glycines
  Genomic contig location: Contig_ID=SeqID_32196; Location=98..1284; Strand=-
  SCN-specific regions: Sequence locations=1-148,173-337,375-404,426 -674,696-957,982-1187
atgcccgaaacttggcacattctctcatgtcgtcctcgtcgtcgccgttgttttatttttttgttgtataaagcttatgtcgccgtttggagaccggcggcttttcctttgcttatcggcatggagagacagttgggagcacttttattggtgagaaattctggccaaatttggccaattttgtgccgcgcgaaaaatagcactctttggtgccgcctccccaattcatttccacgccctcctcccccatagaccacattcatcgaattggcattgttattacgtgtggtgcgtgtgccatgccatcaattcatttcttgggcaaaacaaacacactttaattggtgggttaaggaaattataaagaaattaatgggcaacggcattttttaaattcaatattcttttctttaattttacttttattgatcaatacaaatttacatttaatgcgataatagagatctaacagggatgggacaaattgaaaaataaaaagcgaaatgcgaaaagcgaaatgcgaaattttttctacaactttttaatagttaaaatcataaagcaaaaatcattttttaaaattttattccaaatttaaaaatcaataaaacgcttttttgaggcgcgctttttccaaaaaaactttttgggaagagggggcaggcgccgccgggaaaatttttgaaaatttgattaaaatttgttgacagattttcactaaaaaatgatcaaattttgtgatttttatcatttttctaatgagaaataagagttttggcgcgctgctgagaacagtttttcatcaaattaccaaattttgcgattttgggcaattttctaagaaaaaataggagttttgggggcgcggcggtgccgataggtgccgccgggaaaaaaattggaaattttgatcatttataaacagtttttcactgaaaattagccaatttataggtaaaattttgaaaaattttatgggaatttaatccaattctcaggggtgtaaaagtcgcttttcgcgccaaaaagcgaaatgcgaaatgcgaaacgccaaaaaatgcgaataatgcgaaaggcgaaatgcgaaaagcgaaacctcggcccatccctggtgtcgaactcataacaaaaaatactgttagttgtgaagcactaaccactaaaccacaaatattttataaattaaa

SEQ ID NO: 62523 - DNA, 386 bp, Heterodera glycines
  Genomic contig location: Contig_ID=SeqID_32198; Location=1..386; Strand=+
  SCN-specific regions: Sequence locations=1-34,58-386
aagcattgtacagcataattaaaaccgaaaataattttcgtatattttccccaatttatttcaaaaagccaaaaaaaaatgattaaatttgaaaacgaaatagtgcacaaaagggagggatggttagacgaaaagaggaatttttagaaaagagcgcaccccatctgatattcccatttttccgttccacaactggccaaaggcgactgtgctaattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaa

SEQ ID NO: 62524 - DNA, 362 bp, Heterodera glycines
  Genomic contig location: Contig_ID=SeqID_32198; Location=748..1109; Strand=+
  SCN-specific regions: Sequence locations=1-362
gcttaaaagcattttactgcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaaatttggaactgtcccgcctcacggcggggcttaaaagcattgtactgcataattaacagctatgataattttcgtatattttt

SEQ ID NO: 62525 - DNA, 405 bp, Heterodera glycines
  Genomic contig location: Contig_ID=SeqID_32199; Location=352..756; Strand=+
  SCN-specific regions: Sequence locations=1-135,157-277,299-313,403-405
  Gene Ontology: Mol. function=pre-mRNA splicing factor activity; Cellular component=nuclear speck; Biological process=mRNA splice site selection
atgagtaatcgagtttacattggccatcttgcttcgcgcgccaccgaccgagatgttgaacattttttccgtgggttcggtcgaattcgcgacgtagttcttaaaaatggctttggatttgtggtctgtttgttattgcttttattttttacagtctgttttaggagtttgaagattcgcgcgatgctgatgatgctgtttacgagctcaatggacgtgaactgctcggggagcgtgtagtagtcgaactttctcgtcgtggtggtaacaaatagtgattttataattaattatttttcgtttaggaccctatggcgggggtggcggatacagcggaggaggtggcggtggtggtgggtatagcggcggtgggggaggatttggcggatatcgcggcggtggggc

SEQ ID NO: 62526 - DNA, 1971 bp, Heterodera glycines
  Genomic contig location: Contig_ID=SeqID_6698; Location=312..2282; Strand=+
  SCN-specific regions: Sequence locations=1-25,49-369,400-468,493 -533,563-753,779-825,862-905,928-1093,1115-1125,1148-1150,1235 -1316,1348-1355,1429-1441,1578-1597,1623-1626,1649-1971
  Gene Ontology: Mol. function=DNA binding; Cellular component=nucleus; Biological process=adult locomotory behavior
atggcattggcacggtgtccgccgtcgccgcagcagcagccgccgcctctgtgcgtgcccactcgcgccccgtgctgcagtccaacgacagttttgagcagccctccttgctggtggacagcatcacttcggcgctgaacaatgtgaatgggccgggcggtggcgtcgccggcggcggattgggcgccattgccaacgggtaaataaattcacatatagtcattgtactggtagcagtacttgtacaaggatatggcatggccagggcgtggtgtgcggctatgaaaaatggaaaatttttttttggaaaagtttgccgttaaaaagcaaaaaaaatttccatggcggtgccttagaccctaaattcccataaaaattaaaaaatttgattaaaaaattgccattaattggtcaaaatctgtttaaaatcctttccggcggcaccttcgccaccacctgacaccaaactttaattttttttaaaaattatttccctagaaaaatgtaattaaactcgaaataatttctgaaaaatggtaataatttttctttttgtagggcacgttacggtgcgccgcccacactggtcaacggaggcggtggtggacaacatggtcaagcagtagttgctggagggggcggtgccggaggactccatggccacacccattcccatcacggttcatctggtggcggtggcacaacgccaaccgttgccggaccgccgacagcgatggcaccgccgccgcaactgcatcaccaccaccagcaccaacactctttgcatgcccaacagcaacatcaggccgccgccaccatggggattggaggaggcggcggcggaggagggcatgccgccctcctcgtgaacaacaaccatcatcatgccgcccccgcccacaataatcatcatcaccaccagctgcatcatcaccatggcagtgcgggtgccctgtccagcatggcgactagctcaaacggcatcaacagcaatggcacgataatgccgtcgttgacaaacggtatcgtcagcggcaccggtgctggtggtagtggtgccgttgtttcgccgtcccttatgcaacaacagtcgcagcagcagcaccaccatcatttgatgccggtccagtcgatgccctccttcttggcacagcaacagcagcagcagtcgacgcatcatcaccagcaacaacagtcgcaggggagcagcgccggcgccgccgccgcctccactttgttgtccgctgctatgatgaacggacttggtggttcgcagcagcaacagaagccattgttcgcgttgttcgacctcaaaatgggtgtgtctgtctgtctgtccctctgcttacaattagtctttctttatctctctttttatttctatcgttttttccctcctcctcccctctctttttctttttttccctcataattctccttcctctctctttctctctatctatcttttcttaactctctctttcgttctttctcttctccctttctctctttcaatctctctctttctttctttttctctctttctctctctctctctctatcgctttttctctttccttaactctctgccgtctccctatttttcttttaatattttcattctcgccctttccctttctctctctctacaactcttcactgtttccagatgaccatcatcaccaactcacttcctccatccatcaggacggtgccgcttctgctgcttctgccggtgcttcgtccagtcttcgttcagcaacgaccggtgcagccgctgcttcagtgccgtcaattaccacagcgtcattgccgctaagcggtgccaatggcagcgcactgaacggcattggtggtggcggcagtgttgtgacaacgccgacaaatgtgtgcggcggtggcgccaacaacatttggacatacgggccgtcctggggtgaggagaaccgaaacataaaatgccaattttga

SEQ ID NO: 62527 - DNA, 2130 bp, Heterodera glycines
  misc_feature (66)..(66): n is a, c, g, or t
  misc_feature (144)..(144): n is a, c, g, or t
  Genomic contig location: Contig_ID=SeqID_6698; Location=452..2581; Strand=-
  SCN-specific regions: Sequence locations=1-118,141-241,263-622,645 -648,674-693,830-842,916-923,955-1036,1121-1123,1146-1156,1178 -1343,1366-1409,1446-1492,1518-1708,1738-1778,1803-1871,1902-2130
  Gene Ontology: Mol. function=protein binding; Cellular component =cytoplasm; Biological process=actin polymerization and/or depolymerization
ttccacaaactcgcgcttcctgttcccgcccacacccgctctcacggcaacgcggggcgacaacgngctggccgagtcgactgttccgccgccagtgagggaagcggcgccgctgcccccagcgccagcgccgccgccaatggngcaggtgccgaacgaggaggacaggacggacaacttgagcagctcgatgtctacgggaacaaagggggaaggaatgaaaaaaaatgaaatttcaatgaaaaagtaatgaattttaaaatctttgtaagttattccctggcagtgccaaaaaaatctcaaaattggcattttatgtttcggttctcctcaccccaggacggcccgtatgtccaaatgttgttggcgccaccgccgcacacatttgtcggcgttgtcacaacactgccgccaccaccaatgccgttcagtgcgctgccattggcaccgcttagcggcaatgacgctgtggtaattgacggcactgaagcagcggctgcaccggtcgttgctgaacgaagactggacgaagcaccggcagaagcagcagaagcggcaccgtcctgatggatggaggaagtgagttggtgatgatggtcatctggaaacagtgaagagttgtagagagagagaaagggaaagggcgagaatgaaaatattaaaagaaaaatagggagacggcagagagttaaggaaagagaaaaagcgatagagagagagagagagaaagagagaaaaagaaagaaagagagagattgaaagagagaaagggagaagagaaagaacgaaagagagagttaagaaaagatagatagagagaaagagagaggaaggagaattatgagggaaaaaaagaaaaagagaggggaggaggagggaaaaaacgatagaaataaaaagagagataaagaaagactaattgtaagcagagggacagacagacagacacacccattttgaggtcgaacaacgcgaacaatggcttctgttgctgctgcgaaccaccaagtccgttcatcatagcagcggacaacaaagtggaggcggcggcggcgccggcgctgctcccctgcgactgttgttgctggtgatgatgcgtcgactgctgctgctgttgctgtgccaagaaggagggcatcgactggaccggcatcaaatgatggtggtgctgctgctgcgactgttgttgcataagggacggcgaaacaacggcaccactaccaccagcaccggtgccgctgacgataccgtttgtcaacgacggcattatcgtgccattgctgttgatgccgtttgagctagtcgccatgctggacagggcacccgcactgccatggtgatgatgcagctggtggtgatgatgattattgtgggcgggggcggcatgatgatggttgttgttcacgaggagggcggcatgccctcctccgccgccgcctcctccaatccccatggtggcggcggcctgatgttgctgttgggcatgcaaagagtgttggtgctggtggtggtgatgcagttgcggcggcggtgccatcgctgtcggcggtccggcaacggttggcgttgtgccaccgccaccagatgaaccgtgatgggaatgggtgtggccatggagtcctccggcaccgccccctccagcaactactgcttgaccatgttgtccaccaccgcctccgttgaccagtgtgggcggcgcaccgtaacgtgccctacaaaaagaaaaattattaccatttttcagaaattatttcgagtttaattacatttttctagggaaataatttttaaaaaaaattaaagtttggtgtcaggtggtggcgaaggtgccgccggaaaggattttaaacagattttgaccaattaatggcaattttttaatcaaattttttaatttttatgggaatttagggtctaaggcaccgccatggaaattttttttgctttttaacggcaaacttttccaaaaaaaaattttccatttttcatagccgcacaccacgccctggccatgccatatccttgtacaagtactgctaccagtacaatgactatatgtgaatttatttacccgttggcaatggcgcccaatccgccgccggcgacgccaccgcccggcccattcacatt

SEQ ID NO: 62528 - DNA, 1339 bp, Heterodera glycines
  Genomic contig location: Contig_ID=SeqID_32202; Location=116..1454; Strand=-
  SCN-specific regions: Sequence locations=1-76,247-281,592-643,665 -932,960-1339
  Gene Ontology: Biological process=protein biosynthesis
atgtacaagaaggagtaccgattggcggaaatcgatcgccaaattcaattgatgatcgatgcgaaggccaaaatccaggaagaagaggaagaagaagaacaaataaaggagcgaagagcatattcggagaagatcaaacgcgagcggaagagaaaggaaaaagagcaaatggaagcgaagtccgaggccaagcgaaaggaagcggaagagaaggccaaagaaaaagccaaagcagaaaaagaagaatggaaacgggcactccgacgaccggcagccaaaccggaagaaaaggcgaggaaagaagcggaaaatgaggcgaggaaagaagcggaagaggcagtaaggaaggaattggaagaagaggcgcgaaaggaaacagaagagaaggcgaggaaggaagcggacgaaaaagcaaggaaggagttggaagaagaggtgcggaaggaagcgaaagagaaggcggcgaaggaagcggacgaaaaagcacagaaggaagcagaagagaaggcaaaaaaggacgaagaagaaaaaaagaagtcagagaagcaacaacaaaatgtggaaaaaagagcggaagaaaaagcagaagaaacaataatcgccaggggaatcaaaaaaagacgcctaaccgaagaggaaaaggagaaaaaacagagcatggaaaaagttgaggaagcacacagagaaataagggaaattgtgaagcaggcagaagaagatgcaaagaagagagaaataaggaaaaaaatcgaaaaattgacggcaaaattaagtggggaacaaaatggcaaaagggacgaaaaggacacagcggaattggaaagggagcgcgaggcattcgaaaaccccccggcgccgccaaaggatcgaatgcctttctattccagcagcgtggcacgctttgaatgccaaagcgaattggactcggcacccaaaccgagagaaagagaagaaagaagtaaccgggaaaggatgagcctcggaacgagcggaaaacggctgttcgaaaacacactgaagtcggcgacgcagacggtgaatgagaaaccatgcatacccccagaagggctggggctcaaacgaagagaaagtgccatggaggaagccccgaggggaagaaggccaacaccagtcccaggccaaagacagttggagaggagcccaatccgaaaaaacaactcctacttgaagcgagcattggccctggaaaagcctgaagagacgatctacaaaattcgaaaactgctgttggaggccgccgaccgcctgtcagaattggcagatttgctgtacccctacgacggacagaaaacgaagaaggaagagacggcggaagaga

SEQ ID NO: 62529 - DNA, 814 bp, Heterodera glycines
  misc_feature (15)..(15): n is a, c, g, or t
  misc_feature (22)..(22): n is a, c, g, or t
  misc_feature (93)..(94): n is a, c, g, or t
  misc_feature (104)..(104): n is a, c, g, or t
  Genomic contig location: Contig_ID=SeqID_32206; Location=30..843; Strand=+
  SCN-specific regions: Sequence locations=1-172,195-304,331-374,396 -675,731-814
atgcgcacccgtcgnatctgcnaagttaagcaacgattgctgactagccaaaaggttcggtgccgtgatgaaacgaaccagccactgcttacnncgcggcaccnggcacggtcccccgaaggaatggatttaattaaattctctccttcggggattttttattaaggaagagagttcattatttatttgtcttttgcataattaattcataagtatttttacagaaactgctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatga

SEQ ID NO: 62530 - DNA, 92 bp, Heterodera glycines
  Genomic contig location: Contig_ID=SeqID_32206; Location=941..1032; Strand=-
  SCN-specific regions: Sequence locations=1-8,30-92
aaaatctattaaaaaatttaaaaatgagaattcatgcgagattttctggaaataagcttaatagggcctagttaagctgtaaaaaaaatttg

SEQ ID NO: 62531 - DNA, 83 bp, Heterodera glycines
  Genomic contig location: Contig_ID=SeqID_32207; Location=424..506; Strand=-
  SCN-specific regions: Sequence locations=1-83
cttggttggatggatagagcacccatgggttcttaagaaaaatggttttattttctgccaaatgagcacgagtgccgagttat

SEQ ID NO: 62532 - DNA, 802 bp, Heterodera glycines
  Genomic contig location: Contig_ID=SeqID_32211; Location=163..964; Strand=-
  SCN-specific regions: Sequence locations=1-87,109-374,398-678,701-802
atgttatcgaacagtactaagtcttcatttcaaaaattaaaaaaaagaaagacccaaaaaacagaaactgtcagcagcggtagcagtgatgatcaccatcagcgcaaggacaaagaccgtccaaaaggtaatggtgccagtgccaatgccgaccaacaacaacggcgcaaggatcgtgggcccatggtcggtgatgttgagcaacggattcgaacgacgacggaggtggcggtggagcttgctgaagcggtgccggagggggacgaagcggctgtgacgacacgccgcaagcgacggcaccaccaattgttggaaagtggagaagttgaagccgtatcagcagcaacaattgaagaacagcaaatagtggaactgccaccaccaccgcaaccaccacggacaatgggatcaacaacaacaacactggaaactagcggtaaaatattttgacatttaaaaaaatggccgattgggaccgcatttcggcaactttttgtgccggaattccgtattctggcaatttcagttgccgaaatgcctgcagaattccggcaatttttttttttgcgtaggattcatttttctattgatttgtttcaaaactttctgggaaaatttctgcgttaaatgattggctcccgtggagaacagggcgaccgatggtgcctgaaaattaaactttaaaaggaaatttggcaaagcattaatcattatgcaattattttagccatttttagctctcggcctcttttttattagcatcatcggacgcccaattcgtttaactggaatttctaattaa

SEQ ID NO: 62533 - DNA, 1862 bp, Heterodera glycines
  Genomic contig location: Contig_ID=SeqID_6699; Location=541..2402; Strand=+
  SCN-specific regions: Sequence locations=1-324,346-442,486-1011,1113 -1447,1472-1665,1687-1709,1739-1829,1856-1862
atgaggaaggagaacaacaaaagcagtgccgcctcagcagattctgatgccaatgccaaaagtggtggcgatgcttctctcaccgcccccactgaagaggaggcggaagaaatcagtgccaatgagcaacagaaggagcagcgcaagtcgctggacgcactgtacgctgcggcacgcgaggagttcgatttggacatgagccctttggacagtgcgatgaaaacgttgcgggagggccgtgagatacaaaagttgtccgtgctgcgcaacctggtcgagctggtggagggcgagccggacgaggcgttacaccgcctgttgcccatgatgcaggtaatgttttggaccagggccggatggaattaacggacttgcgaaattttatttctaattttaactgactttgcaccaaaggatctttcctcgtgggttttagggaaactattaaaaataagaaaatttaatatgaaaattttcataattatgtaaccaatttttaagtataaaaaaaatggcaaatgccataaattaaatttatcgtaaatattaaattctgatttgattcaaacccaacttaatcaaacggggttattttgtattatactgttaccgtaataattatcttggtaggaccaagattttggtttagggccacaaaagtgagcagttgtttcaattgttattcccaaattaggccataaattcatcaacattaagggacttttgtcggttacgccaagcaatttggacattcattgtgaagcggcaattgcctacaaaaattgcattaaggagaagaaactgcagcagaaatgcccgtaattatttaattgagcaatttaatacttttgaataattttttcccattttagagaactttctgatcgttttttggtggcaattctcgagaatattgaggcgcagaaggaaaatggtaagtgaaggtgaatgattacagagacaaatcttggacaaattaaaggaaaagagattaagaaaatcgcatttatgatttttaataaacaatttttttaaacaatcaaagaattaatattacacttaatgattttaataaacaattttttttaaacaattaaagaattaaaatttttctcatccgcaatatcttacactttacgataggcgttaaaacccaacactaattggtctaaaaaatattttagctggttttcttttgtgtcctattttctggctctttcacagaaatttttattcaaaggtcgagactcccgacttttaatttgcatatttaatctaagccgcgactctcctcgaagcgacgcaatcagtcaaagcatataaaattatgaactttcgatatttttggaaccgaaatcccgagacttttggccattggttgcctaatccgatttttttggtgggggagtggtgggtgaatcatcagctgctgactgaaatgtgtcatatgaataagtgaatgaatgaatgggtgtatccctcactcccttcacatattcccccgttttgaataatgatgcaagtggcgattagcatgtaattagcacgctgaatgatggtcatacgtttttgattttacaatcctttaagcatttataaaatgatattcggtgttggtttttttgctgttgttgcagcaattaatcaattgcgaaatttataagcaaaaatttaattttattatttgtaaatgctaaaatcaaactaacaaataagcttaggttttaaaaatttaattaccactacagtaaccgccactgcttggctggaatcgctggtggacattgccgactgtgtctccatgcaatccatcgtaaatatggtaaaacaaaaataaattaaaatttatttaaatgataaaa

SEQ ID NO: 62534 - DNA, 1143 bp, Heterodera glycines
  Genomic contig location: Contig_ID=SeqID_6700; Location=124..1266; Strand=+
  SCN-specific regions: Sequence locations=1-130,168-246,269-1121
gtggttccattggccgttgcacaagcggattccggaaagagggttcaacgacgggttatttcaactcggctaattgagaaattggcactgctggtgcccaaggaaatgtaagttgttgcaaagtgcaacaaaataatcaaaagtgtttaatattttgatgatatattggaactataaattaaaaaaagatgccattaaattacaaaaacgtttagcaatttttttaaaaatgagatatatgacatctaaaaatatatatattttttttgtttttcagtctccagagagaattgtcgccctgcgcccaaatgctgtgccaagatccgagtgccgcagtacgcacatcaatcgcacaaaagttgtcaatgttggcacaatcgctgaagtaagcttaccctctaaatgtttacagtattctaattattaattactgcctaattgttttagctaattactgtctaattgttttggaattactgtctaattgttttagcaattacacggattgttgcactttgcttttgccttgcatcatccaactgtgcaaggacgaagacccatccgtacgggaggccattctgagctccatggcccaatgtcttccacactttagcaaaggtagaaacaaaagcaagcagattgagcaacgatatttctgatcacaatcgcttggaagatgaattttcctatttggatcagttaaatctgatcataaattaaccttattagcctcaagaaatgacgaatctttcttggccctcattttctaatgatcaccttttattgccaattagatgcaaaaaagtccgtgttgttgccgttgttgcgcaaatgcactgaacaggcactgatcctgcgcgacgcttcgttgcccatcgtttcgcgccactttggctcgtggttgcattgtctacgcgacattttggcaccggcagagttgcgctggtggttggacacgtacgtgcgcattttggactttgcatgccaacataacgccatcaataatgccatccagcagcaggcgacggcacaaaaacaaggtgaaaagaccatgagcatggcatgaggacgatgctcgagaattttgagctgatcagtctcgacaagaaacagcatagccaattaaatatttttaatgtttga

SEQ ID NO: 62535 - DNA, 1751 bp, Heterodera glycines
  Genomic contig location: Contig_ID=SeqID_6701; Location=222..1972; Strand=+
  SCN-specific regions: Sequence locations=1-218,241-847,870-979,1013 -1024,1046-1452,1475-1486,1509-1751
gctccaactgtgccggacactgccgaagatcaagcagtatttgatgttcccgaacaatgacgagtcgttgtccaacttggagcgtgttgtgcgcgaattgctggcatccgaacagaacgcactttcacgacaactcatccaacaggtgggctaaaattgactctttttttaatcatttcggtgggaaaattcatgataacctccgatccaaaaatgcttatcatattcaattccattttcgtcctgtttcagttcgcttgtgaactgtcgaggacagaaatggacaagaaggagtgccgtgcaaaccgtgccaaattggccgaggaaaagcgactgtggaccgagcatgaggaatccacggacgaaactgatgaggctgaggcgggccagcagtacagtactgagcatacagtaaccgggagcgatgcgataggctcgcccgaaagcggcatcttcttcgaggaggactgttggcttggcactggggtcggaaacggtgccagacctaacaaccaccagcagatgggcggtcgcctgtgccgttcggctaccaccacaagcatatcgcaacacatggagacggaggtggacaaaacattcaaataaaaaaatattggcaaaatgataccattaaatttttaaaaaaactgaaaggaagcgaaaaacagaacccaaaatcaaaaaataaaaaaggtgaacggaactaaaaaataatgataaagataaaggaaggaaaaaatattgttcgatttcgaccattaattaattatttatacgtttatttcccaatttaaacgcatcccttaataattaattacctaatgccttagctcgactaagcttctgaaaaacattttaaattatatttttcaaggcccactccaatctcattaccgctccgtccgcttcctctgaaatgctttccgcaatggcaattgaaccctttgccgcttcatcgcccaaggtcagttacctgacgaataaaataatttattttaattaaaaaaaattaggctgctcgacgccgtcctccgccccctccgccaaaaagttggcgcaccaccaccacaattaaatcagcaaatggtccaaaattggccattgttcgtccacaacctcaagtgaaggtgagtgagcccatctgaacaggtttttagctggttttccctattttttgaaggtggtcaaccaacggtcaagcagtccaatgccatttgttgacgctgagcaacaacggaaaatttcgaacaacaaattgcccaatgagacaccgtcggcagcaacatcaaaagcagaagctaataatgaacaaattagtgataagaagcagcaccatcagagtgacactgatcgccattattcaacaacgacagccctcggggaaagaggaaaagcaccggcagaaagcattcgaaaatcgaaacttccattgtcaacgaatggaggtgagagttaaataaatttattttatttagtcttgtagaaaaatattcattaattcattttctgctttattaggccggcaccgctcgtcgagttcggcaccgccggtgccgccgcctaagcccaaattgcctctgttcacttcttcgtctggcaactcacctccatccccatacacaacggcggcctcgggaacaagttcagtgacggactcgatcaaactgaagaaataccgtccacgcgacatttctacgacaagtaattacttatacattgaaatggatcagctcccaatgccatcaaaatag

SEQ ID NO: 62536 - DNA, 291 bp, Heterodera glycines
  Genomic contig location: Contig_ID=SeqID_32213; Location=792..1082; Strand=+
  SCN-specific regions: Sequence locations=1-291
atggtgccaagccccgtggtggtgcccgatgttgaggcggaggcattcaggacgatgttggtctttatttacacggacgatttgagtgggattgacggagacaatttgttcgacgtgctttacgcgtgtaaaattttaaaatttgcctattttccccgttcattttaacccccaattttagctaaaaagtacaacattgtcggcctggtcagtgcctgcttggacttccccatcccttcgctgcccaacgttttcttcgcctttgcacaggcgcgttttctcgaagaaaag

SEQ ID NO: 62537 - DNA, 882 bp, Heterodera glycines
  Genomic contig location: Contig_ID=SeqID_32215; Location=31..912; Strand=+
  SCN-specific regions: Sequence locations=1-41,64-174,196-845,867-882
atgaaacccccggagttgcaataccaccacatcctttcacgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccagtacaacaggcagcaggcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagag

SEQ ID NO: 62538 - DNA, 55 bp, Heterodera glycines
  Genomic contig location: Contig_ID=SeqID_32217; Location=883..937; Strand=+
  SCN-specific regions: Sequence locations=1-55
atggcaattcgtaacgcgtgtgatagagcgggtattgaccacgtttggggtcaat

SEQ ID NO: 62539 - DNA, 232 bp, Heterodera glycines
  Genomic contig location: Contig_ID=SeqID_32217; Location=752..983; Strand=-
  SCN-specific regions: Sequence locations=1-232
atcttttctcgactttctgggcattcccgtgatgatgatcacttacattgaccccaaacgtggtcaatacccgctctatcacacgcgttacgaattgccatttgtcaacgaacacattttcgacaacaatcaattggcggtccgtttcacaaacatttttttttgcaaatttcgaactcaattctttaaaattcaggtgcataaagccgtgggcgaatattgggcggaattg

SEQ ID NO: 62540 - DNA, 880 bp, Heterodera glycines
  Genomic contig location: Contig_ID=SeqID_32218; Location=184..1063; Strand=-
  SCN-specific regions: Sequence locations=1-82,117-261,285-441,463 -529,551-880
atggctatttgtgcgtgtccggccttcccaatcgaaatggcaatttacatgccaaacagtgtgctgacatgtaagaaatggcataaataaattcaaaaattttattttttaaattagggcattggaatttttgaaagcgttggaaaccttccgaatttcggaccattcctttgagcgcattcgtctccgcatcggactgcacagtggcccatgtgtcgcgggcgttgtcggtaaaaatttctttaaacacatttcgtgtaattaaattaaaatgggtaaattttagaatttgattcattttcctatcaaaaattttattggttgtaatttagggttagccatgccccgctactgtctgtttggcgacacggtaaacaccgcctcgcgcatggaaagctcttcaagccgttcgtttaaaaacattaatgaatctttttttctcattcagctaacaaaattcacatctccaaagaaacgtatatgctgctgcacaataattttgatggttacgcagtggaaagtcgaggcgaagtgataattaaggtgaggggggaggggcgataaatacatcattaatcagcacgaataattgactaaatgccgtgatctataagataaggcacccacaaaactgtcaatttgagagtcacatcacaggattattaacaaaatatgcgaataatatgagaatgctggggaaaaaataagcaccacttattaaccaaaaatcaaattaaaacgaaacaattagaaagccctaaaaaagacaattaaaaattaattagtgtgcacaatcttactctttttatagggcaaaggcgtaatggagactttttggctgttgagcaatgccgagataagaagcaacaaccaaatgatg

SEQ ID NO: 62541 - DNA, 49 bp, Heterodera glycines; identical to SEQ ID NO: 51181
  Genomic contig location: Contig_ID=SeqID_32221; Location=535..583; Strand=-
  SCN-specific regions: Sequence locations=1-49

SEQ ID NO: 62542 - DNA, 1665 bp, Heterodera glycines
  Genomic contig location: Contig_ID=SeqID_835; Location=374..2038; Strand=+
  SCN-specific regions: Sequence locations=1-23,46-133,162-286,308 -711,745-830,875-1070,1093-1198,1220-1485,1510-1629,1663-1665
atgccgatgattcggcgccaattgtccgaccatcagcttcacaatgcctcatccatttcagacctttcaaaccctgggattatggtcgtcggtggtccttcccaaacaccggtaattttttcatattttcggcattttttcaaatttaaattttttttaaagttttgtccaactcgtggcacggcaaatggtccttgttatgctccagcagcaactccagcggatgtgatctatgaatatgtggaccagggctccttgtcgttggcttccacgttgaaagccggcgattttttgtaaggaaataaatgtataggcattttatagatgaatcccttggaaatacagtaccctgaaatatgttaattttatggactgaatgaacgcgcaagaataatacagtgccctgatatttgaattttatggacagtatgaatccctgagaaatacagtaccctgatatttaaacttttatgacagtatgagttcctgggataatgcagagtagtagtctatatttggaatttgagctaactcaatgccctgatatttgaaattcaaggacagtatcgactactgggaaaatacagtactccgaatttgaaattttatagacaatatgaatcagtcagtggttaattcgttttgttaattatttaggcgctcaaggagtaaatttaatgtgtacgatccggtgccgccgatgagcaatggacagcagcaacaacgacaacaacaacaacaacaccgtcgggttgaaagcacttcaattggcacacaacaaattgctgacaatgatcatcaacaacaacagagacgggaaatttatggggtaaaatttaacaaatttaaaaatgctaatatttaatttaaaaaacctaattgcccaattaattattgaatttaaatattcatactagcctaattaattataggataatgaatatttgcaaccgaagagtttgacgagcaatgaaagtgatgacaataatttggcaagcagttcaacagttaggcaccaaaaagcattaattgtcccggtggatgtcggaacatttcgaggtggataaatgtcaaaaatttatttgaaaaataatgagtttaggatgaaattttgcagaatagaggaaaaattgggacccaatttaagtaaagcgcgaattttattgaattggtacttagaactgggaatttttgagtaatattattaaattaattgttattctatacttcctttggtgtatgcttttccaaaacctaagaatttaaaaaaaaatacctagaaatcttttcccaagaaattattaatatctaagccaaattttttttaatttcccaaacacaatcccacatttttttcaaaaaattttaaaaatcctgcaactggataacgcaaatttgatttgtcggtctctagttctaaatgggaatatgcctcctaattaagccatttcccgagaatgtcccgttgtgccaacgacaacgaccacatcatcatcattatcatcaccgccatcgatggcatccgcttatgagcacgtaatgccacaaattccgctgaacacttttcccaatcaaacaccacctcaacgacaatgggaggccgaaattttggcggagttgaagcagcgccaacaacaaaaacaacagcaacaacaacggcaaaat

SEQ ID NO: 62543 - DNA, 1254 bp, Heterodera glycines
  Genomic contig location: Contig_ID=SeqID_836; Location=625..1878; Strand=+
  SCN-specific regions: Sequence locations=1-51,74-362,458-1213,1235 -1254
atggctgatcggcaacaacaacaaccatatcttatcaacccaattaacaacagatacagcaggtaaatgagcaaaaacattgcagttcgtgaaatttgaatgttagacggagtttggcactcgctccattaatggaggggtactgtaatgaaaaaaaattcataggctcattttatcgattttatttgcatttttctttaaaaaattgtttggtttttctccaacttttataagccttaaaatacatacactaaaggtcaatcgccgatttggtaccactgggcctcaatggcacagctttgcccatccgcgcatttgaaagaggccaagccgactcgcccgagagaaggtcaaatctgggcataattaattttaaaagaagaaattgttataaattttcctaaaaaatattagaaaatttatttgaaaatttttctaacatttttacaaattttatgatgaaaatcactaagatttttttcagaaatctttccaagaaaagattttcgggctcttataataaaaaatgtttttttaagtaccatttctacaacattgtcgacaatgcaaggtgaaaacagtccgccgaccttccttggcggcgcggaagtgccacctccgatgggcacgagtttgctccggcaacggcttggctccgcatcggtggcacttatggggtcataaattttgaagttttttaaaaattttgattttgtaatttttttccagctctgctgattggaggcgaggcactttgcagtcagaagctgagcgatcattaggctcaagccgtgccgcgaccaccttcttgggcagtccaccagaagcagcagcaacagattttggacaaaccgtcaccaagacatttggccaaaatggaggaatggacaatgttggacaaagtgtcgaccagcaatttggacgaagaaagtttttcggacaaaatgacgtgtcaccaggcacagatgtgtgaaagcgaatgaacattttttgttgtggaatttcattttcaatatttttttttctcatttatccgacgacgggttattttcctatgattttcattatttgataatgtaatttaattgtttttttctcattgattaaaaatggattagggttaaattgataggggtggcaaaaatggtactttatttaaaaaaaagttctttaacattaaatattatagtacaaaaaatccaaaatcttaaaattactcagttcatttgtttttgaaacgttcaaaattcctaa

SEQ ID NO: 62544 - DNA, 898 bp, Heterodera glycines
  Genomic contig location: Contig_ID=SeqID_838; Location=3125..4022; Strand=+
  SCN-specific regions: Sequence locations=1-604,648-676,698-789,811-898
atgaggaaaaggacgacaaaaacaggtcagcatggggcctggatttgggtgtgcccaaatatttgtcatgaaattcgggtttcggtctctaggtaagtaaaccaagacccttcttggagaagttcttgccgagattgagaaagattctaaaaaagtcacgggatcggttgtcttagcccggtctctcgtttcttaggtcgtggacaatttcgtctcaaggctaggcccaaaatttcctggacaaaagggcaaccatccaatttccgagaaatttacattggtcgacaaaaatggtggtcagcatgtgtccgaattcagtaccaacctcgatagctcagtggtagagctgcccacagattggatggggtgaacgtgtgggttcgactcccacccgatgcctaatattttgcccatttcttttttaattcgaaaatgaaatttttttttgagcagtagcgagctgaaccgcgataaacgtgaagaagatgatgacacaccgatgcatgacggagaggaattggacgaggagggcgacaaatcggacgttggcttggagacgacggccaaaaacgacactgaaacgaccggggaaccatcaacggacggagagggggtaagaaaatgggaaaattttgaattttttggcaattagccaaccacggaacaggctgaggagcaacaacaacaacaacaacaagagacagtgcaggaaaatcttgaaattgctcgaaaaaaacgtgacgaaaaccaaacgggtgagatttaattgattgagcaattaggaaaggaattttcgaaaaattcacagaaaacatggacggaggcgaacaagctgagcaaacacatgtcgaggaattatgtatgatttaacaaaataagacacatgattgtaacataa

SEQ ID NO: 62545 - DNA, 2139 bp, Heterodera glycines
  Genomic contig location: Contig_ID=SeqID_840; Location=253..2391; Strand=+
  SCN-specific regions: Sequence locations=1-4,26-490,513-783,815 -872,894-940,962-963,986-1043,1065-1393,1415-1684,1706-2023,2045-2139
atgaaaagaaaattatttaattcaattgttcttcatgacaattcaattcacatagtgaaaacattaaatttacttttttcccaaattgactcaataaacaattttcgttgttttggggagggcaatctgacgattggtactccaatttactgtcgagaacatgactgttttaaaaataattcattcaaacaaataaatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaactatacaattataaaaaagaaccctcaaaaagaggaaataatttatttacccccaaaacttacatcctttgaatataaacctgtcattaaatttataagtaacccagataaatcaaatgagaaacaaatcacatgtcaatcatctcccgtatgtgaattaattaactgtcgattttgtatggaatatcttaaaaacccacaatgtgtagaccagattcactgggcattaatgcttgtaattataatgataattttatatgttatttcattaagcctccaaattattcgaatactcacacgttttatccattggattttacaatttatttttaattgttttaaaagaaaacccaaagtaaatcgaattagaatttcaagaccaaagttaaaaagaccattgatttatttaatcacttccagtttaattttattcaaaatgatttttgcttgtgatgaagtgacaaatttagtcgctggaacaaatgactgtgctgtaacccaagaaggaaaaattgaatgttcttatgaccaaacaacccaactctctattacacctgaacacttaacctgcttaaaactcgacaatacaaaaactaacaccactatggaaacactacaaattacaatagaaactttaacaataatttgcaccgaaaaatctgattattttacgagaggttgcgaattatcttcgacatcacaaaaaagatgctcaggcgctgggaaatgtaccggccaaacttgtcaatcagtaaaaatttcagaccggaatcccgaagtgaatgatcacgctaataatcaaccaggttattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaggcgacaattaaattgtctatcaatccagaattaacctattctgttgacttgaaacccggaattttaacacacattggtgacgagtctaatagttctatatctatcacactgacttcgacttcaattccaccgacgccgttatttggttcgacatttattatagttcgcgaagaattaaaagcagcaatagttgcgaacggaaatttactcaaaaatatattacggtgtaaaaacaaagaagaagcgcaaagttttagttgcacttttccaccagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaatatttgtaatattgttaccatatcattggaaggatgttattcctgtactagtggtgctaattggactctatcatgcaaaaacatgtccccatgggtaaaactggaaatatttttgaaagctaatctggaatacatacacccaacaaaaaacaaaaatcattacccctaaacaatactaatgaaaaccccccaattggaaatttccttttgaccaaataactgaatta

SEQ ID NO: 62546 - DNA, 750 bp, Heterodera glycines
  Genomic contig location: Contig_ID=SeqID_840; Location=3487..4236; Strand=-
  SCN-specific regions: Sequence locations=1-246,286-350,384-515,537 -578,600-683,705-706,749-750
atgccggtttctgattttttgagggcgtcgtcacagatcccccaatttgatcaacacagaaaacaaagttatgatgatccaaaaaattgtccgtcgaatttttggggtccaccgaaaaattggacctctgccactgtatgggtcggacaaacgcatgcattgacgaacgggaaattcacagctgacactcatctggtaggagttgcacatttcaccctcacatgctttgcacatcagacagagcgcttttttttttaaaaaaaataattttattttaaatattatctttatcagaatttgttggaatttcagccctaaaatagaagcgtcccaagtttggtggtttcccccctattttggctttttgaaattattatttttaatccaaaaggcaatagaaaggaataatgaagttctaaaatcgcattttaaattttcaaaaattattccccaacggaaaatgaattaaaatgaaaattgaatacaacaattaattttcagccctatttatgagaaatcttaataattattctattaaaagagcttaccatctccaaatttataagccgccaaaattgaaaacattaaaattccattggaaaacatttcactttggcagaaaattgtggccaaatttaatactggccaaatgaaaggggacctcttcacagaagaaaagctcttaaagaagaaaagagcagaggaataaaacacagagaaagcaattcattcattcattgaacaaataaa

SEQ ID NO: 62547 - DNA, 565 bp, Heterodera glycines
  Genomic contig location: Contig_ID=SeqID_840; Location=4494..5058; Strand=+
  SCN-specific regions: Sequence locations=1-81,106-146,171-453,475-565
atgggctgtgtgtatccgtatgatgagatgtgccaacaacagcgaatgaatgaacaaatgcggtgggttgattatatcgtcagcaaaacaaagaaaatattcaaatttgattggaattctggggttctaattaaggagatccatgtaatttttaaaaaacaaacccaggatcaggatccctaacaactcgatttaaatcctgaaatcctaccagcgttttgtttcgaattaatataaatagttaagctgttatacatgtgactacgataattgcaatgccatctccaacccatacggtccaggcaattctccatattccaacggaggctacgacccttacaataatgctcaacgatacggtccaaacggacggtacggctattattggaacggcgcaatgaaacaacgacaacaacaaaccgcaaatttattaatggcactaaccgtaacactaatgacacaaattgttctaagcattttttgatttgataattcaattttaaactaagcaattgaatactttgtggaaaaagttgcaaatcaaattaccaaagttccaccgcca

SEQ ID NO: 62548 - DNA, 1498 bp, Heterodera glycines
  Genomic contig location: Contig_ID=SeqID_6702; Location=16..1513; Strand=-
  SCN-specific regions: Sequence locations=1-69,315-592,614-833,855 -1064,1086-1151,1173-1355,1377-1424,1446-1467,1490-1498
  Gene Ontology: Mol. function=protein binding; Cellular component =axoneme; Biological process=eye photoreceptor cell development
atggtgaccttctcagcttggatctcagtctgtacttcacggatcatttggtcaattaataattgccatggaagcggagaaagagaggccggggatgaagttgaagcggacgaaggggagaaagaggagcaggacgaatggggggatgaagcagaagcagaagtggaagatgaggaggaagcggaagtcggagggggtgaagaggaatggaagagggaggaggaggaagaaggggacaaagaggcggaggaagggaagagagaggaggaggaagaaggggacaaagaggaggaggaggaagggaagagagaggatgacggggacccctcggaaaagccgacggatgccggcaaaagacgcggggccccctgcgccgccgcacaccaagcgaactccgcaccttccgacgcggcacacttttcccactcagagaacgcacaactcgaggccgagaagagacattccggtggaggctttatgagcggaagagcgctgacgctgatggcgtcggaagcggcgatgatgacaacactgaggtgaagcacggcacggaatgggggcacttaatctcggcatttgcccacctttgctgctcctccccgcataaatccccgcaggaggccgcgcactccgcgacgaatggacgcgtcgggggttgaggcgacgaacttaaaaagacacttcggcccgtccgcaaacgtcgtggagcagcagccttcgacatcttcggcgacagtttcccactgcctgaggccgccgacgccgtgacgaacggcctacagaaattgggcaatcagcgagagatgagttaatcaacaacccccaaggcatcagctttaagccctaatttggcacaagtgccactccgtgggacagtcactcaccggcaagcgaggtccgaccgacacatctccttgttgtggttgggacgacgggtttccgacggtgaaattggccggctgattgggccaaaccgacgactgaagtggcacgcggaccgcggtggcgaagatggaggccggcacgcagaaaagagagccgccaaattccatcagcgcatacgcttcgtcgtccgtccctcccccgccgtccgaattggccatcgcttcataattcacatcttcgcaaatcatttgggcacgcgacatcgcaccacagccattttcagagcacaaatcggagcagctcagcagcacggaatcggagttgccgaagatgttcagcagggcggcatttctgttcacgtcttcgcaaatcttttccatgcgcgacatttttggatggtttaggagaggaaagtgagaagtggttaatcggtggaaatttggagatttaaaagaattgaaaagggatttggaaaagcccttttggaaggattggcaaaggacaaacgattgagagagaaaaggttttaattcaaaatcagcagaagaagaagaagtggaaggagttaaaaggcttagagagttttttagagtgtctaaatttaaaaaataaa

SEQ ID NO: 62549 - DNA, 2025 bp, Heterodera glycines
  Genomic contig location: Contig_ID=SeqID_6702; Location=796..2820; Strand=+
  SCN-specific regions: Sequence locations=1-105,127-404,650-831,945 -1476,1498-1561,1590-1694,1726-2025
aaggctgctgctccacgacgtttgcggacgggccgaagtgtctttttaagttcgtcgcctcaacccccgacgcgtccattcgtcgcggagtgcgcggcctcctgcggggatttatgcggggaggagcagcaaaggtgggcaaatgccgagattaagtgcccccattccgtgccgtgcttcacctcagtgttgtcatcatcgccgcttccgacgccatcagcgtcagcgctcttccgctcataaagcctccaccggaatgtctcttctcggcctcgagttgtgcgttctctgagtgggaaaagtgtgccgcgtcggaaggtgcggagttcgcttggtgtgcggcggcgcagggggccccgcgtcttttgccggcatccgtcggcttttccgaggggtccccgtcatcctctctcttcccttcctcctcctcctctttgtccccttcttcctcctcctctctcttcccttcctccgcctctttgtccccttcttcctcctcctccctcttccattcctcttcaccccctccgacttccgcttcctcctcatcttccacttctgcttctgcttcatccccccattcgtcctgctcctctttctccccttcgtccgcttcaacttcatccccggcctctctttctccgcttccatggcaattattaattgaccaaatgatccgtgaagtacagactgagatccaagctgagaaggtcaccattccgccgagtgtggttggatttgccaattcccttttctctgttcaggcacttcgcttcgactgtcccaacttccaaatgcctcggaagcgttcgttccgtccggttcgcccggcttctcctcctccgcttcctccgcggtgctttcccttcccatcgctttttttctcacctcccctcccccttcttcagattgacttcccctccaattcttcttcgtcctcctccaattcttcgggatccccccgtccgtttctttgcttttcccaaaacactctgcctcaggcaaaacgtgccaaaaagaattcgctcctttcgctttctcacgaggaattggccgagcgcaaaaaggaacagaacagagcagcagcacaacgctaccgaagtcgaaagtcgaacgttttggagcaggaaagggatgaaatttggcatttggagacggacaacgcgaaaatgagggaagaaatggcacaaatttcggatcaaattgccaaactgcggacgaaactttcactagggagataaaaggggggcagcgggctttgtttgttcatttttgaccacattcattcgcaagtgtaaagtgtcgagccacacacagcccatttatttgtttaccgtaccccactccccccactaccgtatacctttgttagtttttgtcgattcaaaaaataaaatattcgtccattttgtttcgtttggtgctttttcttcgtccccctccctctctaatcccctaatttacctaatcgctcccttttatcttttcctttcccgctgccgttacgcatcgaccctcaaaattggccaacatttcccaccccgccgcttcggctgttgacaaagaataaatgaagccacttttgccctggagggttcgccttttggcttttcctcaccttttccggtcctttgcacttttcctccaaatattaacatttctcgtcattcccttcttccgaatgttttttcccagcttttccctcctcctcttctgctccaactttttgctgcttccaattttgagtaagcgaagtgaaaaagcattggctcagttcgcctctgatcactccgattgtttctcttctcagcttacagcaaagaagcatgtgacggggctcaattcgcgcaaatgccgtgccgttgttgcaaaatggactgctggtattccgtggcggggtcggccatgcaccaattgggccatgtgccgggcgaggcgggagagcgcgaagcattggccacactgcgactgatccgtgcgtgtatgatcgcggaatgcacgccgttatgtgcacacaatttgatg

SEQ ID NO: 62550 - DNA, 1453 bp, Heterodera glycines
  Genomic contig location: Contig_ID=SeqID_6702; Location=3899..5351; Strand=+
  SCN-specific regions: Sequence locations=1-347,369-982,1004-1453
atgcttgattccctccaattgaatgtgcccgtctctggcaccaatggaaatgctatttacggggtcggaatcggcattttgaatggtcagaaagaaactgaccaacaacaaaagcgatcggtgggtgattaagagacgagaaggaaaaaaagggaagagggagggggggggggatacacactaattagcgataataggccggggaaaattgggggggggggataggggtacgtaagagggggagaagcattcgccgaatgactctttaaacagtggccccaattatatgcccctttcttttgcccattttttgtgtgttctcttaagagtgtttttgctcgtcaaaagtcgtcttcggaggaggcggaccggaagaagcgactgacgatgccattaatatacaggtgaagtgaaaatgccaacccaacccaattggatgcttaatataaatcccgctttccttttctctctttaagagcagagaaagtgaaaataataataatttgttggcatttctataattgctttaaatgattacgtcatttccaaaaagagaaataattgccgaagtgcaattataattgaccaatcgttggctaattacttcaatgagttaaacttgctgaatatttcagaatgtacgaaagtcaaagtgacgaactttgcggcaccgtccgggggccggacgacgacgcgtttcacccggaggaggcatcgaaacgccttcgccacgccttagccgccggaattcgtaggggggggggagagggaaaaagcaaccgaaaactgtgcagaaagtgacgacaaaacactgatcgacgttctgttggagcacaacaatttccagcgtcagaaaatcgccacagcttatgaaaatatgtacggaaggtcagtgtttaatggggagaagctaaaggaatgaaatttgcaatttatttgaggattttggcggatgacattgaagaggaatcggggggccatttcatggaatccattttggtaagaagggcaataaagaatggggggaggtaattagtgggaagggggcaataataaaaggggaagggcactcagagagggggggggggaaaggacgtaattggcacagagaaaagccatccctcacttttgttcgttgaaggctcttctccaacctgcgcatgtttattctgcaaacactctctattttgcgatttctgtgagtcaatgaattgccaaaaacataaacaaatccccgccttttgttagggcaaatccttcgagcgaagtgccgcggtggaaattgggctgaccagtacggcatcggttggtatcccttttaagaagtgtcaattgttcattcattttctttccaattcagcaactcggcgtcatccgcgacacttaccaagtccgttttaccagagaataccgtaacaaccccacaaccaccgtaacacttttcacagaatga

SEQ ID NO: 62551 - DNA, 362 bp, Heterodera glycines
  Genomic contig location: Contig_ID=SeqID_32223; Location=772..1133; Strand=+
  SCN-specific regions: Sequence locations=1-362
atggattcggacacggaggaagacctcgacacattgcaacgattcgacttttattatgaggttggacaggtccgtcctgtccttttaagcacaaatattgcaccaattcagcagacgctgaggtcaaacagagccttcgtttccgacctctcttccgaagaagacgacgaattggccaattttgtagtacattcagttgtgcgtttttaaaactgatgattgaatggacttttgaatgaatccgtcttcaggaatccgaagaggacgccaacgatcacgagtctttcttctcagaaatcaccagcggtctctactcaccgtcgccaatgcattcgcccgactcgcaatctgacgacaactga

SEQ ID NO: 62552 - DNA, 351 bp, Heterodera glycines; identical to SEQ ID NO: 53910
  Genomic contig location: Contig_ID=SeqID_32225; Location=716..1066; Strand=+
  SCN-specific regions: Sequence locations=1-20,51-351

SEQ ID NO: 62553 - DNA, 346 bp, Heterodera glycines
  Genomic contig location: Contig_ID=SeqID_32225; Location=1182..1527; Strand=-
  SCN-specific regions: Sequence locations=1-2,60-273,295-317
acacccgctgaacttaagcatatcagtaagcggaggaaaagaaactaacgaggattcccgtagtaacggcgagtgaactcgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaa

SEQ ID NO: 62554 - DNA, 327 bp, Heterodera glycines
  Genomic contig location: Contig_ID=SeqID_32227; Location=282..608; Strand=-
  SCN-specific regions: Sequence locations=1-17,42-327
atgaggaaaaatacggcgcattttatgacttttattttaatcgctgttgcacctcttctaatcacttttgtacctcttttatcacttttgtacctcttatcaaatttgtacctcttcatcaaatttgtacctcttctaatctctggtgtacctcttctgatcactgttgtacctcttttaatcactgttgtacctcttctaatcactgttgtacctcttctaatcacttttgtacctcttttaatcacttttgtacctcctataatcactgttgtacctcttctaatcacttttgcacctcttttaatcactgtgaacctcttctaa

SEQ ID NO: 62555 - DNA, 346 bp, Heterodera glycines
  Genomic contig location: Contig_ID=SeqID_32228; Location=738..1083; Strand=+
  SCN-specific regions: Sequence locations=1-346
atgaccacgtgcattttcggcatgaatgagtcggatggcattcggcaggacccggcaacagatgatgaagtcctttccggtgacgaaaaagactcaatgcgcagaaaggagagaccggtcggagttgtgggccgaggccgaggcgcaaaatggacagtggaagacgaagaaggggagggcatggggacggagaaggagcaggacggggcatggccatcgacgggaagcgcatcggcagcagaaggacgaggacggtgcatctgctgaagggacgaattcgatttctgatttccgaatgactcgatcagcacataaaattgagttattccttttaatggcacgaaaa

SEQ ID NO: 62556 - DNA, 393 bp, Heterodera glycines
  Genomic contig location: Contig_ID=SeqID_32230; Location=271..663; Strand=+
  SCN-specific regions: Sequence locations=1-43,65-146,169-393
atggcaactcgacgtcaggtccgtgtgttcacccgagttgatgacgcaattcggcacattcgtgacacaacgccacgcccacaggaacacgatgggcatcaaaatgccaacaacagcgccaatttgaattgtggcactaatactgatcagtcattggctgatcagcttaagcaacatgaaaagccgctgacaaatcaaaagcggaccgcattacggcaaattttggagaagcaacatttggtcaaggagcggaccagcatcaatttgttggcccatctgcgcgaggcggctgcccgtggccaacgcttggagttggacttggccgaaattcggcctgacggatgcatcagcatgagcattgatctgaaccagcttcgaccgcttgccaattga

SEQ ID NO: 62557 - DNA, 233 bp, Heterodera glycines
  Genomic contig location: Contig_ID=SeqID_32231; Location=453..685; Strand=-
  SCN-specific regions: Sequence locations=1-233
atgtcgtcatcatcgtcgccccagtcgcgctacgactacctggactttgctggcaaaccggaccaaccgcagcagcatcagttgcgacgacaacagcagcgagcagcgccgcaacaacgcgtcgctgtgccgccaccggcgctgcgacgtgctgctgcgtcagcagatgaaccgctctatgcgactgcgtcttcacaaatttactcgttgggcggcagcgaagacccgtacag

SEQ ID NO: 62558 - DNA, 1905 bp, Heterodera glycines
  Genomic contig location: Contig_ID=SeqID_6703; Location=4522..6426; Strand=-
  SCN-specific regions: Sequence locations=1-75,97-268,291-370,392 -829,857-1833,1857-1905
atgaaaaaggaattaataacggttgcggaaaacaaggacatttttgacaaaatcaaatttaggactaaatttgaggttcgtttcatcagtgaatgtctaacaaatttcattgcctctgttattttttaggtttctcacgcagtttggaacccgaaaatcagtcttattgcgcttgggtcacttgatggagaagtggtggttaagcgttacttgtggaagaccgggtggaaggtgctgcttttgaattcgattagtttaaacttttccctttttaattttagagaaatttttctcgtgatgattctgccaaacactttgattttcttggcgatgtttcgtccgttccgtcgtcctccaagtcgaaggatcagttgttgtttctgtgttggtcccccgatggccaagtgcttctcactgttttccaaagtggcttactctattatttggacactcaaactggcaacactcttttcgttaaaaaattgtcatattcgcctttttgcgttgaatggctaaaatttcgaccaagcattgcactcaaatttccgcgtattggcgagcagtcgtcgttgacagcggtaaaatggcaaagcattggaacattttcatgctttttttgcaatttattttaaaaacggattgcttttttgacagcaaaagcgaatcttatagggaactaaatatgcttttctgtttcaaaggtgttaaactttccgttggtttaggctgtcaattccaactccactcaaaatgcttctactgattgtgagcatcgaaatgtttgttgtgcaattgaacacttttaccgccatattttgccaaattcgctctcttcttcttttctttgtgttttatcttcgactggcactgacactttcgtggacattttttctggcggaattttgctcatccgtcgtttaagcattaacgaaggtaaaatgagtgggcatttttcttcttttttttaaacaaatttgttcataatcagcaaccatttgtcgttctctttcgaatctccaaaatgaattttttatttacgacgaaaaaatacacattctctcccgagactcgaattcgtttgaaattttgcgactccctggtgaatttggtcaggaccatttactcatctacgaacaacttgtggattggttggtcttttttatggtttgcaactcatcgatcatttaagttattgttggatgtcattctgtaatgtttaccgtatcgcttacgacttacaatcgaccaacaaagctctgatggactgtgttattctgctccgatcgcttttggttaaattggaggaactcaacgagagccaaaaatgggagactatttctgaacggttggacgtttctgacaaaaaatgaaaaaaaaaaaacatttacagacttctcgacactcttttgaagatttctgcagatcatccagcgtttgaccccaaagaaattttagatgaaaattgtgcaaatattttgaatgatttcgaaaaaacatttcaagttctcaataattatggaattcattcattgtaagttttgggaattttctgcctttctctaattcgtcgcttccctcacaaattagagtacggcagcccataaataaaaacaaatgctatgttttggcccccgatgaaaaagaagccataatccaacaaattggtcatcaaattgaagaaaatagcgaggaagagacttctgatgaggaaaaaatgtccgaggatgagaacggagttggacacagagaattggaaaatgatccgatcagccttcactcatttatcttcggacattctgaacaaaggataactgaagaaagaatggaatgttgatcaaacaatttcaattgttttatttaacgatttctgcctccattttaattttttatttcctaactattaaa

SEQ ID NO: 62559 - DNA, 408 bp, Heterodera glycines
  Genomic contig location: Contig_ID=SeqID_32237; Location=763..1170; Strand=+
  SCN-specific regions: Sequence locations=1-175,197-326,369-408
atggtggaaagtggtgagagtgaaaatgatcataataaatggtatctgattttctgtgtttgtcccgtgtctttcttctctctgttcgttatggtagttccatcggccatcactagcgatggtgatgacgttgttgttccatacgactgcgatgatggccacggttggatgcccgagctgaagaagcggcggcggcaccatggccagtggaagtgccctggaaaatgagtgactgatgacccatcatcaatgacaagtataaaaaaacaaagggacaaagatagaaattaaacattggtgcatgccatgaatgcttaaattggttgcatttgttttttcaattttaatacaaataattgatttgttttgatgttacacacaccgtttcaaaaaacgagacatgaacca

SEQ ID NO: 62560 - DNA, 177 bp, Heterodera glycines
  Genomic contig location: Contig_ID=SeqID_32237; Location=394..570; Strand=+
  SCN-specific regions: Sequence locations=1-108,130-177
tcgagaatctgatttattaaaaatttaattctgagtgagtgaaaggcatcgtctgtgttcaaaacatggacaaaagcgtgaaagagacaaatgctgggagatattggaaatgatcaaatattacaaatgaaacttgcaaaaatggaacatttgtccataaggccaaaagcaagaaat

SEQ ID NO: 62561 - DNA, 90 bp, Heterodera glycines
  Genomic contig location: Contig_ID=SeqID_32237; Location=1139..1228; Strand=-
  SCN-specific regions: Sequence locations=1-90
taaagaaatagtacgccaaaatgagagaaatgtatttttctctgcactctctatttattggttcatgtctcgttttttgaaacggtgtgt

SEQ ID NO: 62562 - DNA, 607 bp, Heterodera glycines
  Genomic contig location: Contig_ID=SeqID_32238; Location=136..742; Strand=+
  SCN-specific regions: Sequence locations=1-12,37-111,133-217,266 -462,529-607
atgcctgcgtgctcatcatcatcatcaacagcagcaaatgttcctcagccgtcgtcgtcgtcactttccgccgccgaagaattcgctaaacaaaaaaagcggaataagaacaacaaaaacaagttcaacaaaaagcaggtagccttgattaatattgaaaaaaaacttaaaatttcataacacttaaataactaaaaaatattaacctttcatagtcttttaaaattattataaaaatggttttaataattatttttaaaaatatcttccaaatttcttttctttttagccgccgcccccatcaatccgcattcctaagggcaaaacgccgaagaaggtccgtccacgccacccggaacccgaccagccggacgaccaatatgagctccgggcggtgttggcgaccgccgaagtggtgtccgggggcacgacacatctgtgtctgtatgtggatttccttggtataaaatttttttttgaatttttacactaaaatttctatttaatttcgatttaatttttaaatttcagattatcaagggcaagaggactggtgtttgtcaacgaaaagcgacgccctagaactgacgcacttccacgacattga

SEQ ID NO: 62563 - DNA, 525 bp, Heterodera glycines
  Genomic contig location: Contig_ID=SeqID_32238; Location=894..1418; Strand=-
  SCN-specific regions: Sequence locations=1-29,51-112,134-225,266 -267,289-386,424-525
tgaacgcttcaacaatgcatttgcctgaatttttaaatatttttggtcagtcttatcaaaacacagaaacgaggaaatgtgtgagatagagaaatgagatgcaaaaaacaatagggggaccaacacggaggaaggcctgcctaccgcttttcacagctccgaaataagcattgaaggggggaccaacacgagggaaggcctgcccatcaacacccagatattaggaaatgtgagagagaaagagagaaatgagaagcaaaaaacaatagggggaccaacacggaggaaggcctgcctaccgcctttcacagctccgagataagcattgaaggggggaccaacacgagggaaggcctgcacatcaacacccagactttatgaaatgtgagagagaaagagagagagagagagaaatgagaaagaccaatccacctttgccctttgcgctggcgtgacatcgacagaagatgaaaacacaaatggcaattgttgctcgaccacttgcggaccattttgctgctgctg

SEQ ID NO: 62564 - DNA, 882 bp, Heterodera glycines
  misc_feature (398)..(398): n is a, c, g, or t
  misc_feature (410)..(410): n is a, c, g, or t
  Genomic contig location: Contig_ID=SeqID_32239; Location=344..1225; Strand=-
  SCN-specific regions: Sequence locations=1-417,451-511,564-656,704 -759,781-858,880-882
atgtctgaacaattcccatcattttatatggccatcattttcggtgtatttttgtgtttgggctttgtgaaaatttatgaggtaagggacaaattttgaaaaaaaaccgttcttatgtcctttaccaagggtagcgttcgaaaatttctttaaataaaattctttattagtcagaaacttcaaaaattttttaaaataaagtgtttgaaatttaacccttttaatttttcactattagagaaaaatttaggttcacggattgacctgtccacacggcctcaaatccgagacggaaacacggaaaccgatttcggagagcaagaatgttcagtgctacatgatgaaaaactggttaagcatgagtgttatatgcttaactgctcggatggtatatattntaattgagtctntcttgagataataaataaactaattaataaatatattttagttttccagaaattttctttttatagttgcccaattaggctaccaccctccaaactcaatgataataaatatttaaattttaaatattattttaatgttagtaataatattttgaaaggaagaaagtaataaatcctataagcttaaatcaactaaactaaacatataattgttatagtagtgaaagttttgagctatcaaatttgtaaaataataataataataattgttattaattatttttaatataaaagtcgtataaattgtaattaagccaaaaaacaaatttttgctataatttatttaacctttttcaatttttataggacatcaaacgcgaaaagaatggggatgcgcttcagatttcacttccaatttggaggagattgcgaaaaaatgcggtaacgggcaggccggtttaggaaaattaaa

SEQ ID NO: 62565 - DNA, 537 bp, Heterodera glycines
  Genomic contig location: Contig_ID=SeqID_32241; Location=93..629; Strand=-
  SCN-specific regions: Sequence locations=1-99,121-254,279-359,381 -425,447-537
atgcccaacattcttttccaactccattttttggtctcttcgctttgttctgcgcacaatgtgacatcgccagcagagctttccgcaattgcacctgtaaatttggaagaatctagaaaatggggttgggttggacgaaattttgattgtgactggacaacttaaaaaaacccaaatccgtgtttaaaggcagaaagaatttcggatatattaaagtttggtttttacaatagcatcttttcctttcctcgtaaaaaacaacttcttgttttgttcattttcagccgaacacaaatgatgaacgcgatgagggaaacggaagcgaattggaaagtacggtggacgacgacgagacggaggaggacttggagatggaggacgtggagacggccatggcacgccaacacagcgcggacggcgaagtcattttctaacattgataagaaaaatttttgacgagaggcaccccctggcgatctttttttgttcattggccaaagcaattttcattttctgttagccgcccttggtattaaa

SEQ ID NO: 62566 - DNA, 618 bp, Heterodera glycines
  Genomic contig location: Contig_ID=SeqID_6704; Location=581..1198; Strand=-
  SCN-specific regions: Sequence locations=1-221,243-307,338-361,384 -432,465-480,502-618
atgtttttactggtaccgtatgttctcattgtactgtataaattaatgttattatccaataaataatttcgcttaaaatattatttgattcatcatctacagtaatttaggcttggtcggctttaccggtgccagcgctcgttacggtggtccatttgttaccctttcggagttgaaaatttgcctagccaattacgtaagtgtcagcatatttattgcccatctttttatgatttaggcagtaaattcatacattttttcgtttattaattaatatatttagaggttttgagaatttatagtaatttcttatggaaaatgaaaaaattttcaaattcgtttttttaatgggtatcaaaaccaatttttaaacaaaaaataatggctttctgccttatttagtgctcttttacaatttattgcctaaaaagcatatatatattatatatttttatacatattttggtaaacatatttaagaatttttgtacttaaatatttcagtttgtatcagggttgttccgggttacccgatacccgaaacccggcatttttctcgacccgaaacccgacccgatgattttgggtcgggtttcgggtcgaaataagcactggtaa

SEQ ID NO: 62567 - DNA, 697 bp, Heterodera glycines
  Genomic contig location: Contig_ID=SeqID_6705; Location=581..1277; Strand=+
  SCN-specific regions: Sequence locations=1-133,155-413,435-478,502 -603,626-697
atgagcaccttttggcgtttagcattggtgcagaaacggctgtccgattatttcaatgcgatttgtgaattcaatgggaaaaagtaagttttggatgggaatgatcagtttcaaaggccgggaggaaatttcaaagcaaaatgaaagaacaaagatcactttctttgattttacttagccacattaaaccacccgccaaagacaaacattagtaaaaccttaatttatacctaaagggccttcattgtttgaataattaggaaccattaaattttggccatttcggcccggcatggctaagatgtctgctgatcacttgtgctttactctttgaagaaattccgcatttttagccctttttacgaccatttggcttttatgtgctgcgacagttgctgtgcttttttgttttggctttgaatgcttaaaatctgcctttattttcctggtgctgcttggtaaacttcgtgtttttgtgccccaaaaattccaaagttttagtcggattttgcattatctttttaacaaaatccacgcatttttgagtcgccggggaatttaaaaagaagtgttctaccacactttgccattattttgtaattgtttgaataattttatatattttccaaatttgagagccgacgacaacaccatcggcacaatgaggccccaacaattgtcggctgcatcagcctaa

SEQ ID NO: 62568 - DNA, 483 bp, Heterodera glycines
  Genomic contig location: Contig_ID=SeqID_32246; Location=106..588; Strand=+
  SCN-specific regions: Sequence locations=1-176,198-483
atggttggtgttgaaccttcctcaaatatttgtcattcataattatgattggctcctgcttctgctgatcattgttattttgttgtttttgttgtcaatgttttttgagaattgcccaattttcagagccaacgttaccgtttctttgcggataaacacttggaactgttgcgacgatatcacgaatggatgaaggattcgttgcttctactggagaaagaattgaatttgggtggtggggtgggcgatgaattggacaatcggcggagaaatggccaaacggagagacaaatcagcaaatttggcagaaaggatgggggagagtcggaaaagagccaaagagacaaatggcaacagaaagagacgcaaagagagcaaaacggagaggaaacggacaaaaggggacgaaaggtgagaataatcagaccaaatgagaaagtgatcaaaagggaggagggaagtgagaatgatcagaccaaatga

SEQ ID NO: 62569 - DNA, 307 bp, Heterodera glycines
  Genomic contig location: Contig_ID=SeqID_32246; Location=890..1196; Strand=+
  SCN-specific regions: Sequence locations=1-226,248-307
atgctgacaagagatttgagggacagtcaagtgtggaaaacggtggtgacggtggacggaattagtggcggacaagcggaacggcgggggcagcggagcaccgcgaaagacgaaaagcggcacggggacacagaggcggttgcactgcgccgccacttttacgccgaaaagccaacaaacgaacaatggcagcagaacggacgagtggcattggacgaggacgggcacaacgccaaccaacaaaagttggaccgaggcgagaactgtttgccattaacgcacaaattcaatcctttagcgccgaatg

SEQ ID NO: 62570 - DNA, 910 bp, Heterodera glycines
  Genomic contig location: Contig_ID=SeqID_32249; Location=167..1076; Strand=-
  SCN-specific regions: Sequence locations=1-910
  Gene Ontology: Mol. function=protein carrier activity; Cellular component=cytoplasm; Biological process=protein-nucleus import
atgttccattcttcgctgctttacggtgccgacagttccgtgcggactgccgctgtccgtgcctatgttgcgtttgtgtgcgacaatgaggagaacgacgctgtgatccgccaactgtccgacttggtccctgccgtcatcaaagtgtgccaacatgtcgtggacactgaggacgacgacggtgcccagtgcctccgatttcatctcattaatcaacttttaaagatgtgcctttgcaatgtttgggcgatttggcctccactcttcccaaaattctcgcccctcacatgagcgacattttttcgctttgtgcaggttttgcaaacaaatttcaagcagaacggcactcggatttacaaaagtgttttagggactgtggccaataaagaaaaggacgaatcgtacagacatagtggacaattttcccattttggataaagaataaaaaatgtttaggtggcctggaagtgatggtttccatctgcgaaagttccaacataatgcgaaaaaagggagcgctgtatttgccaccgctgagtgagtgaaaactttcatttggcccattcttatccagtccatttcagtccagcaatgtctgcagttgatgaccgagttggacgacgaattggacgagtggttgcaaatggacgacgccgaggacgaattggaggaggaaacggcaacaattggggagacttcactcgaccgaatcgcttgtgcactcggcggaaaggcggtgatgaaccacgcgttgcaatgcatcaacgaactgttgaacaacgaaaattggaagtgtcgtcatgcggggctttgcgctctttccacgattggcgagggatgcaagcgccaaatggaaccactgatccccgacattgtgaacaattttgtgctgccgaaaatggccgacccg

SEQ ID NO: 62571 - DNA, 2238 bp, Heterodera glycines
  Genomic contig location: Contig_ID=SeqID_6707; Location=522..2759; Strand=+
  SCN-specific regions: Sequence locations=1-167,190-363,385-403,425 -446,469-995,1018-1034,1068-1116,1138-1378,1400-1576,1598-1697,1719 -1728,1750-1811,1833-2238
  Gene Ontology: Mol. function=structural molecule activity; Cellular component=axon; Biological process=regulation of axon extension
atgcaatctgcagctgttcatttttctgctactgaagattgtgaaattcccgatgcgccattagcacaagttgacgaattggaaatggttgagggcagtttcgctgctttctcttcgtcactgaccgatatttcagcgggagattggtaaagacaatttcgaaaaagtatttcttcttttacattttaagtgagaagtcgcagtcagacgagggccctggcgaagatttgtcgaattgttctgtcaatttgtcttcgtcgctgcaagacttagtcgagtcttttgacgacaaagtcgcagtcgttctgaaggacttcgaaaaagatgctgaaaaaatagcgccaattaaaattcgttctcaggaagaaataatgtctgaaagccagtgagtttgggactgaacattttgtagtaaaatattaaaagttattcatgttgtagtcaagggaaaataaaattaattggaaaaattaaagttttttttttactttaatttggaaacagaaaatcttggcagtctgtcattaaaaatgtctttctttcattttcagattttggtggactttgactggcaattatggaaatttgccgccgattgacttcgataattcgcaaatccgaaggaaacaattggaagcactgaatttcaattctccgaaagtcatttcgcctgtctttacactaataaattgttttttgttttttttgttcttagcagggaacgccaaccgatcgaagtgtcgtctccgactgcgactcgtcggaggacaccgaacgaatcgactttcatcgactcgcaactgcgcaaacacacaacgaaaacggcgaatccctttcctttaacgccgacaaagtcatcgaggaaatcgatgagattttacaggtaaatgttaggagatgacttttttattgtgcaactcaatcaggccccagaccagaaaaagcgtatgaggtggaacccgaagactttttgtttgctcttccctctttttcccgttgtattttaccttctttcgcgaaaaatgaatatttggattaaattattaaaaaaaaaaaattttttttttgcccttttggttatgggtttgatgcaatttattcgatctaaaaatttctattcaattaaaaaatatttatccgtttaactgttgaaataatagatttttttaatggattttcttcacttggttttcatccatttcttttgcgtttttaggccggcgatttgatgaatcagtcgttggccacaaaccgtacgattgagtcggttgattcgatgtattcgtcgatgcgttcgccaaatgtttattcggacattgaggcggagttcaagtccaaagagagggaaggcataagtgtgtctatcgaaggtccgccatttttgttaattttttcaaggtttctcccattttaagaaatgaattcgttcacccatccaaactgatcacaattgtcagtgagatggagcaaatcattcagttgtacaacgaggaattggtcagggaattggcgcggaaggacgaatttgaatatgagaaggaaatgcgcaacaaattcatcactttgttggtggcggtgcaggaaaggagaaggaaacagaacggagggggaggaggcaaaaagcaaaacaaagggacgacgaccgaaacgaacaacacaaacaacaacaacaacgtgggtttggtgtggagatgcattttgatcagttgggccattgtttgatttcagttggtctccgtttccattcctttcgatgattcgaccgatggtccgtctctctctgcgcttgaatggctcgtcaaaagtcgggattttcccccttttcacactttggtatttgtttttcagttcttcaagcaatgatcgacgacagtgtccatttgccgtctctgctcactgattacattctcaacggtcgttgaattttgccgtggggctcacttttaatttgcccttttttcagttgtttgcccttcaaaatttgccactgattgactttttctgtgccgattagcatgccaattctttccctcgactgctccgtcgttggctctttccattgcatttgcttgtggcctgcttttccgttacgactgtctttagaatagaaatggcgtcacattgcttaattcgtcaatattattgtatcatttccaatcgtttatcaaattgcccagactgtcctattacaattagtccgatctcatcgcatttaataatttcgatttttgaggtcca

SEQ ID NO: 62572 - DNA, 830 bp, Heterodera glycines
  Genomic contig location: Contig_ID=SeqID_6707; Location=3085..3914; Strand=+
  SCN-specific regions: Sequence locations=1-352,374-830
atgggtaattttggacgacaaatcgccagttgcggattcgccgttcttttgatggcgttgcgctgttccgtcggcgatggtacgttggaccgattggtggaaatgggcaaacatttcgggatcacttacaacggcgaactcttttccggttggttctcttttgagggtcatttaatttcgttgatctcaaatagcattttcaattagtacattggtcaacacttactacatttgaattcattttttaagctgattggatgtgtgaatttgtccaaaaacattggtcaaacgcttgcgaattgcgagtggcccaatttccatctccaaattccatcgtgcggcatttgatttctgggaaaaaagctcatcatcaatgtacaacgacagttttggtgccgtacgattgtgacaaaaatttcgagccatgcaatcggcagggcgttgcagcacattgggcaatcattgtgagttcaaaccaaaggcgtagccgaagtaatgaaccaactcaccgaattacaaaaatgtcaaaaattaaccattctcgaccaaatatcttaataaatgaaattctataatgcgtaaatctttttttgtgtaccgtgactccgccaaaggctatggctacgcctttaaccaattaattggtaatcgataaagaaagaagcaattaatttgagattggatttgttatttttgatgtcaccgctcaaaatgggccagaaaatcaaaatgcgaaagttattgcatttgacgaaaatgacttccgctgtgatggctttgacaacgaacaccttttgtatcttatagcgcttcaggggaaaagtcggtaa

SEQ ID NO: 62573 - DNA, 988 bp, Heterodera glycines
  Genomic contig location: Contig_ID=SeqID_6707; Location=4458..5445; Strand=+
  SCN-specific regions: Sequence locations=1-838,865-883,905-988
atggactatggacggaacgaaggcattctgcagattcgcgagttccaaagggtgcgttttgcgcgtgacggtgctacgatagtggcgggtacattaccttgttcttcgtagggcggtgccgtcagcaacattcccggccttgtcatcgctgcgcaggaagggctcgaagcccaacacgcaaaagagaacaaaggcggggacaaagtcaatctgccgaccaatgacataacacgtgagagagttgtcggaggaagggcatttatccatcagggctcgacttaactgattttcaattacggaaatccgtaattacggcggtttttataattacgaccatccatggcatccattcacagccattggctgctcaaatggaccgtttagtaatgcacgaggccattccctttctgcctttcccggtggcgttggcctgtctttttctcaacattgtcttgcccggctcaggtgcgtcaattgcattacaaaaagcggcaattacccaaaaataaatcgcaggaacaattttgagcggcgcttcggcactttgcatgggtatttggaatttgacgaattaatgaatcaattcaaaaagcgccagggaaagaatcccacgtaattttccatttgttcaattgactttttccaggccaaccacgggtgaacatcaaagaaggtcgaaagttggtgacactgctcgtgaatttgcttgtcgggatcagtcaattcttcacaatcacttttatgttcgtcggatggttttggtccatcgcttggggcggtctgatcatcatccacgcgagtccgtttcacgagtgcattatgctcccccccccccctccaaactttttaattttcaaacagaaatttaaaaaaaccttaggaaattttctaacaataaaaaaatttcaagaaaaaaaaagattcatttctttttcagtgcaatacagagaagcgttacaacagcgcaggcaagaggcagtggcaaccg

SEQ ID NO: 62574 - DNA, 1740 bp, Heterodera glycines; identical to SEQ ID NO: 6708
  Genomic contig location: Contig_ID=SeqID_6708; Location=1..1740; Strand=+
  SCN-specific regions: Sequence locations=1-602,624-701,725-843,866 -994,1023-1177,1199-1218,1241-1695,1717-1740
  Gene Ontology: Mol. function=diacylglycerol O-acyltransferase activity; Biological process=regulation of nurse cell apoptosis

SEQ ID NO: 62575 - DNA, 680 bp, Heterodera glycines
  Genomic contig location: Contig_ID=SeqID_32252; Location=192..871; Strand=-
  SCN-specific regions: Sequence locations=1-132,201-257,279-286,308 -308,356-421,443-452,482-517,542-680
aggaggacactcggagacggaattggcacgcgcatcccccgcggcattggtgcgacgcttaaaagccatttgggggaaaacagacgaaattggagatggggagggaaattatggcgaaagaattggcattggattaatttaaaataaattaaataaatccatcgaaaatgtaaaaattaaaaatattttttaaaaaataactcaacaattttcagattaacaatttgctcggccgcaacaacggaaacagcgcacaacagcagcaaagtgagcagctgacaatgggcggccgaggcaccaatggtggcaaaaaaacgaaacaataaaacaaaacaaaatgaaaaaccaaacaaaaatcgggcgctcccccgggggcaaaggggcgcaaaagtgtgacattaaaaggtgtcagttgttgcgacccattcattcattaattcatacggtcacttgagagaagagagagtgagtgagctgaaagtgatcaacgcaaaatacggtctatcgaagggaaatcatttaaaataaaatattttaaaaaggaccgattttaatgggattttcaatcgttcgttgttcagtgatcggacaccaaattgcgcagcattcggcggctggtctcaacggggcgttgctgcagggcatcgattttgccgcgaatcaattggccaattatgccg

SEQ ID NO: 62576 - DNA, 314 bp, Heterodera glycines
  Genomic contig location: Contig_ID=SeqID_32253; Location=329..642; Strand=+
  SCN-specific regions: Sequence locations=1-314
atgtctaacaaaacgaaggaaccgcttgctttcgtcactggtgtcgatgataaatgtgtgtttatttggtcttcagaatatccgttggaagaattacgctttccagtgaaattgggtgcacaaagggtgggtgtgatcccgtctgtctttttcaacttaatctgtttcagcccgaattgggtcaaagggttcaatatgtttgcacaaaacctccacatgaggttcaatatagcgggatactcaaaagaatcgcgaatccgtcacccataataattctgcgtgatggtgaatttgtggtaatattagggttttag

SEQ ID NO: 62577 - DNA, 167 bp, Heterodera glycines
  Genomic contig location: Contig_ID=SeqID_32257; Location=271..437; Strand=-
  SCN-specific regions: Sequence locations=1-167
atgacaaaatttgacgagttttctctttacagcattggaattgccgtgcccatcagcacttcctccactatttgccttgacggcgacggtggcatcaaaattgaggaggacaaacagccgaactcgttcaaattgttgttcaagcccgtctccatccagtccatgtg

SEQ ID NO: 62578 - DNA, 981 bp, Heterodera glycines
  Genomic contig location: Contig_ID=SeqID_6709; Location=18..998; Strand=-
  SCN-specific regions: Sequence locations=1-111,201-981
  Gene Ontology: Mol. function=phospholipase C activity; Biological process=phosphatidylinositol-45-bisphosphate hydrolysis
atgccaccgtcgagggttacatttcggcacttcgccggggctcacggctgttggaatgtcattgatttgtttttaatgaactgtttgatccccccccccccccatccttcgaaaaataaaaaaagaataaatttgtaaaaaatttcaaatttttacaaaaaaatttttttgtttataatttttcagattttttaaaaaatccaattttcagaaaattttgcgtcctcttccccgaaaaaacccaagaatttttgaacgaatttctaatcccaataaacatttttttagtggatgtgtttgacggtgaacatggtgagccacaaataacgcacaaacgcacattcattggggcgatcagtctgcgcaatgtgttgaaatgtgtcaagaattacgcatttgtacaaaatccgtacccagtgatccgtaagcaaatttttttttgaatttacggcttcaaaaaccattatttttttcccttttcggttcagttaccattgaaaaccatgtgggcattgtgcagcaacggatcatggccgacattttccaagaggcacatataaacataattaatattttttttgcacttaaaactaggttccgtgtcccaaaaatttaaattagcgtcaaaaaagtgcgcagaaaactattaaaattttttttctttcccccgctgcagattcttggtgaccatttgctgattccatcggacgacttgcacaccaagccattgccatcaccgcagcaactgaagcacaaagtgttgttgcgtggcaaaaccgccggtggtgccaccactgctgacataaacggcggcggaacgcacgtcgaaacgacagcggcgacaatggcaccggcgagtgttgccgcaaacaacggcacgccgtgcaccgcagcgccaccaatgggcactgattatgacaccagggaggagagggaggacagcccgaagcagtcgcaacgcaatctgccggtggacccaaa

SEQ ID NO: 62579 - DNA, 2574 bp, Heterodera glycines
  Genomic contig location: Contig_ID=SeqID_6710; Location=2176..4749; Strand=-
  SCN-specific regions: Sequence locations=25-135,162-449,472-594,663 -974,996-1427,1451-1914,1939-2195,2232-2413,2444-2574
atggctgctgctgctgctgatggacagatgatggtggagaacaacaaaaataataataataataacagaggcggtggagatggagaaaatgtaggagcaacaacaacggcggggaataattggggtgggaaaagtgggacgatgacgacgacgacgacaccgctgggcaaccaccggacagaaaaaaataacattaatggtggtggtggggtggtggtgccattcgatttgccggtccgtcgtgttaaaaatgggcgcatcagcggggtcagtcgggtggcgctggacatctatgaggatatgctcagctatggcgcaacgcgttcatcactgttgagcagcatcagcggatgcagaaaagggagcgctggggaaaggcgcaaaaaaggtgtcctcatctttatccaccatcaaccaggggcgcggggatgtcggctgagtttttgattcccgaaatttttggggaaaaaatcggtcttagaaaaaaaattttttttttttgtatatctaaaaaactagagctcgctcgactctgctggacctgttgtaacccgcaatcctatatatatatttttcttattttcggcgcgactcattttataattcaaaaatatgtattatttcgttttttaaaaataattaaatgtttatttttttatttaccataatttttcctaaaaaggagtgaccttccgtgcttcgttttctttttaatttctctcaaaaagggaaattttattgaaaatatcggaaatttatttaaacaattttctttttgaaatggcacgtggatcaatcaatagttgatcaaaattaattgggctttcgctttgccaattaaaaaaaaaccattccttttcaagtaattttgactgatgtgcttgaaattcggcaaggctaccgcaccgatgggctgcacaaagctgccaaggactacaaattccaacggatggcaccggtcaacaaatcaacagaaaaattaaatgaaacaaaaatttatcatttcaggaacagcgatgcttctccatcatttgcaaagtgtgtaatttggtggcaattaaaaaaaaagcccaaaaattttgatattccatagaaagtcgaaaaccaaaaactcaaattccggttttttgtccaagtcgacgttagggattcggatttggaattcactcaaattgtaaaaattgcgcaggaaattttttttcgcatttttttttcctcaatcacagcaccctcgctttgtgtgcaaatcgcttgactttgtggcggtggacttggatcagacaaccaactggttgaacctgttgcaggaacattttgccaatgtgttgcatttgtcccaaaatacggtgaccaatttcaatgagcaaaaatggctgttgcagaactttcgtcaagccgatttgaatcgaaacggtgctgtgatttacaaaaaaaaaaaaaaaatttaaatcgtacaaaattttttttttctttttttgctaaagatgaaatttcgttcggcgaactttggcgtctgctcaaacgtttgaatttgcagcttagtgaccaatatgttgaagcattgttcaaggtgggcttttttgtgttttggtaattcaaggaattttttcattttgaatttggacaataaaattggattcaaagcctctgcctgtgaattttttttttgttttttaatattggccaaatttattaagaattgctccaaatttatgaaattttaccactttaagtccacccaaatttcccaaactttaataattagttcgtcctctccttttggcactgaactctttttcaaaaattttgttacaaaacgaggaccaggcgagtttgattttttcaaatttttttaaaaatttggatttcgtctaacacaccccttaaccaatttgttatctcaatcaaatccgttttttaattaaaaacaaaatttataccatttttctttttgcaaggaaagcgtttcaaagagcggccggccgcgcaatgcgttgaatgagcaagaatttctccggttgttcagcgtgctcaccgatttgccggaatatcggagcgttttgcgcttggccaacggacagggcaatgactttttggacgcggacacactccgacaatttctcaccgaagagcaacaggcacaaaaaattttttgggggggcaacatttttgaaaaagcgtctattttcggcgtcaaaatattttaataattgaaaaaaaacaaattataacattgagtaatataagtaagtgcaaataaagattggataaaaaaaaggctccgtaactaaaaaaaactataggtactgttgcaaaagaggcactttagcagttttttcgccaaaaaatgattttttttcccatagtttagccactgcttcgaattttttttttaattgccgaaaaaatctactaaaaattaaaatgaaatttttaaaatttagttcaaagatgttgatcaaaggaaggcggaggcagtcatcgcattctgtgagccggccaattttcaacaggaaaaccaaaaggatggtgagccgtcgtcttcgtcgtcaccaaaagtgttgtctgtcagtg

SEQ ID NO: 62580 - DNA, 433 bp, Heterodera glycines
  Genomic contig location: Contig_ID=SeqID_32263; Location=555..987; Strand=-
  SCN-specific regions: Sequence locations=1-4,26-148,201-433
atgaaagttcttaaataaataaacaccagagactaaattaaaaaaggaagtcaatggatgtttagaatttttctatttcatttcgaaacaacgaaacaatggaacagttttattattaatgtaattgacgtaaaccctaaagcctaggaaaatttttttttaaataaaactgaacctaaaataaaaaaatttaaaaaaaacaatggcaaatctctgatcaattaaccggattcaaaatatattgctgaattacagacaattctgcttgctgctgatcatccgaccatattcatggcacagtatgcataattttcataccaatagtcagacatgttgccaaactcgaacagttgtgccacctggaaatccctgcagtgcaaatcgcagatgacctgagcgcaaaaaaacttttttgattaaaaattcaaataaa

SEQ ID NO: 62581 - DNA, 55 bp, Heterodera glycines
  Genomic contig location: Contig_ID=SeqID_32264; Location=286..340; Strand=-
  SCN-specific regions: Sequence locations=1-55
atgctccattcaaaaagtccttataatcttgagatcaacgaagcaggaaaaaaaa

SEQ ID NO: 62582 - DNA, 117 bp, Heterodera glycines
  Genomic contig location: Contig_ID=SeqID_32265; Location=806..922; Strand=+
  SCN-specific regions: Sequence locations=1-117
atgaaaagagtaatttataatttgccatttcccaattatcgccagaaaattgcatgcaagcgaacctcagtttgtatgctcttaattgcacacgctcttcatatgtttcttgacggg

SEQ ID NO: 62583 - DNA, 609 bp, Heterodera glycines
  Genomic contig location: Contig_ID=SeqID_32266; Location=466..1074; Strand=-
  SCN-specific regions: Sequence locations=1-111,136-429,451-469,517 -517,540-609
atgggttctccggacgacatggaccagcccttggtcaggggagagcttagtaacaaattgaaagggggtgtcgatgtcggcattgccggagtgcagctgctagcggtagtttgaattttaaaagggaggggggcagcagcagcaaaaattacgaataggggaatttagtatttttgtcctttttatagcattttttttgttgaacaaaagaagcgggacgaaatggtgcaagaaaaaaagcataaaatagaattataaatttagactctaataaattttttacaattttttgggctttttttatatttttaaaaagaagtaaaaatacatttttcagaaaatgctcaatgttcggccgaacgaacgaatttccgcatctgatgcattgaaagaagcgtatttccaaaacgcggaatcagatgcatagtgaaaatgaagaaaatttagaaaaacaaaatttctgctattatgtatgatgatgtttttatttaatgtttcaaaattaacttttatttaactaaccatgaaaaaatattaaaacgaaatgcaaagggttggacggacataaaaggggcaagcggttaaaatggccgaagggaaaataataaa

SEQ ID NO: 62584 - DNA, 632 bp, Heterodera glycines
  Genomic contig location: Contig_ID=SeqID_32269; Location=970..1601; Strand=+
  SCN-specific regions: Sequence locations=1-219,258-370,410-428,452-632
atgcccggggtgaatcatattcagcattttgcccgagtgatcgacgcgaagaatggcgcgttgttgagaagcggagaaaggatcaaaataaaaattccaatcgacaaaacggacggatcacttgaagagttcaaatttgacattaatttgatgtacgaaggactcagttcgcatccgatcagtgagttcaaagtgccggcagatcaaattaaaaataccaaatttataaaaaagaaatattttaaattttattttaagttgggaaaacggtcatgaaaatggcgagtgaacaacacagaaagattccatttcagcagttttgccagtcaaaaatttagcgtaagttaaaaaggttatgttgggataagacaaaatagacatgcattaatttattgtctctatcttttcccttcgctattttccctcaatgtcttttcctttctctctgcccgtcgaagtgcataaatagtgaatgttccttacacatttcgttctctccccattcattcgcaatttgccttctctactcttctcttcattcactctctctcttctgacttttattattatttattgtcgataaatatttgtgttctttggacacaacattttggcgcggtcagcgaaggcaa

SEQ ID NO: 62585 - DNA, 1560 bp, Heterodera glycines
  Genomic contig location: Contig_ID=SeqID_6711; Location=1106..2665; Strand=+
  SCN-specific regions: Sequence locations=1-13,35-285,309-903,942 -1274,1296-1560
atgaaccgacggtaattaaattaaaagtcacaaattcgtcgtttatttgactaaactgttttcccatttcagttggatttgcaacgacgtttggatggacattttcccatcctttgaccgtcctcaactcggcctcaaattggcacttctttcgccacgtttcaatgcgttggtggataaacattttgatggcaaaagcgaattgacaatttggagaccaatcgaaattagcaaggacatcggaccagaaccgaaactatctgtgtggatggatgacaaatataacaaatttatggaatttccattgccggaccgtccgttgcccagcaaaatccgttttatatgccttcggatttagtaattaaaaatcagagagctatgacaataaaagcattccttccattttcacagttacattgatcattccgtcatcgtttttcttcgttcaaatcaccaaattttcgacaaaagaggcaccaatttacagttgttttggatttcttcaccacacaccacggatggccagcggatttgggatattttgacacgtgaaatttggcccattttttcggcaaatattcgccatttgtgcttttcccatcgtgatcatttggacaatttgcttcgtcaaatttcgccgacaattctcatcgatctcaaccaattggtttcaatccattcatttggtctgttgcccgctgcgtttggtgatggttttgatgggccaaattcaacaacttctgctggccaagcattgtccaaatggttgcacattccgagaaaagctggccaacccaagcgattgcgttgcgaagattacaacgcacaagcgaacactgattggatcaacagtttcaaggaggtgtggggtccgggggggggggggggacaacacgtagccgcaaatttttattttaattaaaaaaattatttaaaatttagttacctagcctaaatcaaaaaaaaatagataaattcgaaaaaaattattaagaaaattcaaggaaatgtaaaaaagtcgtttttttatttttctggaaattcagaaaattagtttttatacgagacggcgacgttttaggggtgtacccggtctgtggatggcattctgagttattttctgaaacccgaccccaaaaaagttataaatcgaaaatttctgaaaaattccgaattttatcaaaaatttcggaaatcggaattcagtgccatccctggtgtggccataattcgacaaatgattgatttttgttttccaatcaaattgtttagcattttcttcgtgccaatgccatttcttccgtcagttacgaaattcatttttctgttcgtgcgccgtcaatggaaatggtgccgtttgaattggtaaacgaatggacaaaggaaaagctgacattcgccaaagcaaagggatgggacaaggcgaaatgagtgacggacaaaagaacaaaaacagtgatcagccgcagaagaaatgaattaattaagaatgatcgatcgaccgatcatattcatcagtgatcaaatgcattttatgaagaaaaacctctcaattgctaa

SEQ ID NO: 62586 - DNA, 2891 bp, Heterodera glycines
  Genomic contig location: Contig_ID=SeqID_6711; Location=2655..5545; Strand=-
  SCN-specific regions: Sequence locations=1-185,207-335,361-814,838 -1231,1255-1404,1426-1792,1824-1833,1855-2015,2038-2530,2553 -2553,2745-2891
atgcaaattgtgccatttgaattggtgaacgaatggacaaaggaaaagctgacattggccaaggaaaatgaaaatgaatggggcatcggttggataatgaaacgaagcaaaattattggggagacagcggcggttcattggaaagacggaaattgggacaacaattgtaacaatgtgatcatttggcttttcagtaccactaattgcattgggtgagcaataaaaaaaggcatttaattttgtttaaataattcaaattgcgcttaattaaggccattgtctccgccaccggcagaagaaacggtacaaagcagcgaaaaagggcgaaatgagtgacggacaaaacaacaaaaacagcgatcaaccccagaagaagaaatgaattaattaagaatgattgatcgaccgatcatattcatccgtgatcaaatgcattttatgaagaaaaaactctcaatttcggtaaataaatcggatgtataaaaatggtttggtatctatcgaatgtatgaatttctccttgaaacttgtgacaattaattttcgggattttgacgcgggatttacgacacacaaaattagcaattagcaccggcaacattaagtgccgatttgctgctgttcttttctcttttcagcttcattctctcctcctttttgcgccgaatttttccttttcctctctttctcttccgtctctcctccttccccaatgctatttccctcctattcccttgtttctccatttttgctgttgtccatcttcatctcgtttcccatcaaaatttcctgttcttgttgtactgcttgaacttcttggttttgctgctgttgttgggtaatcatcggttttactggtcccataaaaaaagaggtaaaaaagagattttgagcgattttgaggtgctcttgggggttttcgggggcgatgaacacgaatatgacatccatttcgacctatttcgaaacccggacccgaattcgaacaaattttttttttgcatttttcactcggaatttgcgtcaaccttctttattgtatgtaaaattaccaattttataatatgaaaaaataatttctcaaaagattttataagctttagttgattcttattttaaggagttgctaattagtttctccggtttttttatttagacatatgcttaatttttacaaaaaaatcacttttaaatgatcactttcggcctcagaagagcataaatcaaatcaattaattttgcttttcattttttggttgaggattaggttgcttttcccaaagtgccgttgtgcgagcaaagaaaatgccgtccgttcccattcactggcagaggagggcattaagccactcaaattaacccaaggaaaatcaatggacagattaatcaatggcaattaatctgagagaagagaaccaaaatgggaacagcagagatgggcagagaaaccatggcatataaaagcacaaatgaaagatgccaaatccattcatcaccaaaatccaaattagcactaaattctattttgctcccctatttattttatttatttaccgttttttaagaaaacataaattttttttaagcacaagggttcttaaaatttactagattttaacgatttatttagcattttacatatttattttgtattattttttgaaatcccttactctgatgcccaaatttcatgtcaccattggagcttcgtcactaaaatagtgaaaattcattattttggcgttttgtcactattttttactatttcgacattttttggaaaatttctcaacaaaaatgcaataaaaccaaaaaatacacccctaagaatctacttaaaaaattttacaaaaaattaggattttcttgaatttttaagtcttataaatcatagctttttggtgagatgattcagcgcttagcttctgcttaatgattacttctaatctcccaataattaagaaaaaattcatccaggtttcattgcctttttatcgaccgaaaattttatttttcggcattttcttctgtaaaactcaaactttgcctcaataagtcaaaaaaatcacgaacaaaagtcgcaaaaactcaaaaaagtcataaaaatccgaaaaagtgtaaaaaaagtcaaaaaaagtctcaaaaaaatgcatgttagaagtagggatcggatttttagtggcaaaaatcccaaaataattaactaaatagtggcaaaaatagtggcgaaaaagttccaaataattacttttaatagaaaacttttaagctctgatggggttttgaacaagcccaatttcgagaaagaattactcgattgagtaaatttcggcataaatttgaagagaaaaaaaggattttcgatgagagacctattttgattttggcagcaaatgtcgggacgcaaatgtccgaaaatggccctttaagaaatgggccacaaatgtccgaggcgcaaatgtcgggccgcaaaagacggaccgcaattgtcgtttttggctggtggccgcaaatgtcgtgacacgaaatcaacaacagcaaaaaggaaacagcgaagggggaggagaaggaagagaaaatggggggaaaagagagaaaaagggaggagaaaaaggagcagcaactgaagaagaggaaaaagaaaattgcagctgaacaccagcagaaacaacaacatcagcagaagcaagaacattggaaggaggagagacggaagagaaagagaggaaaaggaaggagaaaaaggagcagcaacggaacaagtattgctaatggatgtcggaaatcccccgccaaaatcccgaaaaataattgtcacatttttgaaaggaaaattcattcattcgatagatagcaaaccattttatacacccgatttatttagcaattga

SEQ ID NO: 62587 - DNA, 1010 bp, Heterodera glycines
  Genomic contig location: Contig_ID=SeqID_32272; Location=52..1061; Strand=+
  SCN-specific regions: Sequence locations=1-14,49-65,87-241,263 -275,297-514,613-855,887-969,991-1010
atggacgacgaagacgaatatgaggaggaagaggaagaagccgaagggatgggtgttttggcataccaaacggtggagggggcacaatcgacggacaatgtgcaactgatcggcacctcctcaaacactggtgcggaacatgctgggatttttatccagtggagaagcgggggggggggaggcgctggtagccatttggtgaaaaatttttaggagcacacaattttgaaaataatttaaatagtaagaaatattggaaaattaaggcaccaatgagaagaaaaacgaggacagagtgctcgaaaatggcacgtttggccaacgttcgtccgtgcaagagtcggattatgtcatccgccaaattcgcactgataacaatccgcggctgttcaacgaagtgccaacagtgccgggggaattgtttttgctgcgacaccaaaacgaggaaataccgcattactgtatccgtcctcagggcatagaggtactgtaaaattatgcaaaatcagacgagaatttttttttttttttgaaaaatcttcattaaattaattatgctaaacaatttaaaattaaaaaacaattaatataaaaaaaattaattaaataattgttagaagattttcctagctttttaagaataattagttgcgagattaaaaatgatcacattaaattaattgttatgaaggaatattttctcaatattttaccagagttttctaataccatttttaaaacattgtcattaattaggctgatcgtttcatccaacagtccctctccgagagaaatcggtcggaaataaagaaatttttggagcgaaatgtcgcgccggatgacggcgactgtacgcttccaaaaacacacaaaaaatataattattcgaatgttttcagggtcatatttgtggatatcgcaagagcttaagttggaggtgtttattactaattagcgttaattaatgaaaaatttaactcttcagaattacccagtgttcatcttttcaa

SEQ ID NO: 62588 - DNA, 54 bp, Heterodera glycines
  Genomic contig location: Contig_ID=SeqID_32278; Location=698..751; Strand=-
  SCN-specific regions: Sequence locations=1-54
gctatagggaagctactcccgaaggattcggtctccataaatctgggcgcatcg

SEQ ID NO: 62589 - DNA, 420 bp, Heterodera glycines
  Genomic contig location: Contig_ID=SeqID_32279; Location=255..674; Strand=-
  SCN-specific regions: Sequence locations=1-265,302-420
atggccactctcgttgatcctcgattcaaaaacaatcctaacattttctcgacaaaagaacgagctcaaaatgaagtgttattgcttgacacagtagaaatgctaacgaatccatcacgtcgagggtctgaatcggaacaaccaaaaataaatagcgactctccaaatttattggaatcttttattggagccactcagtcgattgattttactgattctcaaacaaacaaaattcgtgatgaaattatgctctaccttcaggcacaaattaaatcatttttaaaaataaataaattatttagtcgacacttcaaccgttggaatcggacccactgcttttttggaaggaaaactcgcaatttcctacaataaaaaagcttgtcccaaaatttttatgtccacctccaagcagcgtagaaa

SEQ ID NO: 62590 - DNA, 650 bp, Heterodera glycines
  Genomic contig location: Contig_ID=SeqID_32281; Location=1..650; Strand=+
  SCN-specific regions: Sequence locations=1-89,112-233,256-650
  Gene Ontology: Mol. function=RNA helicase activity; Cellular component=spliceosome complex; Biological process=RNA splicing
caaaatgcacattcgcagtgccatgtctgttgaagacttgctgcagtgtttagcggtgcaaaaaaaaggattttaccgaaaataaaattgttttattttttcccaacaggactgcccagaatacgaggaaatccctgtccgtcacaatgaagaccaaatcaacaggtgtctcccagcatttgttcattttgatctattaaatccttaattcatgcgccaattgccattttactatattatccattcattttcaaaatttgacacccaatttttgcaaaatttcagtgaaattcaatcctttttgcccatccgattgtctacctccgattggggttcaccccatgtgaaggcccatcttctttaccaggcccacttttcccgcatgaaattgcccgtcgattacaccactgatcagcgttccatcattgaatcatgcattcgaatcatacaggcaaacagcgatcatcattatcatttttgccaaaatggattacatttcggtcaattctgttcaggcaatgttcgacatttgtctggaattcgcgtttgtcgacacggcaatcaatgtgctggtgctgcttcaacaaatttaccaagcccgatggtactctgaccatccgttgttgtgtctgccccacttcagttcacat

SEQ ID NO: 62591 - DNA, 490 bp, Heterodera glycines
  Genomic contig location: Contig_ID=SeqID_6712; Location=136..625; Strand=-
  SCN-specific regions: Sequence locations=1-271,293-490
atgaagcagagggatgaaacggcggacaaaggagggaaaggcacgaatggaagcgacaaaaagcggaaaggcatttgcgtgggtaaggcaatgaatggataatttagcggaaatggtaaaattaaagggaggggggacacaaaaccaagcgaagaagccaaaatgaccgactttgatcattctagttcgtaatcaaaaagtgccagaaatggatttcactaataatgggctgagcgcttgtcactcgagcaaacttctaagttgttgaccaaatccaaattaaaagtgtctcaattcaaattgaattcagtctgaaacaagcaaaaatcaaaccgttcttgacttggaattgaggccaattataaaagcaattatttcagttccagtcaacgaatgcgcagatgaaacactgaacgactgcgatcagaaagtgatcagttcaaaaaaagcaaataaatctaatggatcggatttaggcacgatgcattga

SEQ ID NO: 62592 - DNA, 259 bp, Heterodera glycines
  Genomic contig location: Contig_ID=SeqID_6712; Location=4181..4439; Strand=-
  SCN-specific regions: Sequence locations=1-191,213-259
cgagtcaacaaagcacgtccacggcgcccaacggcagcattgaggaggaaggcgacggtcgtgttggtgcatcatcatcggaggacagcgacagtggtagtgatgcatgatcggaggagcacaaataacttagttttccactcacatttggcgcctttgtttcactaattgaaattgttttatgcgcgggtgcttttcttttctcaaaaacctcattcatttcatgctttttttgatgaataaaccgagttagcacaca

SEQ ID NO: 62593 - DNA, 2062 bp, Heterodera glycines
  Genomic contig location: Contig_ID=SeqID_6712; Location=5175..7236; Strand=-
  SCN-specific regions: Sequence locations=1-12,34-103,129-145,167 -238,260-300,327-625,664-1750,1804-2062
ggaattatgacatttttgttggggccaaaatggcgttcattcttcgacatgatcattgtggacgcgtgcaaaccgtcgtggtttggcgaaggcaccgaggtacaaaaaaatataaaaataaaatatttgtttgggtgcactttatcccccccccccccccccccccgtaaatcatagatattttttcacacaacaaattttaagaaaaaaattttgagaaattttcaacgattttcggaaaacattttgaaaaatcttaataattcatcataaaaatttctcggaaattttttcatagaattttcttatgaaaaactaagattttttcttgaaaaatttctatgttagtaaatgttttttaaaaaaattttctcgggggggggggggacctcgctgctcccatttgtttagcatgtgcgaaaatttaaaatttttttgcttgtttatccgcttattcaaaggtcgatacggatacggatacactgaaaattggcgtcccaacaaatccgttgaatgaaaaaggcgccgtttattcgagaggtttggcaatttcaaattttgccaatatgttgttaaaacaatttttcacacaggttcatgggagaaattgcgccatttgttgaacttcaagggcaaagtgctctacattggcgaccacatctttggcgatgtgttgcgttcaaaggtcggccaaaacaaaacaaaaaaacactggccatatcattgttttgggccatgagcagggatggaaaaaaacatcgtgttggggtggccacaagagttcggttcaatttcgagttctcgggccggcaaaaaatgccgggttgagaaaaaaaaaggtttgcttgggccggcccaacggttcgattctgggtttcgagtcgagaaagaatcaatcggctttcgagtcgagttttaaaaaaattgtgtattaaaaaatcactcccataattcatcggttggttgttcagaaaaccacgggttggcacacctttttggtggtgcccgagctgagccgtgagctggccgtgtggacggacaaccgtgaactgtacgaacagttgcaacaattggagtccgagctggtggagctgcacaagcgagacaaaccaactgaggcagtgaccgaccccgtgttcaaggccatccaggcaagtgactattgttctatgacaaaaaagcaattcaataattaatcatttgaaaaaaatacaaaatggggacaccaaatttatctttattttacggcacaaaaccgggacttcggtactcaattgtccgtgtcttggccccggtctcgacctaccctactaaaaagtgacattttcttcatttttgggctcaatttataaaagtttttgatcactttttaaacgacaaattgagtcggtctaaaacaaattctaattgcaggaagttacacagtcaatggaacaacagtacggcggtttcggctctctgttcggaagcggaacgcgcacctcctttttcgcctctcaagtgggtggtgttggatgatgtgccgtggcatttgcatttaattagaaaagaaaaagtgcccttttcccatggttcgcgatgccatgccaactcattgggtttttatgataattccacaatatgttggaataaatttgctacttttttttggtattccaattgtttatggttagttttttaataaagatatttcttttttttatctagaaaaaaactttcaccgccgcctcaacccccccccccctcctccaaaaaaattgaaaaaaaattcattttaattgaaaaaactaattaaaaaatttacggtttttaaaaaaataatcagagcgaggagatgcttcctcaaaaattgactaaatccttaccaaaaaaaaaattttgtaaaattttttgtcccttttcagctggaacagtatgccgatttgtatgccggctcttgcttcaacttggtccattattcggtcttctatttcttccgcgctccaatggcactgatgccgcaccagtcgacggtggaccatggggccgcaatgccggacatagggtcacgccaaaacattga

SEQ ID NO: 62594 - DNA, 1149 bp, Heterodera glycines
  Genomic contig location: Contig_ID=SeqID_32282; Location=53..1201; Strand=+
  SCN-specific regions: Sequence locations=1-143,166-1149
atgaatgctgcccaagaaccggcatacgaccctgttgcggcttctcgaattcaaaaactttaccgccaaagtcgtcctcgtgcataccgagaaatcacagaacaatcatcaccattttgtcaaattgagggaaacgatcttttcaaccaattcagccaagtttttgaggagaatgctccgatcgacgaagaaatgccaccggaaataccaaggcatggaccaccaactgagcgaaacccgctgggcccacaatttacccaaaaagaagtgtgggaacgtcttaaacggtgcagcaacacggccccaggcccggatggtatccgttattcagtttggaaaaaatatgaccaaggagcgcacatccttacgactattttcaattgtgttaaaagatctaaacacatccctcaaagttggaccaaatcagtcactgttctgctccacaaaaaaggagacagaaacgaagtgtcaaattggaggccaattgcactctcaaataccatcggcaaattgtactcttcagtcttggcaaaccgattggcgatgtggtcaattgccttcaacagagtcagctcgtcccaaaaaggctttatgcctgtcgacggttgtgccgaacacaacttcgtactccaatcgatcattcaggacgccagacgtaccaaaaaacggtgctcaattgcgtggctggacttgaccaatgcttttggttcaattcctcaccaaacaatttttacagccctaaaatggtccggactatctgaccagtcaatcgctgtcattcggcagttatatgccacgaattccactcaaattcggcattcaaacggccttactcccgaaattccaattcgcgcgggagtaaaacaaggatgtccgctcagtccaatcatttttaaccttggaatagagcccatcctccgcaccattggccaactcagaactggctataagttgcaaaaaaaacgcattgatgtgttggcttatgccgacgatctcgtccttgtggccgaatctgccgaagaattgcaaagaatgctggacgccacctcaacaatagcaacttgggctggactttccttcaatgcccgaaaatgcgcgacgctggacatagatgggcggagaaaagcagcattaaacactgaattcacg

SEQ ID NO: 62595 - DNA, 1128 bp, Heterodera glycines
  misc_feature (1027)..(1027): n is a, c, g, or t
  Genomic contig location: Contig_ID=SeqID_32286; Location=94..1221; Strand=-
  SCN-specific regions: Sequence locations=1-232,304-359,391-464,493 -530,552-803,826-1128
atggcctacaccatttccaagcacatgttgaagctaaacggcacctattggatgcagcagccccgggtgaccacagtgcaaacatcggcaccgatggtgaacgcgatcaagcaagcgctattggcattccttgaccaaaacggattcttcccggaacacattttcgtgttccgggccggggcctcggaaggcgaatacaaaaaggtgacgaacagtgccaaggaggcagtcgaaattaaaaaataaataagattcacttaaattttatatctctttaaataattttataagataattttttttgtgtgtgcttataggcaagggtcttttacttaatttggtatatgtgatgaaaataattgataattttttcacaaaatattcttttttaaagcaggaaaaaaattttcatttaaaattttacaacttttttgagaaaatctgaaagaaaaaattgcgttcttaaatttaaaacattttgaaatttattttagtaatccttaagaaaattcttattagaattatctgaaaaatttgaaatattttatttattgtgaaggtcgcgcattgggagggcggcgcattcatgaccgcctttgccgaactgatggctgaacagcagagcatggccaaaaagccggcactgacaatggttgtgtgccaacgcaactccaactatcgcatcattccgaccaatgtgcagccgggcggccgtgcgcaggaacagaactgccagccgggcactgtgctggataaacaggtgagggaggaaactagggacggggtatgaacccaccacaggacttaccaaggttgacattttcatatgtgaagctagggtggcatgccacgggcttacgaagggcggaatttctcgggtggacagatgggcatgcacacgggttttccaaggaaggaagaggggtggcacgcaccacgggcttaccaaggttgctaatatacacagtttttcaggtcatgcattcttcgttgacggaattcctactagtcggccatcggactatcncaagtgggttgaggcttcggttgaccctcattccggctcaaacctaactggcatctaaccaccttttcccatctcaacgtgatcctaaatcagaaattaaa

SEQ ID NO: 62596 - DNA, 399 bp, Heterodera glycines
  misc_feature (377)..(378): n is a, c, g, or t
  misc_feature (387)..(387): n is a, c, g, or t
  Genomic contig location: Contig_ID=SeqID_32287; Location=1..399; Strand=-
  SCN-specific regions: Sequence locations=1-195,223-399
ataaatgaaaatgctcaaacggagcattcttttacaattaacaaagaaagagcggctgaaaaagctgaaggttaggtcatattttagtttggcgttctcattgattaaattcaggcggaaatgttgagacaaacaaaaacggagttttgttttcgatgactttggccagcgagtctaatttctgcacttcgacgccaatcaaaaaacaacaaaaagtcagcaattcgcccaaaagtcccatcatttcatcgcttgtaaatgaagaaattacgaatgaatttgaaagttgcttctgcaaatggttgcgatatgttaccaattttgaggacaaattgagacgtgaaattagtgcaggttgagaacgatccaaacgaagnngtctgatgnttagcaaaagac

SEQ ID NO: 62597 - DNA, 817 bp, Heterodera glycines
  Genomic contig location: Contig_ID=SeqID_32288; Location=374..1190; Strand=-
  SCN-specific regions: Sequence locations=1-412,510-573,620-694,717 -782,804-817
atgtcttcagctcgatgccggatggctttggggcccgcgctgttccgacttcggcaacatgtcacaacggccgaaaatttgctggatgagcccgtgagcaatgccgaaacgattgaaaaccttgaacaggaacgaggtcacatcactcgtatcctgtcaaggatggaagtcgagctggaagcgtggggtgctatcatgaacggacttcaaggcccagcgagagaggcggaggaagtgcttttcactgcctttattcgtgatgaccggcacttgacggagtggttagaacatgcgcgagaaatgctggctcacatagcggcagaactcgcagatgataaaattcacaatggaaaaagtagttttaaataatgtacgcatccaacaaaggttgacataaaatcaatattgtgagtttaatatttataaatgttaattttttttggcttttatttattatttttaattaaatttttaaatattttattacggaatttaaatttatataatatccagtatatattagtagtaataattttgatattgatagcatcaatatttttctccctcgaaatctaattttaaataatttgtttaaaaataattttttcaaattaataatcttgttgagggttgtcgtttctttccgaattgtttcattttattctaaaaaataattatagaccatagattactggtatttccatttttatttgttttatatgtatcacttcaagattacaatgtatatttggttattagtatatttttctacctttattaagagtattaaaaatactttttcccattaaacaataaa

SEQ ID NO: 62598 - DNA, 1707 bp, Heterodera glycines
  misc_feature (432)..(432): n is a, c, g, or t
  misc_feature (455)..(455): n is a, c, g, or t
  Genomic contig location: Contig_ID=SeqID_32289; Location=213..1919; Strand=-
  SCN-specific regions: Sequence locations=1-477,499-1000,1029 -1457,1489-1707
atgtcgtcatcatcgtcgccccagtcgcgctacgactacctggactttgctggcaaaccggaccaaccgcagcagcatcagttgcgacgacaacagcagcgagcagcgccgcaacaacgcgtcgctgtgccgccaccggcgctgcgacgtgctgctgcgtcagcagatgaaccgctctatgcgactgcgtcttcacaaatttactcgttgggcggcagcgaagacccgtacaggttggtgtgacatggcgagagagagaggggacgggttcttgaaggagcataaaaaatgaaaaaaagtgcgacgaaacgaatctaaaactagccccccccctcaacccccggaattttttttaaaatttcaaatttagtcaaaaaataggaaaatttttctggagcaacgatacggggaggaggcaggaaaggggggggngggggacgagctgctcccgatgnggggggggtgcttattttaatgagaaatcttcaaacagcaaaattatgtttaagttccattgtgagtattggtggtggttacggcagtggttcggccacctatgaccagcacggctattcacggatcatcaactccaacaaaaacggcaccaccggcctatcaaaagcgaccacagggtatgaaaataaatattttcctttcctgaaatttcgtttttccaaaaaaatttcacgggtcaagagaggcattggaatttttattttttggggtcaagaaatcggtgtcgcctttcagagtgccaccagcgacaacaatgttagcacgagcggctatgaacaaaaacaatgccaataattttgctgaattggaccaactctatgcaaaggttgtattgtatttcatctgaaatgagtggctttaattggattttcttaaattggaggtgtatccaacattttatgagtgaattttttttttgaaattttatagagaaaattagttgtttttttggttttaaaatttttgagcgagtcgttccccacgcaaaaatttacaaaaaaaataaaaaatttctagcaatgtttggaaaaaatattgaaaaacttaataattcagcaataaaatttttaaaaacgctagaaaaattgtttaattttttcttaaaattttctaacaataagattttttgggaaatttttaagtttgaaaaaaaattttaatttcgggggatgccattcccttaaaatttcggttataattttcaattttttttttgtagatcaaccggaagatatcggctgctgaccaacaacagcccacaacatcggcagccatcgcaaaacaactcctccgtcaacagtcattccaacatcagcaatcgacgacgaccaccgactttggtggtgagagtggttcgggcagtatttgcagcagtacgcagccgtcctatcgttatttgacggtccgcgaggatgccgcagtgattcgggaacgcattcgactcagggaggagcaggagcagcaacaacaaagcgaacaacagcaccagcaacgggcaaacttgtgggtgaagtgaattgttgctaggctaggggtgacttcttcataaaaattttttggcaaaccgtagggctccagccggctttggaggggatacaaaacctgggagtgttcctggtagcgccggaccctcctcatcctcttcgaccaatcaaaacacgagaattttttaaggcataaggggtaattaaa

SEQ ID NO: 62599 - DNA, 290 bp, Heterodera glycines
  misc_feature (4)..(4): n is a, c, g, or t
  Genomic contig location: Contig_ID=SeqID_32289; Location=1..290; Strand=+
  SCN-specific regions: Sequence locations=1-147,170-290
tttntttttctcataaatattatttttactttctaaatctttcctattaattgctgttgctaaccaaccgtttcatactcattcccgatggttgaataatatgcgtcatcacggtcctgttgttccaactgttgaccccttaaaaaatgcaccaaaataatttatatgttcgttgattgaggctttagcccgttaaatgattcggaacaaattttaattaccccttatgccttaaaaaattctcgtgttttgattggtcgaagaggatgaggagggtccggcgctaccag

SEQ ID NO: 62600 - DNA, 873 bp, Heterodera glycines
  Genomic contig location: Contig_ID=SeqID_32291; Location=1..873; Strand=-
  SCN-specific regions: Sequence locations=1-324,346-737,759-873
ggcaggacaagaaaagaatgaagttgatgcctcatgaaactcggaattggttatgttttgtcgaaaatatccttacataatactcataaaaaaatacaaataattcaacccatctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaaatacaaataattcaacccatctattctatgaccacattctgaaaaaaatcccagaaatacgaggaaagatatgcttggtcacaataaaataaaaaatggctagtatgtaaaaatttgcggtcacaaataaaaaaggatcgctaatatgtaaaaatcctgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaatggggcaggacaagaaaagatgaagttgatgcctcatgaaactcggaatt

SEQ ID NO: 62601 - DNA, 1792 bp, Heterodera glycines
  Genomic contig location: Contig_ID=SeqID_6713; Location=1488..3279; Strand=+
  SCN-specific regions: Sequence locations=1-1,23-47,109-258,287 -293,316-395,417-700,731-889,926-1284,1325-1445,1468-1600,1622 -1633,1697-1792
atgcagctgtgtgtgttgctggtactgcctgaccgtgccgatgccgtcctcctccgccgccgccatcaccaccagcttggcaccaccacaattgccgccgccaccacccaacatggcgtcaatggagtgatgatggtatgcggtggtcgcccatgttgtggttgtagtcgttgtgccgaatcctgctgacgccgttgtcggtgccgtgccgggcaatgtcagcccgagggcattccggcttttcggacttcgttcgccgtcctgttgctgttgctggtgttcctgaaccagctccagcctgttgttgttgtttttcgtggtgccaccctcgcagtccgtcgtcgtcatcgatggcactgccagcacggtcaatgtggggggcgctgccctgacgctcatttataattgttgcatataattggaaggcaataaaaatataattattgtatgctaatgatccttaattgatggtagacatgcaaaaatttatccttaactgatgttaaacatgtaaaacacaattgttgtctgctaatgatccttcttgatgttacacatgtaaattgattgcaatttggctaatgaccattaattagtgctggacatttatattttcgttacctaattgcttcggataattgttgttccaagtacgttcttgaaaacaaggacaagactttcaaggacaccaatttaaggcaattaaagaaatttttaaattaattaataagcagaaatttttcgtgccccgaatattaagatgaataatttatatgtacttaatattaacaataaatggtcagaagacgggcttttgaagtcatatccgctttttcatcggatatccaactaattaataggccaatattagcggacaaaggaagtcaattaaattggtgaattttggaaataaatatttattaatttgtctaataaattttgcggatttaatttcctgcgccattcttcttcgcttaatctgaccccgaaatatagtgcttatcatttttcacagtaaattacaccgttgggaaaaattaaaagaatttagtgtttttttcgcaaacgaaatgccaaagaacgaaatttaatgggcaaatttgaggaaggaaaaaatggcgcatgtagtattaagcgttcatgctgttaatggcccgataatgggcaggtagaaatgcagctttaaaaaatcacgacgaacattaatttccggcacggcacggaaaaatgggccccggaggggagggcataaggaatttaaattcggattttggcattatccctgaaaaggaaaagccccgggggaggcggaggaggatgatgatttgattaagctttgagagtaaaaggtacttatgtgagactaaacatggacttatgattaacagacagcgaaaggctattagggcggctccacattcaattccattaaacaattgaactaattgattggtcattatagaacaacatacaattacatctaatattataattaattgtttcagagatggaaaaaagtgggacagattttcggggaatgggccccgtttaatgatatggtaaatcaattagtgattttgccaaaatgccacaaattgtaaaagaaattttaatgattttgccaaaatgccacaaaattataaaattaaaaataattttgtttatatttttttaaaatttctaaaagaatttttatcctggtaaagttaccctcacaatcagctgttaattcctagctcgttcttttcgtacgtgcctggggggataatttggacagattaagaaactggta

SEQ ID NO: 62602 - DNA, 784 bp, Heterodera glycines
  misc_feature (711)..(711): n is a, c, g, or t
  misc_feature (735)..(735): n is a, c, g, or t
  misc_feature (766)..(766): n is a, c, g, or t
  Genomic contig location: Contig_ID=SeqID_32293; Location=59..842; Strand=-
  SCN-specific regions: Sequence locations=1-355,378-382,405-784
atgcacacgttttgcgctcgagctatttatcatcgggcttgtcaatccaaaacgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgngataaaaacattcgaaatcattanatagcttctgagataataagggttatcatanaatttcatttaaaataaa

SEQ ID NO: 62603 - DNA, 49 bp, Heterodera glycines; identical to SEQ ID NO: 60106
  Genomic contig location: Contig_ID=SeqID_32294; Location=1021..1069; Strand=+
  SCN-specific regions: Sequence locations=1-49

SEQ ID NO: 62604 - DNA, 505 bp, Heterodera glycines
  Genomic contig location: Contig_ID=SeqID_32294; Location=52..556; Strand=+
  SCN-specific regions: Sequence locations=1-126,148-390,419-505
caaaggttttttacaaccacttattgccaatctaatttcttgcagatttaaagccatccattgcctgccggttctcggcacagcaaagcactaatacggtgtttgactcacttcaaaaaataattcattacccaaaagttttttacaaccacatattgccaatctaatttcttgcagatttaaagccatccattgcctgccggttctcggcacagcaaagcactaatagggtgtttgactcacttcaaaaaataattccatacccaaaagttttttacaaccacatattgccaatctaatttcttgcagatttaaagctatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactc

SEQ ID NO: 62605 - DNA, 847 bp, Heterodera glycines
  Genomic contig location: Contig_ID=SeqID_32297; Location=283..1129; Strand=+
  SCN-specific regions: Sequence locations=1-847
atgacacggatgagccaattttccctagaaatgatcagaataagccgattgtgccggtggatgaaaatggtaaaattggcagaaaagggaattgttgaacagttactttcagatcaaccaatctttcctgtcgacaaaacgggaactttcatttttccggtggatgagtcaaactgtccgatccccgcgctcactgtctatggttgcatttggggagagggaggcttaagtaaccataattggtattcgatttaggcacgcgtgttgtaccgaaggatgagttcggtaacgcggtgattccgcgcgaccgcgacggcaaagcactaattcatattgcttcggacggcgtcacaccgctctccatgggcgaatggaagcagtggaagaagtactacaaggagcaggcccaagtgcgaaatttctaccaacaacggcagcagcagccggtggctgttgagccggcggcagccgcgggcattggcatcggcgcagtgaattattcggcaatgaactcggtcagtgtacaccgttggccaagaaagtgatggatgcgagcgaacctttcgcagtttggccaaatttcctatcaaattgaccgatggtccgcatataaatggagtttttagacaaaaatgcaacaaaacggttggacttcattataggaatcgtctaacaccttttccatgtgtaaagtagtccacttggctttcatcattgcccattttccgttcagatgtttcacccactgaatttggaacagcaaagtgcctatttcgccgctgacatggaaatgttgcagcgggttcgccgtgttcgacccgaagacgtcgacttaccgggtcaaatg

SEQ ID NO: 62606 - DNA, 604 bp, Heterodera glycines
  Genomic contig location: Contig_ID=SeqID_32301; Location=143..746; Strand=-
  SCN-specific regions: Sequence locations=1-6,28-535,558-604
atggttaggtttaaattatatggatataaataaccgattgtctttcaagtcaatcaataaccgaccaatttttgccatcgttcgatattcgactctacttttcaggcccatgttttgcatataaattataatggagggcggaggaagacgtctgacgagcgccacaggcggttgactgcgggggcccgaaggggaccggtaaatcagaagctgaagaatgatcagaagctgaagaatgatcagaagctgaagattgatcagaagctgaagaatgatcagaagctgaagattgatcagaagctgaagaatgatcagaagctgaagaatgatcagaagctgaagaatgatcagaagctgaagattgatcagaagctgaagaatgatcagaagctgaagattgatcagaagctgaagaatgatcagaagctgaagaatgatcagcccagcaactacggcgagccatctctggccggtgattttgatttcaaaaattaaaaaaaagttcaaaatgggacagagcaaaggcacgcgtcagccaatcatctcattggccaccctgagcggcgaaatccatagatttgctcataaaattatcctaaataaa

SEQ ID NO: 62607 - DNA, 1359 bp, Heterodera glycines
  Genomic contig location: Contig_ID=SeqID_6717; Location=1258..2616; Strand=+
  SCN-specific regions: Sequence locations=1-75,97-357,394-605,632 -670,706-955,977-1037,1059-1207,1230-1359
atgccgacggtcggcggcggtggtcgacggcaacgtgccggcttgcgcggcagacggcgggcgtcacgtgcaatcgccggccggatcagtcggtgaaggacgactcggcgtcggtggccagcagcagcgggtacggtttgcattcttgggattaaatcaaacatttatttagggagaaggggggggggggatttaaattatttgaatttaagtgctatagccaaaataaattgcatattttatgatcaacaacctttaaaatgtgtgtaacatgcttcattatctccaaaaaaaatttttacaaatcaaaggccaccctttggttttgtcgacccctaattagattttgtgtcgaaccttaatctataaaagagcagaaattttcaaaaaaagtcgatgactccatgaaaagtcttttttttcatttagaaatggaggagggttggctgagtctttaaaaatcgaaaactggggccaattttcagttatttgtggaaattatcggattagaatttatttttgcagtagaagaggtggccgtccaccgcgacaacagtcgtcgacttcggcgtcagcagcggggaggccaaaacggccatgggaaggcagcgaggacgaggaggacgagctgagcaaacgctacggattcgggcgcagttttctgttctccgaggaggaggaagacgaggaggaggaggaggaggacgaagggatgggaagtggtcagtttgttcaattattggggcgaatttttttttttttgaaatttgaaagtaaatattccctatacgaaaatcgttttttaaattgtttttgggatgaaaaatggactttgggaacattttagattttaactaacaaaatttgtttactaaaattgctcatttcatatttcccatacaaaaatcgcttttttgggatgtttttgtactgtaaaatttgaatgtgaatggacttttgggaaccctttaaaagattttaactaatttttttttatagaaaattgcccaaaatttttagagatattaaatgagataattaggtacaaatgtttgtttttgggtttttaattactttccattaccccacacagatcagaccgatttggacaccgatgatgacgaccgtggtagtgaagcgaaggcgcttccgtcttctgccgctgttgctccctcggcctcgtctccgtttggcccattttcttcgttggacgacgaggacgacgacatggaggaggaacttttggcccaactaccgcctgaccaaataccaccgctcgttctcagcgactccagcgtggacttgctcatctacaaggaacatttgatggacacgcttgaggtgatgggaagtctgtga

SEQ ID NO: 62608 - DNA, 1158 bp, Heterodera glycines
  Genomic contig location: Contig_ID=SeqID_32302; Location=1..1158; Strand=-
  SCN-specific regions: Sequence locations=1-192,216-358,380-1158
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttcggggactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaacccaacgcagaattaaagcacaggctatagggaagctattcccgaaggattcggtctccccataaatctgggcgcatcggttcggggggactgccccgaaaacaaaaataaatcgattttttcgagtgtgcgtttggggcactcaaacaaatatggagagcaaaaatccaacgcagaattaaagtacaggctatagtgaagctattccggaaggattcggtctccccataaatctgggcgcatcggctcagggggagtgccccgaaaacccaaaaaaaaatttttt

SEQ ID NO: 62609 - DNA, 456 bp, Heterodera glycines
  misc_feature (341)..(341): n is a, c, g, or t
  Genomic contig location: Contig_ID=SeqID_32306; Location=1284..1739; Strand=+
  SCN-specific regions: Sequence locations=1-456
atgtcggcgctcatttcagagcaagatactgctgtaccggagagtatcccagaccagatagccacgcttctggtcagttaccattaagtatgacggatcgaattttcactaacacagctaagactacatctgttggcatattataaaaggccattaagaaattgttaaaatgtaagactttgcctgcaccgaaggtactcgctcgggctcttcacggactcgtggcggcacctgtccgcccactgcgacgactgtcaaatggccgcgaaaaacccaacaaaggcacaaattcagccttggaaagcggcagacgaagtttttgagcgcatccatctcgactntgcgggcccatgcgaagacggccaaacgtatctcgttgtcgtcgacgcctattcaaactggccgggagtttgggagatgagtcgtgcaacagcgaaagaccgtcgctatgcttaa

SEQ ID NO: 62610 - DNA, 262 bp, Heterodera glycines; identical to SEQ ID NO: 60799
  Genomic contig location: Contig_ID=SeqID_32307; Location=483..744; Strand=+
  SCN-specific regions: Sequence locations=1-262

SEQ ID NO: 62611 - DNA, 197 bp, Heterodera glycines
  Genomic contig location: Contig_ID=SeqID_32308; Location=105..301; Strand=-
  SCN-specific regions: Sequence locations=1-197
tgccattgggacgacgtgccgttcattcagccggacagcgccacgtacatttgtgctgaaaatgacgcggtgcgagagcccggcattcgccaacagttggacacattgttgcgcgaaaagaaatatgagagccgaatgctgttggccaaaacgtatttgatggtgcagaacaggccgaccgccgccggctgtttaaa

SEQ ID NO: 62612 - DNA, 682 bp, Heterodera glycines
  Genomic contig location: Contig_ID=SeqID_32310; Location=930..1611; Strand=+
  SCN-specific regions: Sequence locations=1-12,49-363,385-682
atgaatcagtggatattattctttttaattgtattatttttaattattcaaattgaaattggagcggaaaagaaaaaattggaacaaaaaacatttgacgaaatatttggagaaaaatgggaagaaaaagaaaatgaacagaaaaagagagaaattgttcaaaaattcaacaaaattaaagagaaaattttacaaaaagagagaaaatattcaacaaaagaatggaataaaattgaattgaaaatcggaaaaaaattgggcacaaatcgccaatatatttaccaatggatcaaagaattaaatcttcagaaaataaaatcttacaaatcaaaaacggatgaacaaaaaattgaatttgtgcaaaaatttattaccatgaaaaatgaatataagcaaaatggaagaaaatattcgagaaaagaatggcaccaaaattatgccgaaatttgtaagaaaattggagtaagttatggaacaattgaaaaatggaagaaacaattcggaatccgtgaaagaatgacggagaaagaaaaaatggaaaaagtgaaaatttattttcatataaaaagagaaaatccaaaaataagtgatgaaaaaattgcaaaaatagtgaaaattaatcgacggaccattgacaaatggaagaaacgctttggggaagaataaatgaggattggataca

SEQ ID NO: 62613 - DNA, 746 bp, Heterodera glycines
  Genomic contig location: Contig_ID=SeqID_6718; Location=1228..1973; Strand=+
  SCN-specific regions: Sequence locations=1-239,261-337,504-746
atgcttttggccgagttggaggacggcggccaatcggacggagcagtgccagcaacacaacaacaccagcaccagcaacaacagtcccaacacattgtggccatgctggagcgagcgctgcgcgagagagacgaatttgccaacggcatgatggaaatggcacaagaaatggtaggccgaaagtatacggtagtcaagtgaattttgtacggtaccgtatcgttaattattcgaatagcttattaaatgacagtaattttctttgcttgaaattaaatgattaagctatatatattaccaaatttcaaattgttaattaaggatctcttaatagttgttaaaatttattttaaaaaatttttaaaaagttaatccattaatattattttgccaattatttcatttttttaagaatttattgaatttaattccgattttaagaaatttgaataaataaataaattttgaaaattttttgaaaattcatttaataatttaattttcaacaatttgctatgactcacaattttttgaaaaaataaacgaaatatttcattttttgtaatttattcttttttaaatttatgaatttcaaggacaatgatgaaaatggtggcggtggttcgtcagcagctttaacaacgtgttcatcttcatgtaatggggacattgggcctgctgcgggcggcaaatctgtcaagcaacacaatgccattgcgtcaacatttggtccataatttgtgaaa

SEQ ID NO: 62614 - DNA, 354 bp, Heterodera glycines
  Genomic contig location: Contig_ID=SeqID_6718; Location=2008..2361; Strand=-
  SCN-specific regions: Sequence locations=1-354
atgaccctagggttgatcgaacatcgagaaatgaccctagagttgatcgaacatcgagaaatgaccctagagttgatcgaacatcgagaaatgaccctagagttgatcgaacatcgagaaatgaccctagagttgatcgtacatcgagaaatgaccctagagttgatcgaacatcgagaaatgaccctagagtttgatcgaacatcgagaaatgaccctagagttgatcgaacatcgagaattgaccctagacttgatcgagccgagaattgagttttatgaggctcgagaatgagaattgagacccccggggatatcgggcaaatccggctacatatttcaggagcaaataaa

SEQ ID NO: 62615 - DNA, 408 bp, Heterodera glycines
  Genomic contig location: Contig_ID=SeqID_6718; Location=2376..2783; Strand=-
  SCN-specific regions: Sequence locations=1-408
atgaccctagagttgatcgaacatcgagaaatgaccctagagttgatcgaacatcgagaaatgaccctagagttgatcgaacatcgagaaatgaccctagagttgatcgaacatcgagaaatgaccctagagtttgatcgaacatcgagaaatgaccctagagttgatcgaacatcgagaaatgaccctagagttgatcgaacatcgagaaatgaccctagagttgatcgaacatcgagaaatgaccctagagttgatcgaacatcgagaaatgaccctagagttgatcgaacatcgagaaatgaccctagagttgatcgaacatcgagaaatgaccctagagttgatcgaacatcgagaaatgaccctagagttgatcgaacatcgagaaatgaccctagagtttga

SEQ ID NO: 62616 - DNA, 934 bp, Heterodera glycines
  Genomic contig location: Contig_ID=SeqID_6719; Location=737..1670; Strand=+
  SCN-specific regions: Sequence locations=1-42,64-251,294-510,534 -616,656-763,832-934
atgcttgtggacctgcaggacgagttggagcgccaacgcgtggagatcggcaggcttcaagctgaacggttggagctggtcaaggacgcgcgtgcagcgaaggatttacgtgacgaaatggaatgcatgcagcataaactgaccaggctggaacggttggagaccgaagcggagaaaatgcgcacaaaattgggcgagttggacttctacaagagccgaatgaacgtaaaacaaattaattattttgacacttaattttataaatttattaaaattataaattaaattattatcccaaaatatcacgcttttcagaggagttcttaattatgagagtttcagaaaagccatgaaatttaatgaccctaagacttagggattataaatttgtgagaatttagcgccaatttttataattttttgttgagaaaaaaaggaaattttagaggaaaaaattcatatgattttcttcagattttcattcgagttaactcgtggaacaccaatcttagaagaaaataataatttgatttgaatcaaaatgcctcaaaaatatttccaatattcatttttggtattttaaaatttattcatgaaatttctaattaattagctcataaataaaaaataattattatattaaaatattttatttcttatagagtttgaaagaggacaatcggctggtgcaggagacgtgccgcgtgatggaggaacagcttgaacaatgccaacgcaaactgaccgcccatttggaggtggcaaattttaatatttttaaaaattgaaaatcaattaaattttgttttaaaataattaaaattaatatttgttaggtggagacgaagctgatcgagtcacaggccaacaacaaatcgctacaacttgatctcactaaggtcaattaatttctgtcatttggcaattttattta

SEQ ID NO: 62617 - DNA, 753 bp, Heterodera glycines
  Genomic contig location: Contig_ID=SeqID_32312; Location=249..1001; Strand=-
  SCN-specific regions: Sequence locations=1-32,55-196,222-491,528 -718,740-753
  Gene Ontology: Mol. function=protein tyrosine kinase activity; Biological process=protein amino acid phosphorylation
tttagcaattttttggttgcgttttaatttgcgaaatttaattttacatttattccctaaagtgtgaagggcgttcgtacaacgccaagtcggacatgtgggcgatgggctgctgtctgtacgaaatgtgcaccttgcggaaaccgtttgacgcggacaatttgacaattttgatccacaaaattataaatgttgcattaaaaaaaataaaattattttatcttccatttttggcaccgttttcagtgcgaatacgaacccctgaagggcccttattcgcaggacattcggctgattgtgcgcgagttgttccgcgccgacccggaacagaggccaagtgcgtctgacctgcttgaacaggtggacaaacaaacgaaaatcaggccgaaataattaatggcgataattgttgacgatgaatgacacaaagtcgtccattattttctggctcaaattttttatgttcataaattttcgagaatttaaattcgaataaattaattttacaattaaatcttaaaatatatcccctcacatttccccggaagatccgtcgtaagaatccgttgctgaacagcacacgccgaatgaaatgtttggcagcaaaggcggcgcggagcaaacggagcagcagccaaagcagttgctattcggcactgtacagattcgacacggaaaaattcacacttttggccatgtccgagttgccggaccgcgcccaaataaaacaggtggccaaaccaatgaatgaaa

SEQ ID NO: 62618 - DNA, 1214 bp, Heterodera glycines
  Genomic contig location: Contig_ID=SeqID_32313; Location=47..1260; Strand=-
  SCN-specific regions: Sequence locations=1-49,71-173,195-900,922-1214
atgaacgccgaacaaattcaacaacttttgaccgctttgctccaaggaaatgccgcttcaagcataagccaagcgaatttggccagctcaatcgacagtagaatttcaaagtttgtttatgaccccgagaatggtcaaacatttgaacagtggcacaaacgcttcggcatattgattgaagaggatggcaaagacttaaccgagcaagccaaagtccgactattgttgggaaaactcggagacgaagattacacgaagtacagggacacaatcagcccggagttacccgacaaagcttcgtgggctgaatcaatcaacagattaaaggagttgttcgctgaaacgcgctctcttttcgtccgccgatatgaatgctttcgaatcagacggcatccaaaccaagtcatcagttctttggttgctcaaatcaacgcagcgtgtgagcatgccaatttgagccttaccaaggaacagctcaaatgcatgattttggtgatttcactgagggatgaatatcacgatttgaggcagaaatgtcttaaaatgatggaagaagccgagaaaagtggcaccacagtcacactcaaaaagttggaagaggagttaaaagcgatccaaattgtcaaagatagtgctttgtcactcctttccacgccagcttcgacaaatgccatccgaactcgccctcaacagtggagagaatcaaaatccaaggccaattcagcaaatgccgtgcaacaaaaccacccggcacagcaaaaaccggccacaggaggaaaagcaattcgtggacaaccgacccagccgtgcggctcatgtggtggtactgatcactggagatcagattgtcgcttccgagaagcgacatgccacaagtgccaaaaacaaggccacattgctaatgtttgccgaaagggagcattcacgacaaagaaccaacgccgttcatttcacacggtccaagtcaaagcaacatgcctacaaattggcacgactcaaggacggtggtggacaattttggtcgaaattaacggcacaaaaattgaaatgaatgtcgacacaggagctcaggcgacagtccttaccattgaaacatggaccaaattaggacaacctaaattgttgccaaccgacattgagactcgcaactgcaacgacgtcacatttaaaacaaagggcaaatttatatgtcttgtcagcattgtgggaccttg

SEQ ID NO: 62619 - DNA, 1137 bp, Heterodera glycines
  Genomic contig location: Contig_ID=SeqID_32314; Location=54..1190; Strand=+
  SCN-specific regions: Sequence locations=1-192,216-358,380-824,846 -977,1004-1086,1129-1137
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 62620 - DNA, 210 bp, Heterodera glycines
  Genomic contig location: Contig_ID=SeqID_32316; Location=1..210; Strand=+
  SCN-specific regions: Sequence locations=1-78,100-101,123-139,161-210
agtccctcgtcttttttcacgcttttctttggttgtggcactcacggattatctcaaattattatctctttgaattcgttgcttttccattttctcttgatcattttgaaaattttgatattgttcaccttctcttgctacaaattttccaataaattttcccatttcataatttataagcaaaaaaaaaaaaaaaatctttgaaataaa

SEQ ID NO: 62621 - DNA, 383 bp, Heterodera glycines
  Genomic contig location: Contig_ID=SeqID_32317; Location=298..680; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 62622 - DNA, 1166 bp, Heterodera glycines
  misc_feature (3)..(3): n is a, c, g, or t
  misc_feature (55)..(55): n is a, c, g, or t
  misc_feature (74)..(74): n is a, c, g, or t
  misc_feature (124)..(124): n is a, c, g, or t
  Genomic contig location: Contig_ID=SeqID_32318; Location=129..1294; Strand=-
  SCN-specific regions: Sequence locations=1-81,163-251,277-492,517 -556,597-1043,1066-1110,1132-1166
atntttttcgccgtttcaatttcgttgaagaaggaatacaaatgcaaaaaacggnaagaacgtgcgaattgganaaagggcaaaaaaaacaaaaaacattataaactaattaaattaaatcatntaaatttttattcaaaaaatatcattttttaattattaggttggggaataagttttgtcatagtagtcgacaaatttaacatgttttttaaatcgaccccatagggttcttgagataaggggctttttcagaatttatttttagtttttcttgaaaaattgcaaatttgggtgtaggtaacgcctatgactgaacataataattgcatggattttttgaaatggtgccatattgaataagttataccaccatcgaaactctttttggaccttgttgaatcaacaatttatgatgaatcagagaaattttttttaacaaaattaatgttccatgagataaccaacatctagtccttacaatatacaaactattattattttatttatttttttgttgaatcccgcgattaaaattctttcaaaattttcgaagaatttcatttttgaaagttgtgtttaaaaaataaaattcatgaagtcaatttaaaatctgaaatatggcttattaaataagcccaaagttttctctttcgaatagtatatccaaatgaacaattatttgtttgaccgatttaaaaaaaatctgtaaacaagttcaagtctaagctatgacagaaattattccttattttgatatcattaacacttatcttttcgtatgattttgtagattctgcttcgtgtaagcggtgccgactgaacaaatgcttatcggtcggaatgaactcgttaagagttagcattaaatcaaaacgagtgagtgggcaatcggcaccagcaaaatcatcaaatctgggagaaattggcacagatttgtcagcaataaccaccttgaacaatgcaccaccaaaatgggccgttccgaactcggttggttgtccgagacagggaatgtttcttggttcggagggtgctagaagaacctattgtaaaaatgattaatggagaacctgaagaagtatcaatgacccataagatttttaattcattagtattttagttatttataaaattgcgcaaaaatgtacaaagtctgtaataaa

SEQ ID NO: 62623 - DNA, 788 bp, Heterodera glycines
  Genomic contig location: Contig_ID=SeqID_32319; Location=297..1084; Strand=-
  SCN-specific regions: Sequence locations=1-333,386-416,454-543,574 -667,689-765,787-788
  Gene Ontology: Mol. function=small conductance calcium-activated potassium channel activity; Cellular component=integral to membrane; Biological process=potassium ion transport
atgtttttcaacccatcttcacagtttcggatgcatgtgaactcaatcaagcgttggcactgtgcggtccacttgcgccaacgggtgctgatactgctcgaacttgtgctgtgtgccgttgtgccattgccgcttttgcgtttgccatgcggtggtgacgcgttcgcgtgcgcactgatgttcctccggctatactggttaccacgcgtgttgcatttgcgctcacgcctcagcacggacgcggcagcaaaatccatcgcgggactgaattgtgtgaagacggacacgcgcttcctgttgaagcgtatgcttttcctccacccaggtgggttctaaattttttttgtgaatttttattttaaataattttcatttttttttttttgctctatgcgagggggcagaatactgattgctaataaattaattttaaaaaaattgtaatttaattttggtatattttctcttttattactctacgagagtgatccgagattaaattagaattagtcacctgtcaatctatatgcttcttaatttctataaagttttattttcatttttaaaactaactttcgaaatggttcaattcttaataaacttatataaaatacaaatcattattatttaggcccaactctttctgcatttgtggtcagtacatttatttaaaatttaagaaatttttggaaaaattgaattttagttctgtttttggcttattggtgcctatattcttcgcttatgtgaaaggtgcattcattgtgcttaaaaaacttttaaataaa

SEQ ID NO: 62624 - DNA, 63 bp, Heterodera glycines
  Genomic contig location: Contig_ID=SeqID_32321; Location=957..1019; Strand=+
  SCN-specific regions: Sequence locations=1-9,31-63
aaattgggcttcgccttcggcttcggcttcgagtgctaagccgagcttcgcccagccctgatc

SEQ ID NO: 62625 - DNA, 355 bp, Heterodera glycines
  Genomic contig location: Contig_ID=SeqID_841; Location=539..893; Strand=+
  SCN-specific regions: Sequence locations=1-9,31-57,250-355
atgacggatggaaaggaaggatgggagggaggggggggacatcatgcaagcacgacaggaaggaagacaaaggaagaattggaaatgagaaacgaacggatggggaagaatggaaacggaaggaaagatggtgaaaaagagaaaaggaagagaaaaaggaagagagaggaaaaagaggagcaagaggaagagaaactgggaagaacaatgaaaaaggaagaattaagagaaaggaataaggagggaaggtctgatgcctttgatcaatttttggggaaacattcttcctgatgatgcccctcttcattcattgagaaaaggttttttgaattggctaagatttcagattagccaa

SEQ ID NO: 62626 - DNA, 105 bp, Heterodera glycines
  Genomic contig location: Contig_ID=SeqID_844; Location=1856..1960; Strand=+
  SCN-specific regions: Sequence locations=1-105
atggccgagagttggtcactctgtcgagaatgttggctgtccttgccgtgctggtggtcatgcttgttttgtgtgcttgctcttccgaactcatcaatcggtgaa

SEQ ID NO: 62627 - DNA, 798 bp, Heterodera glycines
  Genomic contig location: Contig_ID=SeqID_848; Location=646..1443; Strand=+
  SCN-specific regions: Sequence locations=1-134,156-419,441-736,758-798
atggagccgaaaagcgatgtctgtgcggacagcgacaattcgttggtctcgggaatgggcacgcctcagacggaagtgatccgagtgggcggactcgcgaacgaaggccgaacggaggcgcaactgaacggcgccggagggggcggcggcgcaggttcgaacagagaggagagagtccgttttgttggccaccctagccatggccacaagcatttacaaagggttgaaaatgcacaaaatcattcaagcttagcctccatgtctgtaatccccgatggggtgtgatattctgctgaataattgccatttccaaaatgtttgtccgaattcgtcctcccattttcagatcgattggccgccggttccctggacgcccaaccgtcgccggtcgtaatggtcaaccatattctcgtctggagttccatctgcagtcagtcgccccctcagaagaccttcatcatgtgcaatttcctcgactctgatcaccaccacttcggcctcaaacccggcacttccgcttcgctcacttttgtgctccaaaaactgtccgcgaagaccgagccgtccggctgtatttccaccccttactccgttaacgttgtgctggacgaactgtccgcgttgggctaccgagcgattggaatggtcaacaaaagggcggacgaagtgctgtggacacttgcaaaatgagcggagggggggggggcaacaaaagtcatttcgagagagatttgcaacaactctaaataattatattatcaatcgcttgtcgggggaccggcttaattttgcaaatta

SEQ ID NO: 62628 - DNA, 555 bp, Heterodera glycines
  Genomic contig location: Contig_ID=SeqID_848; Location=1734..2288; Strand=-
  SCN-specific regions: Sequence locations=22-240,262-555
  Gene Ontology: Mol. function=electron transporter activity; Cellular component=mitochondrion; Biological process=glycine catabolism
aaaaaggaaacggtaaaaatcaaatccaatttcagctttcactcgccaacaatgcactggtgagaagcattttgtaattttaatgccattagtgtgacaagggcctcattaggcaaccgatcggtgtctttgcctttgattgatgctttaggccgttgcacgattgtctgatgctcgaaccgacagaaagtgaagacaaagcggagatggacagatactgtgaagcactgatagccataagagaggaaattgaggacattgccaggggcgaattgcacatcgatctgttcaaagtaagcggcgatcactcgcggcactgtcggcggagtgccctcaaaacaaagtgaatcgatgccaatcccaaagaatgcgccgcacactctgtccgtgttggccgcctccgtttgggaccgcccctattcgcgtgagcaggcgggatggccaaaaccatggtgccacacgtcacgaaaagtttggccaactgtcggccgaatcgacgactcatttggcgaccgaaacccattctgttcatgtcccccggtcaaaggggacgaa

SEQ ID NO: 62629 - DNA, 1108 bp, Heterodera glycines
  Genomic contig location: Contig_ID=SeqID_849; Location=579..1686; Strand=-
  SCN-specific regions: Sequence locations=1-621,649-929,951-984,1006 -1017,1039-1108
  Gene Ontology: Mol. function=electron transporter activity; Cellular component=mitochondrion; Biological process=glycine catabolism
atgagtactcgttgtgaaccaatcggagcagaattaagaccaattgacaatgtgtcaactttggcagttggcgatttgtctgccgaggccgccgcaataatcatacagtacccaaacacggaggggaaactgtacgaccatttggagcgactgattcgcgcagcccatcggcacaatgtcacaaagcttattctctcactttcctctctttctctggtcttttgtctctcagttctttattatcttttgtctctgtttcccttttttctctgatttttttcactctatttttcctatttttcagattctcgtcattctcgtctgtgatcttttgtcccttacgcttatccggtcgccgggtgacctcggcgccgacattgccgtcggcacttctcagcgcttcggacttccgttgggctacggcggaccccacgcggggtttatttgcgtcaaggatttggcattggcacggcaaatgccgggacgaattgtcggagtgtcgaggtgatttgatgaaaatggtgcaacagttcattcgcatttaggcaattaattcattcattatcattagtgaggattggcaggcaattagggcaaaagtgaattgcactgatcgtccgctgttcgttcattttccaagtaaatcctttcaagggatcagcagggaaagcccgcttaccgggtgagccttcagacgcgggaacagcacattcggcgcgaccgggcgacttctaacatttgcactgcgcaagtgcttccggcaaacatcgctgccatgtgccgttgttttgcctttcaccattttctgatcacttcgccattttctgatgttttaggtacgccgtttaccacggtccccgtcggctcgtccaaatcgcaaaaatcgtccataaatcggccgcttatttggcacaaagtgagcaatcattttgaaaagaaaattacatttccaatggtttcagaattaaaagcgaatggaatcgaagttgagcacaaagaatttttcgacacaatcaaagcaaagccaaaggaaatggacgactttcgtaagcgttgtgaggagcaacagatcaatgtgatccactcatgctcctctgatttaaactga

SEQ ID NO: 62630 - DNA, 340 bp, Heterodera glycines
  Genomic contig location: Contig_ID=SeqID_6721; Location=290..629; Strand=-
  SCN-specific regions: Sequence locations=32-340
atgggatcaccaacaaaattttctgcctcactcacacggacagcaaggagaaaatggtcatcatgccgcgttgcattgtcccggctatttgccgttaattggcagcgacgaccaaagctggtaatttgcttcgtaataagcgaattttggtcacccgttttgcatttgcttcgccaacctttaggggatggaatttggtgaacaatacaattgcgcacaacggcgaattcgtggaacgatacccgcgtctgaacaagaggaggaacgacgggagcaagcagcggaagacagaacgaacgaagaaagtgatcaagacgccgacatcgatgtcgttgactga

SEQ ID NO: 62631 - DNA, 170 bp, Heterodera glycines
  Genomic contig location: Contig_ID=SeqID_6721; Location=39..208; Strand=+
  SCN-specific regions: Sequence locations=1-170
attaactaaacacggcgtccggaaactgagctgctgtaccaaaaaagatttgtatgtgtggcgaagtggtttgtgagaaggtcaccaaagggggggtcccaggttcgatacccagtgcatgctattgatgtatttcgatgattttaatgaataaataaaaggaaaagtga

SEQ ID NO: 62632 - DNA, 1046 bp, Heterodera glycines
  Genomic contig location: Contig_ID=SeqID_6722; Location=690..1735; Strand=-
  SCN-specific regions: Sequence locations=1-297,408-499,521-531,578 -627,867-924,947-1046
atgaaaaatgtggaaaacaatggaagtgagtgaccttgacaaaacgcatgtgggagaacattcgacgcactttgtcagcatttgcggcctcgcgaagaaagtccaattcttgcggaaggtttaattttgtctcgcggaccaaccatttcaatttgagttcgggaaaaacaaaggaagcgacattgacgaaaaactacgataaaaaaaataacagtaaaaatgtcgaaaaatttagaaaaagccctctaacaagcgatttattctattcgcattgtcaaaaatttgtttgaactgaacctccatcgtggccatgtcaacaaaactgcggtctttcacatgcaaatgttgtattttgactgccacgtattcgtcgcttgacttcagcttggccctgtgcacttgcgcgagagaagcctaaacgaattcgaagaccactcagagatacggaaaacaaaaatgccattataatgcaaaattaatctttgttaattgtatagaaatgaacaattaggaatatgaaagtaaaacgcacagcgccacatggacgggggtcgaactcgtcgaaaacatcgtcaaactgtaaaattgtagtgagtgagtgaaacacggcaaaaaaaatgaatttacatttttgtgcaaactcctgtagaagaccgtcttcatgtcgtccaaactgctctccggcgctttcgagtggagaatggaaagtgtggaagtgtacggctccggcaaaaggtattgcagcgaggcgatgtgttgaccaactttgatgaacactccgccattccttcgtgccaaactgagcagtcggtctgccccccgttgatggcattgccaaatccgttctttgtactccgcggattcgctgtccacacctaacaaagacaatttgtaatcgacaattgttgctgaagcctgcaaaaggaaagaataaatgaaaataaacgattaacaaaaaataaaaaaaattacagtgagtccaacacgtgcaaatcgaacaatgccaatgtgtgaaagtgaataatcgttttgatgcaaataataaa

SEQ ID NO: 62633 - DNA, 1610 bp, Heterodera glycines
  Genomic contig location: Contig_ID=SeqID_6722; Location=821..2430; Strand=+
  SCN-specific regions: Sequence locations=1-49,289-338,385-395,417 -508,619-1610
  Gene Ontology: Cellular component=mitochondrion; Biological process =electron transport
gcttcagcaacaattgtcgattacaaattgtctttgttaggtgtggacagcgaatccgcggagtacaaagaacggatttggcaatgccatcaacggggggcagaccgactgctcagtttggcacgaaggaatggcggagtgttcatcaaagttggtcaacacatcgcctcgctgcaataccttttgccggagccgtacacttccacactttccattctccactcgaaagcgccggagagcagtttggacgacatgaagacggtcttctacaggagtttgcacaaaaatgtaaattcattttttttgccgtgtttcactcactcactacaattttacagtttgacgatgttttcgacgagttcgacccccgtccatgtggcgctgtgcgttttactttcatattcctaattgttcatttctatacaattaacaaagattaattttgcattataatggcatttttgttttccgtatctctgagtggtcttcgaattcgtttaggcttctctcgcgcaagtgcacagggccaagctgaagtcaagcgacgaatacgtggcagtcaaaatacaacatttgcatgtgaaagaccgcagttttgttgacatggccacgatggaggttcagttcaaacaaatttttgacaatgcgaatagaataaatcgcttgttagagggctttttctaaatttttcgacatttttactgttattttttttatcgtagtttttcgtcaatgtcgcttcctttgtttttcccgaactcaaattgaaatggttggtccgcgagacaaaattaaaccttccgcaagaattggactttcttcgcgaggccgcaaatgctgacaaagtgcgtcgaatgttctcccacatgcgttttgtcaaggtcactcacttccattgttttccacatttttcattttttagatccccaaaattcattacaattactcttctgacaaagtcttaaccatggaattctgcgaaggtggtcaaatcaacgacttggactatttccaagtccatcagcttgacaggcacaaagtgagtgaacggtggcgcttctcctgactaaccatccccgtttttgcactcaccaaattacccaacccgaaatatctattttaccgatgattttacgaaattgttttttggactctcaacggaattggcccatctctgagctcatgttctcccactcctccctctttttcagatttgtcgtctcttgggcgctttgtacagcgaaatgattttccgccgcggctacgtccacagcgacccgcaccccggcaatgttttggtcagacgaagtgccaacaccgggcgggaggaaattgtgctgttggaccacggcctttactgtgtaaaaagtccgtttggaaatgccaatgtcaaaacgagcgccaattgtcagactcttcccgacgaattgcgcattgattacgcgaaactgtggctggcgctgatgaagccggaccaggacgaaattcggagggtttgcgaacggatgaacatcggacagaactacggactgttcgcctgcattgtcacaatgcgctcttggaagtcagtcactgcgggcattgcgcggacagaaattgacgacagagag

SEQ ID NO: 62634 - DNA, 927 bp, Heterodera glycines
  Genomic contig location: Contig_ID=SeqID_6723; Location=453..1379; Strand=-
  SCN-specific regions: Sequence locations=1-350,373-678,701-927
gctccctccgctcaactgccggccaaagcaccgcagcagccccaagcgccaaaagcagcggttgccccggcacagcaacaacaacagcccaaagcggctgcccctccaccgccaaaggccgccgcggccccgcaacagcccaaagcgactgccgtcgctgcgccgccgaagcccaccgcccctcccgcggtggcgcctcaaaagcgcgcgcctccgcccgttgtgcgcgaagtgcaactgcccgaagcgccgacccaacccatcttacgacacgcagaatacacgccgaaattggtggacgcatctgtcaacaaactgccgccagggcaagagccggatgaggaacaattggaggcgagcgcagtgccccgaaatccgatcattgtaagttagacggacgaaaacaaacgaagcggagggggggggggagacggaatatgctaaggggggggatctcggcgggagtcccaatcatttgcggatagcagcgatctttccgcgcaaaccgaccaaagggggaatgaataaaatgaaggggggggggataaagcccttttcaattccctataaaatcggatcggttgaaagtctgtcaaaatttaggaggacaatgcgtggcaagtgcagcggcgtgtgcagcccgaatatcagccggtgagtgaacgaattggcgagggaagaagaagacgagcgaaggaaatgctcattggcttatcggagaccatttggcctttgtttttgcaggtccaacccgccaaattaaatgcgactggcgactttttggtggagagtgaggcaaaggtcgagaccaattaaacttatcatttatcggttaattaattaatttggtgtcagaaatcgattgtgcccgaggcggtgggctattcgaagacaaaatggaacgaattcccagaagaggaagagaaa

SEQ ID NO: 62635 - DNA, 254 bp, Heterodera glycines
  Genomic contig location: Contig_ID=SeqID_32322; Location=868..1121; Strand=-
  SCN-specific regions: Sequence locations=1-254
aaaaataaatcttgccacaaaaaaagacataaacagaaaaatattcaaaatttttaatttacttttgtatgcaatttcaattgaattgtcgagaagagcacggaaaatgtctttgacaacgttcgggtggggatagcccacacatttgtaaatgttttcctcgtctatttcagccgatgttgacaaagccgtgctctgtgatcaattcgcatttgatgatgccatttcatacatttgctaaaaacctgaagaat

SEQ ID NO: 62636 - DNA, 298 bp, Heterodera glycines
  Genomic contig location: Contig_ID=SeqID_32323; Location=429..726; Strand=-
  SCN-specific regions: Sequence locations=1-298
atggttctctcaaaaattccaattcgtcgctccttgcatacttcggccccgttatgtaagtggtgttcccattctcatttcgcactttaccttttaatacaattttaggccgtggagccgtttctcaacccggatggtacccgaggtgagtgcaccccatgtctttgagttgcccctccgttgccttccatttgcatttgaattcagagatcatatgcctgggccttacccgcgtaacgaagaagaacgaagggcggctgccataaaatacggactacgacccgaggattacaagtga

SEQ ID NO: 62637 - DNA, 131 bp, Heterodera glycines
  misc_feature (30)..(30): n is a, c, g, or t
  Genomic contig location: Contig_ID=SeqID_32323; Location=836..966; Strand=-
  SCN-specific regions: Sequence locations=1-81,103-107,129-131
gctgaaaaaatcgtcaggcattgaaaaggngaagaagtaaaaaaagattagcagacgatggaccaaagcagacgattgacgccttatttttctctgttttattctccctttgataaacaatgattagctaa

SEQ ID NO: 62638 - DNA, 297 bp, Heterodera glycines
  misc_feature (281)..(281): n is a, c, g, or t
  Genomic contig location: Contig_ID=SeqID_32326; Location=34..330; Strand=-
  SCN-specific regions: Sequence locations=1-297
atgacattctatgcttctcttgttggatacacgggaagaaataatagttagtccttttgttgaatttttagaaattctatccgtccaatcggcttttggaattttaatgagtaaatcaggaaccgtaaatgaaattctatgcttctcttgttggatacacgggaagaaataattgttagtccttttgttgaatttttagaaattctatccgtccaatctggaattttaatgagtaaatcagtaaccgaagatgccattctatgcttctcttgttggatacncggccaagtagaatag

SEQ ID NO: 62639 - DNA, 300 bp, Heterodera glycines
  Genomic contig location: Contig_ID=SeqID_32326; Location=415..714; Strand=-
  SCN-specific regions: Sequence locations=1-300
atgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataattgttagtccttttgttgaatttttagaaattctatccgtcatatcggcttttggaattttaatgagtaaatcaggaaccgtaaatgaaattctctgcttctcttgttggatacacgggaagaaataa

SEQ ID NO: 62640 - DNA, 614 bp, Heterodera glycines
  Genomic contig location: Contig_ID=SeqID_32327; Location=20..633; Strand=+
  SCN-specific regions: Sequence locations=1-614
atgttcatgtgccacaactcccttcaaacggacagccgcaaaacccatggaatgttcatgtgccgcaattcccttcaaacggaccaccgcaaagcccaaggaatgttcatgtgccacaactcccttcaaacggaccaccgcaaagcccaaggaatgttcatgtgccacaactcccttcaaacggaccaccgcaaaacccatggaatgttcatgtgccgcaattcccttcaaacggaccaccgcaaagcccatggaatgttcatgtgccgcaattcccttcaaacggaccaccgcaaagcccaaggaatgttcatgtgccgcaattcccttcaaacggaccaccgcaaagcccatggaatgttcatgtgccgcaattcccttcaaacggaccaccgcaaagcccatggaatgttcatgtgccacaactcccttcaaacggaccaccgcaaagcccatggaatgttcatgtgccgcaattcccttcaaacggaccaccgcaaagcccaaggaatgatcatgtgccacaactcccttcaaacggaccaccccaaagcccatggaatgttcatgtgcccccactcccttcaaacgaccaaccgcaaaaccatggaatg

SEQ ID NO: 62641 - DNA, 153 bp, Heterodera glycines
  Genomic contig location: Contig_ID=SeqID_32328; Location=1179..1331; Strand=+
  SCN-specific regions: Sequence locations=1-153
atgagtcgaaatcgtctcccaccagaacttttactagaaattgtcctctgcgttcgcaggggacacaacacgcctaacatttgtttctcttctcgcattttacgaactttcatggagcctcgagttgcactgtggcggagagtttggatttct

SEQ ID NO: 62642 - DNA, 1160 bp, Heterodera glycines
  Genomic contig location: Contig_ID=SeqID_32329; Location=676..1835; Strand=-
  SCN-specific regions: Sequence locations=1-556,578-997,1026-1080,1102- 1133
atgcaaactgctttgttaccagtcggtaaacgaagccaattcacgtcaatcaaatgcgtcaattgcaagcaggagttggatgccatggatggttatgcactggtagattgcagtcataaatggcattttgagaagccctttgctgattggtccgtttgcacaatgatttttttgcattttttttttgtaggtatgcagaatcatctataaaaaaatgcatgaatgatgcttgcaagaagaaatttacaaaagttcggtgtcgagaatgcaaagaaaacttgggggccggtgttttcgagacaggatgttactgttctgtcacgtcggcatcacatttacacgctgatgaattggaaataaagtagaattatgtaatttttttgcatatttgtcaatattttgaggctacgacaaaacactggtaaatgtctcgaatgcaagagtcagcatcccggtttttgcatgctttgtcagcagctgttcaaattgcagccaactggaatccgccaaagcaaagtttttttgcgctgctgttcggcatttttccactatgaatgctggtaaacctggctgattggtgttccttttaaatcctttttaaaggtattcggaacaaccaagagtaagttgcccatgtcagtgcaaaaaattatggcaaggaatcatggatttgcattatcagtaaggcttatattatataaaaatatagtactatatgttatagtgaggtttgtggggtgaagaacgctgctccgctgcgaaacattggcaagaagaggggcgttattggcggccgacctcagaaagccgacatgtcagcatctgctgtttctgattcaaagaattctgccaaagtttcaaaaagaatcgtttccggttcggttgatcaggcattgatggactcacaactcataccacgtctttccttggttccttgccgcagttcaagaattagctatgcagggatcaagcgtctaagcggccagtacagaatgtgtccttcaagaggagggggagggggtggcgcatgtaccgaattttgctcgtcgacaaagagagttatatttttgagaaaaccagttttaaaaaaaaattttttttgaggcaatacttttgcacctgactgtagttgctattattttgattttctttttaataaa

SEQ ID NO: 62643 - DNA, 381 bp, Heterodera glycines
  Genomic contig location: Contig_ID=SeqID_32330; Location=62..442; Strand=-
  SCN-specific regions: Sequence locations=1-115,137-381
  Gene Ontology: Cellular component=alpha-ketoglutarate dehydrogenase complex (sensu Eukarya)
ggaggatatctttcctcaaagattctcaattttctgctgttaaggtattaccaacccgacgaaattgccaaagttggccttccattgggtgacattgaaattgccgaactttcttcagaagaagaaaaggaagcaccaacaaatggtgatttctttgtcagcattctctattatgccttcttaatcatttaatttccattttcagttttgccaactgtaagaactgacgctccgtcttcgcttttgtctcaatctccgaaagtaatcgcatcgccggtcgatcggcgcctcatccgcgagtatggcatagatacggtcggactgaccgggtcgggcagagacggacggattctgaaggaggacattctgaacttggcacac

SEQ ID NO: 62644 - DNA, 456 bp, Heterodera glycines
  Genomic contig location: Contig_ID=SeqID_32331; Location=753..1208; Strand=+
  SCN-specific regions: Sequence locations=1-143,170-285,311-456
atgctggtgtggtaagtgtgaagaactgtgttcctccaggcaaaaaattctaagaaaatttataagcatttgtagggttctcagcagtttccctgcaaaatttggtgagcttctgatcagtctagaaggttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttattca

SEQ ID NO: 62645 - DNA, 380 bp, Heterodera glycines
  Genomic contig location: Contig_ID=SeqID_6724; Location=790..1169; Strand=-
  SCN-specific regions: Sequence locations=1-26,48-380
gctgatgctgaacatcccactgatgctgctgttgtggacaacttcgagacgcgcgctcgccgcttcttcgacctgatcaacgacggcaacatccaacaacttcgtgtgctgatcgatgcgctggacgccgacgagctgaacattttgctgcggtggatggttgatccagtggagcgcgactacacccgatcacgatcagcactttggagtgccttttttcgacaacacatcgacattgttgatctcttggtagtgatcaaacaaatttatcagtcggcactaattttgtatggcattttcagttggagaagggcgccgatccgaatgagccggtggttggccgtgagaacgacattaacacgagtgggtggtgttgttga

SEQ ID NO: 62646 - DNA, 2257 bp, Heterodera glycines
  Genomic contig location: Contig_ID=SeqID_6725; Location=448..2704; Strand=+
  SCN-specific regions: Sequence locations=1-1051,1074-1395,1417-2257
atgttcaaccatccatccattgctgagagacaaataaatattggtttgttctctcaaaagggtcaacagaattcggtacaatttgacaatccatcggcgaagaagacaaaaagttatgccgaagccgtgcgattcgaattggctgacggaggaaacagtgacgaaccaatgatggaatgggaggggccgcagaatcagcgggaggactcaacgcatgacgacggcactctatcggacaatggtaagaaaaaatggggtatttatctgtcaccagacttcaaaaaaatttatacgggtaaactggtttggggtttttagggtcgggaaaacgattctttcggatcctgaacccaaactcgaacaaaaagtcgaaattaccccatttggtttatgctgacaataattagttttagtgcattctttgcaacccgttgcgccccccgtcactgaatttggaattgatttgtttccgattgtttctgcaaaacaaactggagacgattttggtgcgcggaatgttcagcagcaggtaattcagtggccaattgttccagtttctaattaaactaaacgtttcaggaccaaagtcgtcgcaacgacggatcagacattggactatttgaaaaaaagaaatgtgttgcctcattggaaatccatcggatggacaatccaaacgaacgttgtgtagtcaaaaagtacgaattcttcatggtgacggacaatgagcagcatcaaatgaattccgctgcttttgcaacttctgagcgttgtaacccaacggttggccaaatgacacagaagattttgtcggagcattttgaaacaccaattgacaaattaattgcacaattcgacatgcaaatgcaaatttttgatacggattttgctgacggacgttttgtcgacatggaaaaaaattggtcagctgaacttgttcaaaacaatggtgcctacaaagtgctgctccattcaaaaatggacgccagaagtggacgtggatatgaagatgtatccaccagccaaatggccaaccgtggaccacgtcagcaacgtgaaatgtttggcaatcaaacgtacaatgaatatgagtccgacatgtttgatcaacaaactgttggaaatcgtagtaaatgtgggcggcccattggtgatccatcgttttgtgactccaacttggaacaaatgtaagttgaaaacattattcatatggatattccgagtattctcttcatacatttttagtggggggtcgagcccccctgacttcgttcgtatgaggggccgaaagaggggggggggggggactttgtattggttgggacaaaaatctgaaaaaaaatgtggggaaaggtcggagacgaaggattaagatagatgcgacttcgtaaaggcgaagagaatttaaataatttaacatacaaaaaaatttacgaaaccgagtaatatttcgtattttttttatcaaataggtatgatttttaacaaattgcacttcgcgaaattgtttctggttacgggcctgaaggacttcgtaaattttcgtccgacccccccccccccactatttaatgtatgatttaaagtaattgtcttttaaattcttatatgtttgttgttgcttctttttttctctaaaatccattttatcggatatttagcggtcgctttcttctctccgaggtgaaggcgcctctcgccaatctttacgatgtttcaacggacaatttcgtcactttgaatgatcatggatttgtcaacaaaatggccaaaaacgacgaaaatttgacaatgcaggacaggccaaatatgcgcgaacaactcattgaaattgaaagttttgacgatttgaaagaacgcaccaaaatattggactttgatcagaaagttgctaatacaattttaacaaaagctatttacgcttttgttatagttgagtgtgatcagccaacttgcgcattttgacgatgccaatccccttggccagtttctgcagaaagcggcagctcaaaccgaacgtggcaactcatttggcttcattaaaattgtgccaaaaacggtagaaatcggcactcactttttactctcatgaaacttgtctatgttttgcagacaatttcactgaaattggtcctcccaaaaatgcgtgacatcattctgcagcagttgcctgtaaacaatgccacacattttgtcatgtcggcatgctatgggtcaattgtggcagggatcgtgacttttaatgagcgcagtgccgcca

SEQ ID NO: 62647 - DNA, 1615 bp, Heterodera glycines
  Genomic contig location: Contig_ID=SeqID_6726; Location=895..2509; Strand=-
  SCN-specific regions: Sequence locations=1-65,87-177,202-287,310 -323,351-426,448-1022,1044-1316,1338-1484,1507-1550,1572-1615
  Gene Ontology: Mol. function=transcription factor activity; Biological process=regulation of transcription, DNA-dependent
atgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaattttgaaaaaatgtgtaattttttcccgtcttttttccccccacagtcacatttcttgtcgagaatggtgccaacatcaatctgcagaatggtgatggggcaacagcactgatgtacgcgtgttacaagggaaatctagggaaaaatttccattggcgaaatgttttccaacatttccatttgaatttaggtggacattgtgcgcttgttgctgacacatggtgcaaatgtcgagcaaatggatttcgaaggtgggggattactgttacagtacccaaaaataccataccacaaatgttgtcctaatttcaggattccatttcgcacttaagagcgctgccattggcggcagtttggaggtgtgccgtctgctggtggaggagtgggccgcagatgtcaaccaacaaaccatccaagagcgatacactccagtgatttgcgctgccagtaaaggacatttggccatcggtgggagagaattgtggcaaagtgccaaaaatgtaatctccctaattttcagtgaatttcctcatcgaacatggcgccgaccttcaacatgttgacgtggttggaaacaacgctttgatgtgggcagtgatcagtgggaagactgaaatggcacggcatttggtggccatcggcgcggacattaaccaacgggacacggccggtgagcagcagcggaagtggccaaattgaagcgtttagttcactttgttcccccatttcaggcaatcgagcgcaggatatagcggtactgaccggacatgccgaaatgatggccatttttcgtactacggcgacggacaatgggcaacacgcggaaggcaccgatgggtaaagaaaaattgttatttttgatcaaaaataaatgttttttcccatttttcagacagcaaaatgatcagcaacagatgtgacagcagcacagagagagcgaatcgctggccaaaagcggcggatggatttattcggaagacattaattgatcactaatgtattgtatcttattatgcccaccatttctatttgatccgatttgtctgtaatatgttccaaatatctctgattgtacatataatttgtgagtcgctgtataaatgtcgaatgaatttgagaaaaactcggaatttttgtaacattttgatttaaatctgccagcctttgtgtttttaattgaagctattcagtcgtcgtcgatttaaaaaagcaaattttcggaatccgaaaaatttctgggcgccaatcggttggtaaaatggggtcgatggcagttcgtacaatttcaaatgggaattgccataactagggctcgaaattatatggactaaaaaacgtcaaatatgacataaaatatggactaaaaatgcccgaaatatgaagaaagctacaaaaatggccaaatatggaccaaaatatggactaaaaactgccaaattataaaaagtacaataaa

SEQ ID NO: 62648 - DNA, 452 bp, Heterodera glycines
  Genomic contig location: Contig_ID=SeqID_32332; Location=352..803; Strand=+
  SCN-specific regions: Sequence locations=1-7,442-452
atgagtaaagacgaaatggaagagaaaaaggaagaaagggaaggaaacagagaatgcggaagaaaaaaatggacgaagaaaaaaaagggaattatggaagatcgaggagaagaagaagtaatagtataagagaacaaggaagaacgggaagatgaagaaccggaagaagaaatagaagagtaaaatgaataaaggaacgaaaatgcggaagaaacaatggaagagaaaagaaaaagaagacaattatggtgaagagaagaggaaaaaaagagtgaatgataaacaagtgtaagaggaagaagaaatggaaaatgaaaaagaaagaaagagaagacgaagaagcgaagataaaatggaagagaaaaaaaaggatgaattatagaagatggggaagaggagaatggtgaagaaaggtaacaggaagaagaagtggaagaggaaaatgatgagga

SEQ ID NO: 62649 - DNA, 665 bp, Heterodera glycines
  Genomic contig location: Contig_ID=SeqID_32333; Location=252..916; Strand=-
  SCN-specific regions: Sequence locations=1-665
tgaaataaaaaaatcgattttttcaagtgtccgtttgggggtactcaaacaattatgggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaac

SEQ ID NO: 62650 - DNA, 573 bp, Heterodera glycines
  Genomic contig location: Contig_ID=SeqID_32336; Location=497..1069; Strand=-
  SCN-specific regions: Sequence locations=1-48,158-207,229-573
atgcctatcgtggggtaagcggcgggggataattgacttacgtccacgccctctctctctctctcccttcccttattctttctattttctcagcctctcattttgtcactgtccgctttccctttctccccaatatttccacctttccctatctctcgtgctggtcctctccgtccctttgtgccattggccaaatgccgtcccccgcggccctttggcactgcgccgcggtccgtcgctcgcttccccccttaattactcacaatgcaatggcacaccccggccgggcagcacatcgacgacgaacacttaaaagcttcgccgccttttcagatcggataataaccaaataattctcggctttatccgcacggattatccattcggagaacaaaaagcgcaacaaaacggaggagcaaaatgcgatgcgaaggaggagaaggaaaatgggaagaaagaagcagcaaaaaatgaaaatgtgagtaaaaaaagtgaaatggcaaaagaattcacttaatttgtttatttttatggcataaaaaatcattggcatttttaattgccctaattaaa

SEQ ID NO: 62651 - DNA, 803 bp, Heterodera glycines
  Genomic contig location: Contig_ID=SeqID_32341; Location=718..1520; Strand=-
  SCN-specific regions: Sequence locations=1-190,214-803
atgagaaatggatcttatgagaacaaattgacacttgccattgacgtcactttgaaagaagcagaagcgatggacaaaaaggcttctgctactgaacaaaacaattcattcggcacaatttcgatggaaattgaaaaagtgtccgaattttcgcgcgaaattttgtacagtgaccgtataagcgaaaccgtgcatttgaagggatttccatggcaattaatggcaaattttaatccagacccaaacggcgtaagcagcacagacggcagcacggaattatatttgggcttttatctttggtgtaccagtttgaaaagaggtgaaaattaagaatattatggaatagcatttttcaatggcaaatatttgagtgaaaaatattcaaaaattgtattaaaaatatactcgaaatttgccatcctcttggggctaaatttccagaaatttttttaaccgtatttcgtttccgtttcggtaaatatccatcataggtcccagactcaaaattgcataaaaacacttttataagttttcttaggtgctgaaaacgcctaaaccatcaaaaaaactgcgcgcagagcgtttaaaccggtttttgaacatgttttaaaactcgaaaatttgagtgaaagggaggcaactgaccttttaaaacggtcaaaatcacacaaatttggtatccttcgaaagctcttgatgagctaagtctaaaaaacaatgtatacattggaaccgacgccatttgagcactggggcaactgagtcccagtgaaaatgaacatttcagtaccgaaaataataaa

SEQ ID NO: 62652 - DNA, 836 bp, Heterodera glycines
  Genomic contig location: Contig_ID=SeqID_6727; Location=155..990; Strand=-
  SCN-specific regions: Sequence locations=1-561,587-836
atgaattgcactgtcataaataagttgacgactctgtcgaaagtgcgcgacgcctttcggatcacaaatttgctgatttgtatagcatttatgattttgtgcgcttttccaatgtacaggttggctcgagaacgcctgacattgtacatggtgatcagcaaggtatggtataatcagaatggacgcgatcagaagcgatcttgatcacgcgggttttatcactcaacctgtgaaatgttgtatattgagtaaagaaaaccgtgagaaaagaattttctagacacacctaaattaaacattattagtatcattcgatagctcaaagtgtcatccattcgtatacgaagttaaaaaaaaaatttcaccaatgattcagatgtcaaaaagtgggaaaaagtgaatgtttcaatttttttcgtcattgcttttctgaaacggattaaattttttgaaattttataattcttataaaggattcttaggagctatagaatgtaaaaaagttatggtctattttggttaacagttatgaaaaaaagttttggtccaaaaaatgaatcgggttttttatattaaaattgaatttccatgtttctctgtttagctctttcccggaatattgttctttttatcaaaaatcatttccttcccatcaacgggttttataattccaaatgttgtgttggatattgttgcaaagattgcatttatttgccagaattacggtgttatttgtattcgtttgcattacgttgtgatggctgcaaacagagcacatgcggtgctgttcccattcaattatgcacaaaacatcactaaaaagtaaacccaataaa

SEQ ID NO: 62653 - DNA, 430 bp, Heterodera glycines
  Genomic contig location: Contig_ID=SeqID_6728; Location=1610..2039; Strand=+
  SCN-specific regions: Sequence locations=1-374,396-430
atgtggcatttttcgattggcattgctgtcatttttggtacgctctgttgctcaaacggaaacggttcgttcagtatatatagttaacaactatgatttttaaactatttataccattttcaataaattgcactaaccaaaattgagaatgatttttctaattttttttcgaaatatatgaaatttccttgtccacgagtcaatcatgttcattcccggcaattaaatggacaattgttccttttttaagtgttcaatgacgtcgaaggtttcgtgtccgagttcgcctcaatgacggatgcgggggcagatgtgctcgaaaaactcggccacattggaaaggggacattcagtctcttaaaattcgccggctgttaaaattttttcagatatttgcaccaagtggttgtttgtcctgcttggcaacaaa

SEQ ID NO: 62654 - DNA, 571 bp, Heterodera glycines
  Genomic contig location: Contig_ID=SeqID_6729; Location=117..687; Strand=-
  SCN-specific regions: Sequence locations=1-82,104-131,153-328,393 -429,452-571
atgcatttaaattataaaaacatttttcatattttaagtgaagccgagcagttcgacaaggtcctggacatgctgcagatgcccaacatcaacaacatcacaaccaacagtttaagcagtggtacagactgtgctgctgttggtggtgtgctcggattttattcaaacaaattttatgtgcacggtaaaacggtggacgaagaagcccaacagcattgagcgggacggcaaagttggaagcagataaaataaaactgtgttcatgtgattaatgccttggcatgacaaaaacgaagactaagtttcatctcccaattattcttctttgttataatttttaaatataaatcaaaagcattaatttgtattagaaattttataagatattttatcctttcaattatactaaaataacaatatgaaactgattgattaatattgtttgtctaaatctacaatttttagggaaaaatgtgaacacacttataataaacacattgcttacaaggctttttgcccactttgaatcataacaggaaaataattttgtatttattggcaacggaataaa

SEQ ID NO: 62655 - DNA, 207 bp, Heterodera glycines
  Genomic contig location: Contig_ID=SeqID_6729; Location=730..936; Strand=-
  SCN-specific regions: Sequence locations=1-52,131-207
atgccaacattgtctaaaatgattgttggtgtgtgtacactaattaggtggcaaattttttcattattaaaataatttttttcaatttaaatcagaaatgaataataaattttaaggtaaattttttaaagctgatcagttcaaggcaagacaaattgaatatcaaaacaaatattcaaaaaattgatcatttgttttttaaataaa

SEQ ID NO: 62656 - DNA, 281 bp, Heterodera glycines
  Genomic contig location: Contig_ID=SeqID_6730; Location=46..326; Strand=+
  SCN-specific regions: Sequence locations=1-128,153-281
attttctaagaaaaaataggtgttttgggggcgcggcggtgccgataggcgccccccggggggggaaaaatggaaattttgatcatttataaacaggtttttactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaatgcgaataatgcgaaatgcgaaaagcgaaacctaggcacatccctg

SEQ ID NO: 62657 - DNA, 830 bp, Heterodera glycines
  Genomic contig location: Contig_ID=SeqID_6730; Location=1211..2040; Strand=-
  SCN-specific regions: Sequence locations=1-95,117-500,522-547,569 -738,811-830
atgacaccaataatattcagaaaagtgagagaagaattcaaaaattctgccaattatattaaggagctgcaaataattatgagacgaactaatacaaaaaattttttgagtgttcttatagagattaatcaggtataattagtactaatgatgcaattgataggtggaacttgccggcatttcgcttgccgagttcgtgcatccggatgacgcgaccttgctgcataatcagcttgcactaaatttgcctgcaagcgcgttgcttgtcctgcaacccgagctgcgcttcacactgcgcttccgctgtacgccaggccggcgcgcaatgatgggatgcaatggcattggcatgcagcccggctataagccaattcactttgtcggcacgctgcacgctgacgatgatgggagattcttggtaaaggcatggtaattatggaaaagagacctaccgtactaggaaggaaaaaaaatgttctcaaaagtagggtgttgaaaattttttgtttgctgtttttaaatctctcaattaattgtgcgttaattttcatatataattcaaaagagaaagctttggaaaatttttataagccatatatttttatttaatttcaagtttgttgttttttacgtttttttaatccaaattccgaaatgaaattttttccaaatttttttgagtgatttttaattctaaaattaagtgagagagtgagtacatcaatattatgataaaccttttttaattattttttaatttgttatatgggttaattacaaattttttgaaattaaaaatttgtataaaaacctatggaatataaaataaa

SEQ ID NO: 62658 - DNA, 76 bp, Heterodera glycines; identical to SEQ ID NO: 51235
  Genomic contig location: Contig_ID=SeqID_32342; Location=954..1029; Strand=+
  SCN-specific regions: Sequence locations=1-76

SEQ ID NO: 62659 - DNA, 1435 bp, Heterodera glycines
  Genomic contig location: Contig_ID=SeqID_32343; Location=246..1680; Strand=+
  SCN-specific regions: Sequence locations=1-1340,1362-1435
atgaccatcgaacaattgaaacagtgtatggaagacgcaaagcgctttttggccgaggtgcgttggagttcatcgacggaattgccaattttgcactaaaaaggaacgcgctaaacgcccgagcccgcacttggacaacaaaatactgaccgcatggaatgcccttgccatctcgggcttttgtgctgctgctcaggtggtcattttaatttggattgatataaatgggaattcaaattctatcaaattaaatgagagaattcccttttttgttaggctgtcccaacgcgcgcggccgagttccaaaaacgtgctgaaaaagcggttgcattcattcgcagccatcttttccatgggggcgaattgctccgatcggcttacttggacaatttgggacaagtcgttcaaatgtccggagtaatttgccggaaaataataacacaacccttgttttagaagacatcccatcaaagcgtttgccgatgattatgcttttcttatcgaagcccttctcagcctttactcgctgaacttggatgagaatttgcttcaatgggcgcataatttgcagcttcaaatggacgaacttttttgggatagcactttcgactcgggctatttcatgtcgagggttggcgatccgtcgataatcgtccgaatgcaagacgaacaggacggggctgaggtgacaccaatgttagccactgttttactattcatcgtttagccctgcaccaattcggtggccgcttccaatttgctttgccttggctttcttctcgattccgctgactttcgtcggcgtgccaacgattgttttgccggcgcagcaaaacgaattgagaaataccctttcataatgccacgtatgctaatcgcattgcatgccgcaactcatccgccgtaccaagtgaccaatttgggaatgaccgacataagcagcaaatcttttaattaaaggtaattgtggtcggacaaagcactgacgaggcgactcagaaaatgctcaaagcgattcgtgcgaagtttcttcccatggcaacacttatttttatcgacaaggatcgccctggttagcaggatttatttagccatttttgataatgctttgattgtttcacatgcttagatcaatggattttgcggcaaaattcgcatttggcggattatgcgagtgcctacagacccggacagccctcagtgtttatgtgccgtgagatgtcttgtgaaatgccgatcgcaactctcgaggaactgcaaaagcgactggcagaactgtgagggagtctctgccggcgcatttgttaattattcactgccctatgggaattgaagccgctatttattattttcattgtttcgtttcgaaatttcccgatgggaacagtcacaatgtgaccattcgctatgcccgagggcatagtttaattgatga

SEQ ID NO: 62660 - DNA, 109 bp, Heterodera glycines
  Genomic contig location: Contig_ID=SeqID_32343; Location=1816..1924; Strand=+
  SCN-specific regions: Sequence locations=1-109
ttcctgtgtctgtcagttatgcggtattttgtggccattagtgctgctttctcctggccattatccgtcgactcaaatcattcctcgggtatatttatgccccccccct

SEQ ID NO: 62661 - DNA, 1301 bp, Heterodera glycines
  Genomic contig location: Contig_ID=SeqID_32344; Location=55..1355; Strand=-
  SCN-specific regions: Sequence locations=1-118,140-663,701-791,813 -1093,1179-1301
atgccaacagtgacagttccaactgtatcacagcctacagtaacaccacgctgcttattcggtccagatggaaaatgcctaccgactccaagctacagtactgcagacccggtcacaaacacatacagcacacaaccagtcaccaacacatacagtactgcagatccagtcaccaacacatacagcacacgaccagtgacattcagcacacaaccggttaccacttatagtacacgacctgtcacttacactaggcgaacatacagtacaacagatccaccatcgtcacgttcgacctacagtaatctggcttaaatttaatgtttgtaatccacacaacttttaggtgacgatgagaacaacaaagagacggtaacccctgctggaattgcaagcaatatttcggcaaatttgggtactgtaaatggaaaaacaattaattttagttttgtaaaactaaattttattttagacaaagtagcggagacgaatttccatgattcgccgattcaagtacagcttgacgatattgatgacattgagctccaaactgggccagacaattatgatgtaaagctacgaagtccactcgaaaatggcggtaaaacaaagttttaaataatgctaattaaaatttgatttttattcatgaatatttaaggcaaatatttaatatttaattaaattaaattaaaaaattgggactacgactttggtacgtcggcttttttcccattaagatttagcgatgcaatttcgacacccaaaatttttcggaaatcgaaattctgatgcctaaaagattccaaaaattggtcttttgagccgaaaaatttttcggaaatcgaaattctgatgcctaaaaaattccaaaaattggtcttttgagccgaaaaatttttcggaaatcgaaattctgatgcctaaaaaattccaaaaattgatcttttgagctgaaaaatttttaggaaattaaaaaattccaaaaattggtcttttgagccgaaaaatttttcggaaatcgactaccctaaaaaaacggccgtgtcgtacaatcaacgccgatctgatcctatcccaattcaaaattgtgtaaaaatgaattttttcatataaaaagttgtattatgaattaagtaatttttataaaaaacgattttttattaaaataaataaatgcaatttcaaaaaataaattcagtgtgtcttcaacaaattgacaaggacagaatggcaccgttaatttacaatgcccatcagccgggcatcaccacagtgtccgcctcattacccagcgaaca

SEQ ID NO: 62662 - DNA, 737 bp, Heterodera glycines
  Genomic contig location: Contig_ID=SeqID_32345; Location=241..977; Strand=-
  SCN-specific regions: Sequence locations=1-241,263-278,300-308,335 -345,367-419,441-575,597-737
  Gene Ontology: Mol. function=U2 snRNA binding; Cellular component =snRNP U2; Biological process=hermaphrodite genital morphogenesis
aagggacgcgcagtactcatcggagcggtaaggattttacgactaatttttatgatacctaaacccggtgcttgatatacgactttaactgactgatccggacaatttacacgacgaaccgggctttatcaccaatttatgttcaccagaaaatacataaatttatttatgaaaatgtgctaaaactattactgttatctcaagagcctgccgagattaaaaaaatttcttgagttaaaatcacaaacatataataaaaagacttaaatggcgaatgatatgatatttttgattgtatatgaccataaccaaaagaaaattaaaaattatgttgataaatccataaaaattaaatggttttaaattcgaattccaactaaattttgtcaatgctttcaggctgaacgtcaaaaattggtgtatattctgaacagagatgcccatgccaatttgaccatcagttccccgctggaagcccacaaaaactacagcatttgcttcgccatcaccggcatcgatgtgggcttcgaaaatccgaccttttcatgtttagaaattgattatgaggtgggttattaagaaataacacatttaaacgattcgtttatttaattgaaggactccgaccacgacccaacgggcgatgcggcgaaacaaattcagcagacactcactttttacgagttggacttgggactgaaccacgtggtgcgaaaatatgccgagccactggccga

SEQ ID NO: 62663 - DNA, 87 bp, Heterodera glycines
  Genomic contig location: Contig_ID=SeqID_32346; Location=545..631; Strand=-
  SCN-specific regions: Sequence locations=1-87
atggacaatcagcagggaaaggatgatgtgttgtcgtccaatgcatttgcatatcaacaaattgttgggccacagaatataacggca

SEQ ID NO: 62664 - DNA, 371 bp, Heterodera glycines
  Genomic contig location: Contig_ID=SeqID_32348; Location=176..546; Strand=-
  SCN-specific regions: Sequence locations=1-49,72-305,329-371
atggaaaagcaaagaattggagaaaagtgcgacgacgaaagggagaagagaatttcgggaaaagaagaagaagcggaaatggcgataattaaggtaaaaagagagaaaatggggaaaaaggaaatgaaaaaataaagtaatatttaaaaaagcttaattgattttacctaaaaaaataggcggaattgtgccgcgaacgggcggaaaagaatcggagacattcggaactgagcaaagtgcaccaggaactgatgcaatcgctgcaaaaggcagaacagttgcaaaagaaattggacagagaaatgagagaacggacaaaagaaagagaggcgacggacattttgcaaaaggcaaattcaaacggacaataa

SEQ ID NO: 62665 - DNA, 662 bp, Heterodera glycines; identical to SEQ ID NO: 54633
  Genomic contig location: Contig_ID=SeqID_32350; Location=824..1485; Strand=-
  SCN-specific regions: Sequence locations=1-662

SEQ ID NO: 62666 - DNA, 604 bp, Heterodera glycines
  Genomic contig location: Contig_ID=SeqID_32351; Location=222..825; Strand=+
  SCN-specific regions: Sequence locations=1-425,447-544,566-578,600-604
atgacaaacgaagcaaagggaaatcatcgaaacgaacaaggagagaaagtgagtaagttgggatggagttggaatccgaggatgaagagttggcgatcgaacaacggagaaagaagcgagaggaactgcttgaaaagctaaagacagaaatgggcctgactgatcatgtgaatgagcagcagcaaaacgatcggtataattcgacgcgatgtttttatttaaattttgcattttcttcttcaacacagtatccaagaaaagacgagtgctgcttcatctccaaagcacacgtcaagcagcgactcttcgagtgattcggaagacaatggcagtggctgtaacaaaagcattggccctggaggatggtgaaagggcaggtgatgaagtaatagagtgtgaaacaatacatgttgcagactcaaacgaacaaaatgacaaatttatgtgtgtctattattaggaatgagaggagcaaagctcaacatagcataggcggcaatgcataataactaaatttcaggattataattcataatcaatacctaacttgcttttattttatatttacgtgtatattcaattgtctggtaaaatatttttgtaa

SEQ ID NO: 62667 - DNA, 131 bp, Heterodera glycines
  Genomic contig location: Contig_ID=SeqID_32351; Location=1..131; Strand=+
  SCN-specific regions: Sequence locations=1-110
gtgttaaagcgcgtgttgaactgtcaacgagccgttctcgtcgcgatcgggatgagcggggccggggaattagtcgcgagaatgaggaaaaatcacgcaaaagggaacataagtcacccaaaaagaagaaa

SEQ ID NO: 62668 - DNA, 3556 bp, Heterodera glycines
  Genomic contig location: Contig_ID=SeqID_6732; Location=58..3613; Strand=-
  SCN-specific regions: Sequence locations=1-73,95-259,283-595,622 -624,658-762,784-866,922-1216,1245-1613,1635-1650,1672-1703,1757 -1804,1964-1993,2025-2065,2087-2145,2167-2422,2452-2572,2594 -2728,2837-3064,3098-3160,...
  SCN-specific regions: Sequence locations=...3186-3248,3296-3373,3395 -3501,3523-3556
atggaaaatgccaacaatgcagcaaccaacaacaacaaaatgccaaaaacggcgggggcaccggagcagaaaaatggcggcagaaaaacgaagacgacgacaaaaggggcaaaaaatttgagcggctcttcgtcgccggatgggctttatcccaaattggctgctgctgctaacaataagtcgtcgccggacagaggcgagctgtgcgtgtcattcaaagtgctcaaaacgagggacgaactgttggtggacgaggagcatgaagaagaggaggaggacacaaacacattgggtaggttcggttgggatgaacaattaaaaggacaggaatttatgaataaaatgtcgggatcaagaattaggggataattaagcaacacgaaggacatattgttttattggctattttttaaaaaaaaatttcttggagagaaaattgaaatggttgctcgagagtcgaaattttctgtgactcgagaaccgagaccgggaattgacccaccactgagagttgcgcgagctcaaaaaaaaccggagaaatttttcgactcgcgagtcgagaaaggaaatttttttttcaaaaattttgttgtttacacaaaaaagaatcaaaaaattcatcccaaaattaattaataaaatattttgaaatttttactgctaattattgttttcattaattttaaatgatttgatagtttgcggaatacaatttaaaaaatctttaacacaacccatttacactttttgtacattttacggattgtttccaaattttgcagcacgtctcttctctgaagacgacgtgcactttagcgattcgttttgtgcaaaactgaatttggccgatgccaacgaacagcaacagaaacagcagcagcagcaggaggaggatgaggagggtgaagaggaggatgacgaatcggacaccagcgacagcaccgcaaaagcgggcccatccacgggcggacttgcggccaaagacacattcatcaagtgggcatcattcattcataatccctatttgttcatattcatgttagaccccaacgaaatgaagaagaatgtgtatctcttgggccatcaaaatacaaagaaaaaattcgacgggcccagccctaactagaaaaacgaaattttttttttgataggcctgggaattgaaagtcttcccccccccaaaaaaatgagtatttcattgtcattttgtttaagcatttaatttatttcaattttttttttttgcattcgccctttctccatggttatggatgggcctgcaatcaaaaattgaacgaaaacggaccctaaagaaagctgacgaaatctccctttcgctctctccggcaattacaaatttaagaaatcgaaaaattttctcgaaaattttagggcactaattagtattcatgctacctatttttgttgtttaatcagtcaattaattaatttgccacagggatttctccttctcccccgcctgtttgttgcgcattgactacgaggcaaaacgcgtgaaaactgatcagcagggcgcgctgatcggctttttgatcggaatggcaaatttgaacaaaacggaactgacgctgaaggaaatgcgcattgaacggggctttcttggcattgaaaaatgtgcacaggtaaaacaaaaagaatgtgaagagacgacaaaaatgaagctgaagcacaaaattctgttgtttaaatataatttttaaagaaaaaccattgttttaaattaattaaaaaaaaacacataaaaaactatgttataaaaagtttcgaaaaatcacttttcccgaattttttttcaaatttttaaaattttcaaaaaatcatttaaataaaaaaaagatttttgaaaaaacttagatttcatcttaaaaattgaaaaaatcattaaaaaaaattccaaaaaaaattttttttcttaaatttcaaaatttgaaaaaaaaaatttcaacgcgggggagaaacgtcatgcacccattttagccttctttctcttatttacagtttgtcatcaatgaatgggtgaaggacataatgaacaaacaattcccaaatgtggtcggcagtttggcgccaattaatgcgctcgtccaattgggtaaataaacaaattattttatctaattagggtaattaattaattatttttatgacattttaacgctttaagcgcaaggctttcacgatctgttcgccctgccctatgatgagctgagaaaagagaatggccagctgatccgcggcattcaacggggcaccaccagttttgggctgaacgccgccacggcggccattgacgccacccaacgggtggtcggactggtccaggcaagtgttttgcggcacattttgttgcttaattacctctttgatggcaatagcataattaaaataatttgtgatttggtttttaaatttcaaaaattaaaaaaaaaacaatgtccagtgaaaaaatttcactttccgtcgggtggatccgaacccatgtcaagaataaagtcaatttaaaaaaaaaatggaaaattagttataatgagacaaatgtcgattttactagtaaaacaaatgaggggaaaaactcattaactttgataaaccatttttatcgaattttctgaacatatttgtgcgccatttatagtcactgaaatgaaaagaggcaaatttgccaattttactttcccacaaaatatgtttaatttgtttaaaattgttaaggcaataaaaattttcaatttattttttattgttgtcttaaatgatttctttatttatttttgtattttattaaatattattagttattaattaaatcattcataataatcatttgcagaatgttgcggagttggcctttgacattgtcaacccgaacttccaacgccaccggcgcctcctcagcggtccgcagcgtgtccaagtggccggcgacctccgtgaaggcttttcgttggcctacaacgccgtcagagaggtgggtggtgttcaaattgttgtttatcccgtttttggacgcctaaatccaccgcctaagtcttgcccaaatccgaaaatttaaaaaaaaaatttaatttattttaaagggcgttttggacacggcacaaacactgcaggcggccgctgctgaagaccgggcactcggcgggctgggcatgggcgtgctgcggcacatgactccgtcagcaatcaaaccgtttgtcatcgccagcaaagcgacctccctcgtgttgggtgtgtgcatttgtttttgtttttggatttttaaataaataaaaatattggtggtaaatttcggttacactttgctaaaagtgcgcccatctccgaaaaactttaaaaaaaaggatttggaaacttttcagagaggagaaggaaacgagaattggacaacgaaagaaaaattatttggagaaaagtctggacgtgtctggttgaattttatgttggtcctcatctgcacttggattttccgtataaaaccgtgaaattccaggcccaggaaaaatccagaggttgccgaaaatggcctgggtccagcagg

SEQ ID NO: 62669 - DNA, 985 bp, Heterodera glycines
  Genomic contig location: Contig_ID=SeqID_32353; Location=1..985; Strand=-
  SCN-specific regions: Sequence locations=1-305,327-685,707-985
  Gene Ontology: Mol. function=3'-5' exonuclease activity; Cellular component=nucleus; Biological process=aging
aaagagttcgcgattgatcgggcgaccacttgtgttgcgaccattgcgttcggaatgggcattgacaaaaaggacgtccgacgagtgattcattacggaggtaagaggagggggggggggggaaggaaaagctgattggtcactttggtaaatgtgcaacaaatttagcacccggatgcattgagagttactaccaggagattggccgtgccggccgcgatgggttccccagtcggtgcttagttttttatgccgtcagtgatataatgatgcaaaagtgcgcatgcaatttttgaacccgataacccatttttctgtccaaggcgccggattatgaacaacaacctttcgaaggaatacgaaaaccacaaattggaaatgctgcgccgcatggaacagtttttgacaacgacgagctgtcgtcgctatctgatcctgtcctattttgacaattccatccaacacccggacgtgccgaactccgactgctgtgacaattgtgaaaaacggtgccaaattggagggaacgacgcgaaaatttacggggaaccgacgacggtcgactttggagaggaagccaaaaagctgttcaatgcgctcgaattgttcaacggacggagcggactgaaaaagcccattgattttctaaggggcagtgaaaatgtaaaaaaaaagagaaaggaactaatgacaattatttaatgttacagaagtctctccttccttttctgaagagcaatgggcttttgggccacgaattattcggaagtggcaaaaataaatccgaaaattggtggacggaattcggtaaaatgttgcgcaacaacggtttcttgtccgagtccaagtcgacgttcgcccaatactgctatctgaccaagttagcaccaaaagcgattgaatggctgagcagcgggtcaaaggtgggttgaggggaaaggggcatacatgtgcaaggggtgtctcgacataccccccttcatcg

SEQ ID NO: 62670 - DNA, 248 bp, Heterodera glycines
  Genomic contig location: Contig_ID=SeqID_32356; Location=942..1189; Strand=+
  SCN-specific regions: Sequence locations=1-124,148-167,194-248
ccgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcc

SEQ ID NO: 62671 - DNA, 1547 bp, Heterodera glycines
  misc_feature (27)..(27): n is a, c, g, or t
  Genomic contig location: Contig_ID=SeqID_32357; Location=593..2139; Strand=-
  SCN-specific regions: Sequence locations=1-42,64-161,183-680,702 -865,910-1064,1086-1547
atgcgcttggagtgctccactttcacnaacattctcgcactttacctgaagaccaagggcgacgtggtgctggtggccgatttgatgcgttccgttacggtgctcggctacaaagcggtcgactcgactttcgaagagttggccaggtgttgccatacaaatcaaaactagagaccggacaggtggggttggaaggatcccaaccaaatcccgatcccgatcaatcccgaagatttttgaaaaacgatcggaacggactccgaggtcgggatcccagtctggtctctaatcaaaaaaaaaacattaaaataatcgcttttttctatgttgagggactattccacggaatggacgagtgcctgtgaaattatcgactcggagacttttctcgcggcggagaacaaccacaacatttactgctgcaaaatcgacgtgaacgccgaatcggacgaggatcgatcgcggttgaaggtgtccgttagtcgcaagacatcaaagggtttcactatggtttttgtcctcttttatagcaagtcggcctctattaccttggcgaaatgatcaatgtgttccgtcgcggctccattgtttccgcccagcaaagggaaagggattgtggcacggcgcatggactcatggaaattgaggacggaggagcggcaacgttttgtgaaaatggtggcaaaactggcaggaatgggacaccgacggcgacgtcggcaccgcttttttcgaatccgataatttacggtacgctttggagagtcaatgagtttatattgagcggggcgggagaggagaaatagttttaccgtcgtacaatggaaaaatgaaatttaaccataagttaattgttttccaactgttttatttttttttattaaaaattgaatttacaaaaaaaaatttcaaaatgaaaaatgaggaaatgttaatgcgccagactccttttacaaaagggacgttttagggacgagtgacggcggtttgggtaccattgtgcaagtgcctccccacatttacaggtgatttgaaacgtttgatttattaagtcttacggattgggataatcattaaaacgtttttgtttttagttttctccatgaattgcaaaaggcaatcacaacaaaaacacacaattggcaagttgttttgccattcattccgtcgtacacaatgccttctttttcagccttcgcgttgaccacaacatttaccgttcctttttcaccgaacggcgcaatgagcagcccattgggttcattgacggggatttggtggaaacagtgactgaaatggtcggactttcttttgttaggcccttgtgacaactaagggttaatcgagttcaaattgtttattcagccgcgtgaaatgttggaaattgtcgtcgatgggttacgcctttggagggaacccgacacaatggacgaaagtgagaaaaaccccaaacaaggcacttatttgttagatatgttttttcaggcgttacggcaaggcccgaagatgtgctcaaactggtggaagatctcgcgcaaatacgttaa

SEQ ID NO: 62672 - DNA, 184 bp, Heterodera glycines
  Genomic contig location: Contig_ID=SeqID_32358; Location=415..598; Strand=-
  SCN-specific regions: Sequence locations=35-92,119-184
aaatttttaaaatttttttgaatttttaaaatttcccggttggtcccggtcccggtttttcttgcggtcccggtcccggtcctgaaaaaaaatcgaggtcccggtcccggtcccggcttctcaggtcccggcaagtcccggtcccggttttggcaaaaattcccggtcccgtggcactctagtt

SEQ ID NO: 62673 - DNA, 794 bp, Heterodera glycines
  Genomic contig location: Contig_ID=SeqID_32358; Location=960..1753; Strand=+
  SCN-specific regions: Sequence locations=1-12,34-534,560-578,632-794
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataagaattggaggagatgaaaatgaaaatgagactgatcaaaatgcaaattttcatcaaaatgatcaaaatgaattaactgatcggacagatcaattggatgttcaacaaaaaatcgaaattattcacaaatttcatgcaattagagaagcaattaagaaaggaaaatattcggcaaaaaattggaataaaattgagcaaaaaatagcggaaaaattgggaattaatcgaccaaaaatttataaatggaaaaaagaaattggattaaatataaaaaatgaccaaaattattacgaaatgaaaaagaaggaattcattgaacgaatcgatgagattaaaagaacgtccgaaaatggaaaacagaaacaatttgcgaaagagttgggcattagcaaagtgacattaagaaaatggaaaaaggaatttggcattgaaatgagcaaaagtaaattttaaattaattttcaatttaattattaatattaaattttattatattcttaggtcgaattcgattcaccgatgaacaaaaaatgagcaaaatgaatgattattatgaaatgaaaaaaggaaacccttctttaagtgacaaagaaattgctgacattttgaaaattggaactgccactctaacgagatggaaaaaggaaaataattcgtaa

SEQ ID NO: 62674 - DNA, 968 bp, Heterodera glycines
  Genomic contig location: Contig_ID=SeqID_32359; Location=39..1006; Strand=+
  SCN-specific regions: Sequence locations=1-238,261-968
gtttatctgaagactttggcggtgatgagtcagcagcaatttgcggagagaaaagtgatgccgaagagggaatatcagaaggaactgtgagtggtcgggggggggggggaatttgtaccaaacactgatcagtgatcacccattggcatcgggagggggggggggacttttattgccggccatccttttttaccgtacttattttctccatcattccattacgcattaccgtaactcattccccaccattcattaaatcgtatatttcagtctttcttcaaaattacccgttagttcattacagttttcctcgttctttaccgtattctttttgcttctcttacagtacgatggttccctcatggatgatttccgctagcacgacgacaacagctgcggcgtcctcttcgaccagcgccgccagtggccaatcgtcgcccggccccgactcgcatctgccgcccttccaccaacatggcgacgtcggcttttgcgagttgccattggaggtcgaaggcaccagtaaattgggcagcgcactgctcaaacacaccgccacccgctcgtacagctccaacccacgggttcgtttcgcatttttatgatcactcatacaaattctgatcagtttttgattgtgatttcctcctttccctaggaattcttcaaatttggccgtaagccaaccattgccaagtcgcgcggcgtaatcgaacagcaacagacggacgcggtcacaggcggtgccgtcggtgcgagcgtaggcgactccgcggcgggtccgtctggcagcagcggcggtgtttcacagttgcgctaccgcaagtcaggcggaagcggcatgggagcggggcggtctggcgccgtttcaaaggacgcggagagcaggcgcaaatcgctgggcgcggccgccgcagccaatgctgtcgctgcgggcacaattctgcacagggacagccccgtgggca

SEQ ID NO: 62675 - DNA, 1552 bp, Heterodera glycines; identical to SEQ ID NO: 32361
  misc_feature (1333)..(1333): n is a, c, g, or t
  misc_feature (1417)..(1417): n is a, c, g, or t
  misc_feature (1482)..(1482): n is a, c, g, or t
  misc_feature (1511)..(1511): n is a, c, g, or t
  misc_feature (1515)..(1515): n is a, c, g, or t
  Genomic contig location: Contig_ID=SeqID_32361; Location=1..1552; Strand=+
  SCN-specific regions: Sequence locations=1-310,350-1527,1549-1552
  Gene Ontology: Mol. function=mannose-6-phosphate isomerase activity; Biological process=fructose 6-phosphate metabolism

SEQ ID NO: 62676 - DNA, 837 bp, Heterodera glycines
  Genomic contig location: Contig_ID=SeqID_6734; Location=473..1309; Strand=-
  SCN-specific regions: Sequence locations=1-94,117-266,307-316,339-837
atggccctcacgcgaaaatggccacgcgaaaacggccacgcgaaaacgaccccgaccgcaattctcaagtattaccataattggaatatacaatgaatgaagaatttaaaattttaaggttgcgaactcttcaggaagtcagttccaagagtaacactgtcgtacgagctagcgttgtgctgctcggtcggtgttttgtaattgttctaacagtatatgctaatgacctcatatgaaccatgataaacaaattcattgatctactcatttaaaaatttaacttttttaaaaataacttaattttttctaagccaacttttataaaaatataaaaaaaacgcttttatgttgtgatttaataggtaatttttccagggaatgagcgttgtggaaaaagtctgttggcgaatcgtctgacgcgaggtgaacgatccggacagagctcagtgctggagtacaattacctgcaaattcaagcggatacagacgccagctatgcatatcagctgggaggttgagaagacaaaaagaaactacgaaagtatttggcgtatcgctgtaatttttgtcgttttggaggtggtgccgcgaatggcctccttggtccgaccgactcgacagaccttccgctttggatacttgacgggaaggacgagtgcgctccgctgcttcgctttaccttcccgccgtctctgtccaagtgtgtggtgtgcctttgcgcgtccatggaacagccgggcaacataatgccggcattgtccaaatggtatcggctacttgacgagcaaatccgattacactaccagccggaggaaattgtccaggcgcgacaagcac

SEQ ID NO: 62677 - DNA, 374 bp, Heterodera glycines
  Genomic contig location: Contig_ID=SeqID_32362; Location=60..433; Strand=-
  SCN-specific regions: Sequence locations=1-353
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaataaa

SEQ ID NO: 62678 - DNA, 374 bp, Heterodera glycines
  Genomic contig location: Contig_ID=SeqID_32362; Location=469..842; Strand=-
  SCN-specific regions: Sequence locations=1-374
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaa

SEQ ID NO: 62679 - DNA, 1140 bp, Heterodera glycines
  Genomic contig location: Contig_ID=SeqID_32363; Location=223..1362; Strand=+
  SCN-specific regions: Sequence locations=1-40,62-137,235-382,414 -451,481-876,898-973,1071-1140
  Gene Ontology: Mol. function=protein binding; Cellular component =cytoplasm; Biological process=actin polymerization and/or depolymerization
ccagaatttccgaagccggagtttgagaagccgtcatttccgaagccgccgccaccgcccgaagtgggactggtgacggaaggacgacgctccgattgaccgaatccgccgccagaagaaaagtcgttgttggagaagccaccgcccccgtcgctgtcctgacgattctgtcgaccgaatccgccgccacctccgcccccgcggcctccaccgcgtcccccgcctccgccgtcgttccaacgattgcctctcccaccgcgacggttgccatccgactgattctgtgtgtcgccatctccgaagccttgaaatgacaataatcaatattttccaaggcaaatttcaaaaaaatcttatattagaaaatcttttacgaaaattctttaaaaaaaaattttttgaaaatttttttagcgattttttgaaattttatggcgaattacatacactaaaacattaaaaaggggtggggtgtgaaaagttttttgcgaaggggggtcggccgctgagattctgatgactttttttttcaaaaccattttttgcggcgcactttttccaaaagaaaattcggggacatggggccggcggagccgataggtgccgccgggaaatttttgcgattttgagccaattttttttaagaaaaattgagatttttgggacttcgttgaaaaatttttcaatgatttttttcttgaaattttctcataaaaagaatattttaaaaaattcgggggggggggatgaagtgcactattttagtttcaaaaaagattgaaatatgattcgaacgaatagtttaacattggctacttatggcgaatttaatggtaccagaatttccgaagccggagtttgagaagccgtcatttccgaagccgccgccaccgcccgaagtgggactggtgacggaaggacgacgctccgattgaccgaatccgccgccagaagaaaagtcgttgttggagaagccaccgcccccgtcgctgtcctgacgattctgtcgaccgaatccgccgccacctccgcccccgcggcctccaccgcgtcccccgcctccgccgtcgttccaacgattgcctctcccaccgcgacggttgccatccgactgattctgtgtgtcgccaaagccttgaa

SEQ ID NO: 62680 - DNA, 122 bp, Heterodera glycines
  Genomic contig location: Contig_ID=SeqID_32364; Location=450..571; Strand=+
  SCN-specific regions: Sequence locations=1-122
ctgttgacattttgctgctattcgctgtcttgatgagcgacacaagagcataccgtatatgctctaattatagcccagtctctattaagcccgcagtctccaattatcccccagtgtacgag

SEQ ID NO: 62681 - DNA, 1351 bp, Heterodera glycines
  Genomic contig location: Contig_ID=SeqID_32365; Location=284..1634; Strand=+
  SCN-specific regions: Sequence locations=1-68,90-97,227-246,268 -358,384-597,650-663,686-1057,1079-1351
atggggcagaatgggagtgaaatgctcggaaaaatgacagtgttgactgatcactcgacaaaggtagctttttaatatacaaaaaattggaatggagaaaattttaaaaaaagttaataaattattttcaaataaagaagaaaattttttttcaaatttaccaattgataaaaaattatttttaaattaaaagaaattttttgggttttttttaattttaaaaaatgattttgtttgtaactgttgttttttatataaatcaatgggttgtgccgaagtacattaccaatctaagcatgaacttgtaccaattttctatcagcatattttcataattaacatttttgtgaatttaatatacaaaaagttctttttattattaatcctttaccatagggttcagccccgaccccgagctccccgaccccgatccccgacatttttgggcttattccccgccccgacatgtcgccccccgaggtccccggcccccgactttttgctccccgacattaattcggggaattggggactccgagcattgtaaaaagttaagttatttcaacaaatatttaaattttacccaaacactaagccaaataaaaaattttcatatttcatatttttttaattaatagatattttaaaacttaacttcacatatttttcaatttttatgtgttaatagatttcatccaattaattacttctaatggcttcaaaagcatctgatatttggaattttttcacgaaaatttcttcagaggttgctaagtgccggctttgtgaaaaccaattagcgtgtaaaaaatcgtgcacaaaaggattgtgggggcattttaaagcgaaacacgctaaagaatttgaaaactatgcaaaaatccgacccgtcaacggtaatacaagcttccttttttattgaatataaaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttggcctacccgaaactccaagtaatattttttacccatttttactattgtcatattttttaagcttcgccgcaaagattattttcggaggaatgtaattcccaaaatggccgatgaaattcaacaaaaaattgttcagggaattggtcaggattttttttctgtgacctctgatggatggtcgcaaattacaaaatcaccagcgctcttaaggttctataatccttttcatggattatacaaacagactttagcgttaccgtacatcatataa

SEQ ID NO: 62682 - DNA, 438 bp, Heterodera glycines
  Genomic contig location: Contig_ID=SeqID_32366; Location=644..1081; Strand=+
  SCN-specific regions: Sequence locations=1-438
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaattatcagagtgccgaaaatcgc

SEQ ID NO: 62683 - DNA, 885 bp, Heterodera glycines
  Genomic contig location: Contig_ID=SeqID_32367; Location=88..972; Strand=+
  SCN-specific regions: Sequence locations=1-407,439-616,638-885
atgtcttcaatgaccaaatcttttaccaacaaattggcttcagaaaagtcgccctatttattgcagcattcgggaaatcccgttgattggtcagtgttatgggtacttaaggagtttaaggttttaatttaaaataactaggtatccatggggtgacgaagccttcaagaaagccaaagaattaaaccggccgatatttctttcgggtaaatatcaaacatttttacataaagtttcacttcatttagtcggctattcaacttgccactggtgtcatgtgatggaacatgaatcgtttgaggatgaagcaattggcaaattactaaatgagaattttgtcagtatcaaagttgaccgagaagaacggcctgacgttgacaaactctacatgagctttgtccaggtgggtttttaggtaatttattttataaatttgttgagggtttcattcagagtcttacgggaggcggcggatggccaatgtctgtctttctaacgcccgacttggagccgatcaccggtggaacttattttcctccaaaagattcaatgggtcggctcggattttccaccgttcttcgaatgatttccaataaagttttttctttttgttttcttatttatatattttaattatgtcagtggaataataattcgcaagaagtgaaagagcaaggccgggaattggccgaagccattcgcgaaggcattcaacaggcaaagtcgtcgcagcttccaattgcggacgaagccgtacagaaaagctatgctcggcttgttcgccaatttgacaaggaaaatggcggcttcggttcagcgccaaaatttcctaaagcaggtcccctaaaaacattcaattctactgtaattgagcattttagttga

SEQ ID NO: 62684 - DNA, 1271 bp, Heterodera glycines
  Genomic contig location: Contig_ID=SeqID_32368; Location=207..1477; Strand=-
  SCN-specific regions: Sequence locations=1-150,238-1271
gatggaaaggtgcaccaatctgtgacgaggacatcgatgaatgccaagatgaatcagtgtcatgcccaaatgaacagcccgattgtatggtaaaactcgaagatttttttcatcacacattttccaatttttaaagattttttgcagttgataatttcaaaaaaatttatttcgaattaataaaacttaactaatgaattttattaattttatttgccttattataatataaattttgtacattttccaacaaaattccatgattcctttaacagaacacgcctggtgcctatctttgcctatgttatgaatacgacaattccactggaaaatgcatgggtaaaaattcaaatggaatttttttgtgctacttaataattttaactttaaagagagcctgtaaaaagtgccatgctcaatttttgaaaattgatcacttgattaaaaaattttgattctaaaaccatttaaattcttagaaagaatttattcatatgcacaaaaatcacagaataagatctatggattaaataatctaaatttttaacatgggatcccggttgacaattttcaggctcatccgaggaagctgatgatgataatgcggcactttcattgtcttcccaacgacgaataccagtgccaatcccatcaatggttctaacgcctcagcttggacctttgttggacaaaatgtcgcaccaaattagcacccaaatgccaaccaaagtgacacgaccatcggcacccaaattgcttttgcttggcactgaaaaggcggcaccaatgcaggcttgtttccttaatcgaagaatattgaaaaattttatgtaaggaagcagctgaatgcgtggtttaaaacatggaaaacccttggatttggtagctcaatgggagagctgctgcccatggacagggtgggagcgtgggttctatgcccacccgaggcctaacatattttgcctatttattattttagttaaatactaattttgaacaatttatctatcaattatctttaaaattcaaaaaaatttcgttaatttaaaaaaaagttacgacaaaaagtgatcgaaaaaacttctggtcataactttttttgaaagttaacaattttttttttgtttgcagattattagataaatctaggatgaggaggacaatttctaagccaaaaattcttgtcaaggaaaaaaaatttgttgggggtattatgtgtattaagtgcgcagaaattctaggcatttgcctaaaacgaatcttaatattta

SEQ ID NO: 62685 - DNA, 478 bp, Heterodera glycines
  Genomic contig location: Contig_ID=SeqID_32369; Location=681..1158; Strand=+
  SCN-specific regions: Sequence locations=1-3,28-161,195-335,362-478
atgaaaaaaataattaaaaaaaataatgctggtgtggtaagtgtgaagaactgtgttcctccaggcaaaaaattctaagaaaatttataagcatttgaagagttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcgaaaagggagatga

SEQ ID NO: 62686 - DNA, 54 bp, Heterodera glycines
  Genomic contig location: Contig_ID=SeqID_32370; Location=744..797; Strand=+
  SCN-specific regions: Sequence locations=1-54
atgtcctcaacaaaattaaaaaacgggcgcgaagcgcccgtcttgaggccgggc

SEQ ID NO: 62687 - DNA, 76 bp, Heterodera glycines; identical to SEQ ID NO: 53709
  Genomic contig location: Contig_ID=SeqID_32372; Location=1121..1196; Strand=+
  SCN-specific regions: Sequence locations=1-76

SEQ ID NO: 62688 - DNA, 180 bp, Heterodera glycines
  Genomic contig location: Contig_ID=SeqID_32372; Location=238..417; Strand=+
  SCN-specific regions: Sequence locations=1-180
aagcaattaaaaaattttttaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaa

SEQ ID NO: 62689 - DNA, 1356 bp, Heterodera glycines
  Genomic contig location: Contig_ID=SeqID_32373; Location=29..1384; Strand=-
  SCN-specific regions: Sequence locations=1-519,545-584,814-1356
  Gene Ontology: Mol. function=calcium ion binding; Cellular component =extracellular matrix; Biological process=lipid catabolism
attaccgtaaatgcaatatttgaatgcccactttctaatctctgttgtacctcttttaatctctgttgtacctcttctaatcactgctgtacctcttctcatcattgttgtacctcttctaatcagatttgtaccccttctaataatgctgtacctcttttaatcactgttgtacctcttttaatcactgttgtacctcttctaatcactgctgtacctcttctcatcattgttgtacctcttctaatcaccattgtacctcttctaatcaccattgtacctcttctaatcaccattgtacctcttctaatcaccattgtacctcttctaatcaccattgtacctcttctaaccaccattgtaccaaaacatgtctttaggggttatttgggccgctgatcacgaatacgtgatcagattttacttttgacatcgttaagacctcagaatccctgtgtgattggggattctgaggcatcattttttgggggggggggcaaagttcgaagccggacggtgtacattatttttctttatattttttgggttaattttcattacttttaataaacttaaatgtttggttttattaataataaatttttttagtttaattaaattattttttgatgaataatgattttcatttaaattatttattatatttaattaaagaatttcagctattattttaaaatttaattgtaaaatctttttcatttcaatttaaataactattcaattattatacatttcataatttgtttttcattaataaaaagtgtattatattttaaaaaatgaaaaatataacacatcgattttttatctattttgattaaaaacaattccttaattaccataaatgctctatttgaatgcccactttctaatctctgttgtacctcttctaatctctgttgtacctcttctaatcactcttctaatctctgttgtacctcttctaatcactgttgaacctcttctaatcactcttctaatctctgttgtacctcttctaatcactgttgaacctcttctaatctctgttgtacctcttctaatcactgttgtacctcttctaatcactgttgtacctcttctgatcactgttttacctcttttaatcattgttgtacctcttctaatcagatatgtacctcttctgatcactgttttacctcttttaatcacagttgtacctcttttaatcactgttgcacctcttctaatcacagttgtacctcttctaatcactcttctaatcactgttgtaccacttctaatcactgttgtaccacttctaatcactgttgaacctcttctaatcactcttctaatcactgttgtaccact

SEQ ID NO: 62690 - DNA, 300 bp, Heterodera glycines
  Genomic contig location: Contig_ID=SeqID_32373; Location=1026..1325; Strand=+
  SCN-specific regions: Sequence locations=1-300
atggtggttagaagaggtacaatggtgattagaagaggtacaatggtgattagaagaggtacaatggtgattagaagaggtacaatggtgattagaagaggtacaatggtgattagaagaggtacaacaatgatgagaagaggtacagcagtgattagaagaggtacaacagtgattaaaagaggtacaacagtgattaaaagaggtacagcattattagaaggggtacaaatctgattagaagaggtacaacaatgatgagaagaggtacagcagtgattagaagaggtacaacagaga

SEQ ID NO: 62691 - DNA, 946 bp, Heterodera glycines; identical to SEQ ID NO: 32378
  Genomic contig location: Contig_ID=SeqID_32378; Location=1..946; Strand=+
  SCN-specific regions: Sequence locations=1-44,78-382,405-946
  Gene Ontology: Mol. function=zinc ion binding; Cellular component =polytene chromosome; Biological process=chromatin assembly/disassembly

SEQ ID NO: 62692 - DNA, 399 bp, Heterodera glycines
  Genomic contig location: Contig_ID=SeqID_32380; Location=516..914; Strand=+
  SCN-specific regions: Sequence locations=1-27,49-399
atttggtgtctcgcaatctctgctcacaattttatataatattattttgcaaactgccgaagaatttaaggaaattgctgaaccaaacataacgcgccgttttttgacctttttaatgaaattatttgccaatatgctccattttttgccacaaaataccaaggcttcattggcggaccataaagttttggcccatggatgggattggactttccattttttgacaactgctggccaacaattggcacagttggaccattatttagcagcaagtgccaaacagagccaaaatgttgccaaaactgatactgaacagagtgccaaaagaggcttttggcataaaaattgtactaatttcgcatcgggcagcggaacaaagcagcaaaactgatcagttga

SEQ ID NO: 62693 - DNA, 775 bp, Heterodera glycines
  Genomic contig location: Contig_ID=SeqID_32381; Location=821..1595; Strand=+
  SCN-specific regions: Sequence locations=1-257,279-467,489-651,693 -699,721-775
atgtctgggccaatacaaaaagggatcatcaatgcactcaaagctctggacaatgccaaaagcgccacctcactccttctacaccccgacccggacctgtcaaactgggaaagtgccgtcaacttggaggctcaatttgatcgggtcgtcaaggaaatccgcacaatggaaatgcagatggacagtctacgagattcatccaacgcttggattgaacttctcgcccgcctgatcggagacgacaaagacaacggcgaaaaagaatacgtcaaattcgacaagaatgagaaaatcgccggcgatacgacgcagcgattgtttttatctgctgaaaatacaattaataaaatagagtttaaattgtatggactataatcaccaaatatagacataaaatatggattaaaagctcaaaaatggccaaatattgaccaaaatatagactaaaatgccgaaccgaaatataaattttaattctcaaattttccaaaaaaatatgtttatattcaatatttaatatcagcagacgacagctcttgtctctaataactgtacgatgtacgaatgcgtaaatttatgttgttgttgggaaacattccctaaagagatacagacagatccgggattctggagtgttcaaaaaatgaaaagaaatttaaaaagaaaattatatctttttttatttttaataagtaaatcaaacgcatttaacatggtgttggatgtgaaatgacatttaatgtggaaaagaagaacattgttttgaaaaaggtca

SEQ ID NO: 62694 - DNA, 511 bp, Heterodera glycines
  Genomic contig location: Contig_ID=SeqID_6737; Location=2783..3293; Strand=-
  SCN-specific regions: Sequence locations=1-315,337-511
atggaaactttggttgagcaaattgacgagttgaaacaacttcaaagagaaggagtcaccaaattgaaaggtgtgaaaaaggggcgcacgtgtggaaggaaatttgaaggtatcagaaataaaaggtattcaggtcgtctgaaggtcgattcaacacccattcattggctaaagagaaggaaggtgaaaaggacggacaacgccgaacagaaaaagtgcgtaagtgacaaaggcagggggagaaagggcaattggggaagacgggacaatgagtctgtgactcatccatggccgttttcgtcaataattaaggcatttgatcaaaaacagttttccagggccggacttcgctggaagcgaataaaacggtggacaaaacgcacccactgccaacaaaatggggaggacgatgaatgaagacacgtgatgatactcattgtgctaatattcgccattttcgcattcggaaaagaaagttttgtattatataaagttccactgatttaataaa

SEQ ID NO: 62695 - DNA, 610 bp, Heterodera glycines
  Genomic contig location: Contig_ID=SeqID_6737; Location=1949..2558; Strand=+
  SCN-specific regions: Sequence locations=1-214,236-610
atgtcccgagtgattgtctcctattttcgtcagtattcgctcaaggattggcgcaattattttctgtccacccatttttggggtccggtggccaattggggccttcccctcgcggcgatcgttgacttccgaaaggttttttgacagtttgccaattccgaagtaaatgcatttttcaggacccagagatggtgaatacttttttctgataaacaaaataaatgctgaaaatgctctcttattgtaagatcagtgggccaatgtcctgcgcactgacaatttactcgtccgtttttatgcgatttgcttggcaagttcaggtgaaaaggaaggaatttgggaagggaagcgaaagaaatgacgccaaaagtatttttagccgaggaatatgctccttttcgcctgccatttgacaaatttcgtagctcaacaaattcaggtccgtccctttcctctttttggcttcctttcctctcaatgcattcacttttctcagatcgttcgcttctccaattaccatttcctccatttgtacaccgaccctttcgccaaaacggttaagaaattgtaaaggggacaaaatacgaaagtcgagcaaaggcattgtgca

SEQ ID NO: 62696 - DNA, 2060 bp, Heterodera glycines
  Genomic contig location: Contig_ID=SeqID_6737; Location=3773..5832; Strand=-
  SCN-specific regions: Sequence locations=1-304,326-405,442-506,528 -647,669-944,982-1252,1274-1955,1977-2036,2058-2060
atgggtgttgagtctcctccgcataagcgtggtcaccggtacatttttgtcgacaatattggccctaacttttttgacgacgatccgaacgcgtggggtgctcaagaggacattcatttgctcaactcgctaatcaaagcgcatttggaccaatgggccgagctgagtaaagactttggcaggaaaaaacctctcatggaagcacttgaacgattggaccgctgttttctgcgcaacgaaattggcaaatgcgtcttggccactaaaaaccggtaaattggggaccaacgaaaacatcgaatttaggtaaattttggtttttcatttccagtggcattgtgaacatttgtggcgatgacagcgatgttaaggaagaaaatgcgaatggttgggtgaaattcacaattttgtttcacttctttttagaattcagttgcaatgggtaccaaagtgaattcaaagtatgccattggatatttgttcaatttgggtgcatagataattggttattaattaaaagtttaattgaatgaagtccaattctttttgttgtctaattatttgcagtttatagttcaatcccgaattttgactttttacccccccccccccccctcttattcattctttttaatatattccgctaattaattccctttgaaatgttcagacaaaccacgaagaccatcctcctcctttggatgtcgcttcactgagtttttccgctgcacccacccaaaaacgaagtgcaacattttttgacgaagaggcaacaattatttctgtttttatactaataatgaaaattttgttaggacgactcggacagcgacagtgccatttccaaacagaacagttccgactccgtggcaattgacgagcttcgattgcccccgcgttctgtcggagaaacttcgaatttgacggaaaatcggcgggttgcgttttaaatattttttgttttttaaaattattatttttgagaaggcaacgcgaaaagaacaattgctggctgtggctaaaaatgcggcggtggaggcattccgtggacaaagaaagacatcgctcgaattgtctgaggcaatgaattcagtggaaaatgctgggaaaggtaaggccaaagtgacccatgttaccagggaaacgacttcccttcccgaaatttaacaaaatgggttaaataggagtaaagaaacgcaaaaaatccatgcttgtcggagggcaaacgcagaatttggagttcctttttgaattcactttcttattcttggtcagatttttggattattcttttcagtctcatgtgacggtgtacacaataattcagcgatttgtgacgagaaattggccgaactttacgcctcttctgcttgcagtccgtacttttacaatgcaaaagtgccgctgatgaaaccccaaacggtggccaaatttgacgaggaggacctccaattgctcacttatttgccattccgtgacgaattcgaaaatgttcaaccaaccttttgctttttggtgtttatttattttttgaataggagtacaaaaatgatgctgagcagctgatcagccgaattgtattcccacgagaaggagccgatttgggagaagtcgacaaattcatcaatggtgagtttccacaccttctcattctcaagtgcattagtccataaaatgtatctacaaagtttcgagtaatggctttttgtatgacaataaattcccctttcggcaaaacaccctaattcttttttcggattgactcggccctccaatcccttaatgtactaatccaatttcatctgtttgccattattgtatctgttttcagaggtcatttatgccaggttcgatcggtacaaccgaataatgcgaattaggaccaccaaaaaagcgatcatccgcgagcacaatttgttgaacgaatacttaaacattgttaaggtgatgagcggttattcaagcaaagtataaattgattctttttcagacaaatatgtcagaaaagggaaagtacgccgtttttgaaggcaagtaaaaagtattctattttaaataaa

SEQ ID NO: 62697 - DNA, 1046 bp, Heterodera glycines
  Genomic contig location: Contig_ID=SeqID_32384; Location=58..1103; Strand=-
  SCN-specific regions: Sequence locations=1-207,230-529,587-638,660 -670,692-1046
  Gene Ontology: Cellular component=lysosome; Biological process =embryogenesis and morphogenesis
acgccgccattcagacgccgtgtacgcccaacctttacgcggaggaacagacgaaacggaagtgccggaaggataagtgccaaacggcatattacaaaaacagtgccggaggggaatacgcggcggacaagcgaaagggtgggccaaccaattacctaactgaacattggtcaatttgggggctattagaacatcatatttcatctcttttcacattttttcgttaattatccctaattacccctctttccactaattacccccccccccccaccctttttaaggttccttcgcttacactttgttcccccgcaaaatgagcgtcgaccaggcgggcaatgaccgcgtccttttgccttcagtggtcggccatttcaacaaaacgtcgtccgccggccctctgacgatggaacaaattcggacgatcatccgcaaggagctgtttctgtacgggcccaccactttggcactgccgctgaccgaagaatttttgcattacgactcgggtgggcaaaaggggcgcaatacgtaaaattatttgaatattttttaaaaatattaattcaacataaaattttgaaaaaatcgctgaaaaattaaaaaaaactttcgcggtggggggacaagctgctccggggcaaaagcctacaaataaatggaacatttggaattgaattcatttcccatttgtgctttcttcaatttcatttcccaattccctcaggcattttccaccctttcccccgccaacactttgacgaccgtatcatttattggcacgtcgtgcggctcatcggctggggccatgacgaagacgatcatctgttttgggtggcggtgaacagtttcggagagcaatggggcgaaaacggtcggatttgccaaaaattagggaacgaaaatatcgggaatgaattttggtggcaattggagggcattgtcagtcttaatgccctgttcaccgatccctcccatggccaggctttttccgcgtggacacttctctgctggaggactacggactcgagtacgaagcgggaatgcca

SEQ ID NO: 62698 - DNA, 441 bp, Heterodera glycines
  Genomic contig location: Contig_ID=SeqID_32385; Location=543..983; Strand=+
  SCN-specific regions: Sequence locations=1-10,32-441
  Gene Ontology: Mol. function=transcription co-activator activity; Cellular component=nucleoplasm; Biological process=chromatin modeling
atgactccgccccacccgcaccatcgacgccagcagcagcaaatgccatcggcacagtctgtcggcagtgccgcccaatttggacgacaaccattcggagccggcggtgggccgataatggcgaacaatgcaatcgcaaatcgaaaaaagcgcagatttgccgacaaaatggtggcaccggaggtaaaaatgggctcggatgcctaataatgtcattatttgcaattgccactgcttattgctcatgttttttcacagattcgttctttgatgcccgaattggatgcttacgtcggccttttgtcctacgagcagaaattggacgcgataatttcgcgtaaaaagatggaaattcaagaggcactgaagagacccatgaaaatcaaacgaaaactgcgcatttacatttcacactcattcattcaagcacgggaacccgag

SEQ ID NO: 62699 - DNA, 252 bp, Heterodera glycines
  misc_feature (244)..(244): n is a, c, g, or t
  Genomic contig location: Contig_ID=SeqID_32387; Location=1..252; Strand=-
  SCN-specific regions: Sequence locations=1-108,134-216,238-252
atggagaaggcctgcaagatttggagagattatatcgattttaatgcgctaggttcgatgaaactttttaaaatataagcctaaactttttggcctgtttaaaaagggattaaaaatttttaaaaattttattcatcttccttttgatagaaaaagcatcagagagccttatttaacttttaattaacatttggtgcgtttcagagcacgttctaaaaaatatttatgaattaattttgcaaanataataaa

SEQ ID NO: 62700 - DNA, 234 bp, Heterodera glycines
  Genomic contig location: Contig_ID=SeqID_32389; Location=53..286; Strand=+
  SCN-specific regions: Sequence locations=1-234
caaattttctgacgccgccgttgcccaaaatggcgacgatgagccgcaacagtcgccggctgacccggaacaagcggacggcgagtcggagcaggcacagcagcacaacccgctgcagtaccggccgcgaacgcatcgccgacgcattcgaatggcggcgatggctgccggcgccgggggcaatgaatgaaacgctaattaaccgacagattaattaccaatattgactaatta

SEQ ID NO: 62701 - DNA, 234 bp, Heterodera glycines
  Genomic contig location: Contig_ID=SeqID_6739; Location=237..470; Strand=+
  SCN-specific regions: Sequence locations=1-234
atgttcaaaatgtatgagggcgaagtatgtcagataaattagttttttctttattttttgtctatttattattacttataggtgctgaagaagtttcctgtcgtacagcactttctttttggtagtctcttttccattacggagcgtaaggatggaaagaagaccgactcgtcaggattggataaaatttcccatggattgcatcccgcgaaactcggaattattccagaatag

SEQ ID NO: 62702 - DNA, 1139 bp, Heterodera glycines
  Genomic contig location: Contig_ID=SeqID_6739; Location=865..2003; Strand=+
  SCN-specific regions: Sequence locations=1-223,246-285,313-348,370 -566,588-890,912-925,947-1139
atggacacaaaaaagttgcaacaattggcttcaaatccgacggtggtggcgcaatccaacggaccaaacgaaggcaccgcaaaagacacaaacaatgataacacttcgatcacatcaactcgggagaaaatgctcgaagtcgtttatgggaataagctaatgggaaaggagaagcagccgaaatttatgtgttttgttgtggatgcgcaggaaagaaaaattaggataatgagcagagaggagcagaaaaaacaggtaaaaaaagaccggtcgtgagttttttaaatatgggcaaaataatattttattaaacgcgttttaatttattttaggagagttccgccatcattttggaagaccttacggatgaccaattttctcggtttggcaaatccgtcaaggacaaagaggctgataactccgacgcattcgtccattgtgaaaaatgttctctgttctacgaattctgttgccttgatcatccgctttatcagtgcaaagatcgggtgccttcgtcttctcccacagaaattgaggacagagcggcggccactcttcctgcctttctttttattcagaattcttcaattccctccgctgggaaaggtgagaattaattaccttcatttattttaaatattctcgtgaattgttttaaggagtgttcaccaaagttgatattccaattggaattgtgtttggtgcgttgtttgttttgttggctgtcgtttttgttctttcgacattaaaagtttccattttcaggtccctacgagggcattctcacacaaaatttgtcggaaatggaattcggtgcttacacatgggaattacgtgtaggatatggaaaaccttcctattacattgatggttagggaccgtcctaattattcttttatttttcctttttcagccaaagaccctcgttattccaattggatggtaaagtttattaggtaattaatttgtctacttttctctttcgtacagcgctacatcaattctccgaggaatgagtcggaacagaatctgatcgccttccaataccagggcagtgtgtattaccgcgtctttaagcccattgaccgatcttcggaactattggtttggtaaaatatgcaacttcgggaggaaggcaa

SEQ ID NO: 62703 - DNA, 1817 bp, Heterodera glycines
  Genomic contig location: Contig_ID=SeqID_6739; Location=5028..6844; Strand=+
  SCN-specific regions: Sequence locations=1-418,447-595,619-619,660 -720,816-946,1005-1005,1050-1121,1332-1343,1365-1817
  Gene Ontology: Cellular component=integral to membrane
atgagtggtcagatgtggaaccacatccgtggcccgccctttgtgatgactcacccccaaacgcgtgaaacttcgctggtccacggcagcactcagtaccaactcattgccgagacgtacatcgttctctcattgtacgccgccgtcacccttggcgtcgtcgtgttaaatgatgctgcctccagcaaaacggaccccgggaaaagaaagcgtggggatctttcaccatttggcaccgttttttattgattcaattcagttatggcatgcatcggaataggactggttgtggtcttcttcagccttttgctttcagtgtttcgcagcaaacatcacggatatccgtaccattttctgtttagttagaaagacgtgggaccgatgttatgtgaattttgttgggttacctaatcttgtcttatttattgtaaaattttaattttattcatttgtttatttgggcctaataaatcactttctgtctattcatttttgtccgtggcaaatttctgattattcgtgtcaatttatttttcattttttttatctacccaattcttgttaatcatttcgatggatgtgcaactcaattttctgcaacacgaaccgaccgccaattggcttgattattttttggagcggaaaaagctttcagagctactcagacgaaacccaattggtcttacattattgcatttcactttaatttggcttttttcagaccgaattgcagcgatttcgttttgtgaccaattcgttgaacaggctttggtcggtgaaagagatttggcgacgatggagagaaacaatgcaatagagaaaggtgggggagggacatatgggggcggggacgtcttggcaaaatgtacaaagtccaacatgtatcgtatgttttgccattgccctgagatgggaattatgtgttttacacatatcgactgcgtttaagatgatttcatgagcacacattacaaaatcgaagacctttggctgtgtgctctcagttgttttgcagcgtgtgattgggacttgtcgttgctgatcaaaaagtcagtcggagagagggattggttgggatttgaccttttcaataccaatagcagcagattatcccttttcagttcgaatgccatccgagtgggcgctttgttaagccgtctcatccgatgggcttttgaatccgatttgagttcacagagcagaactctctttgcggaagagcctttcaaatttctgaattctttcgaccgagttggcgcctcgagacttttctccggatggctttacgctcgttgggttctcaaaactgatttggatggccgattccctgtctgttcatttatttattttgttctaactcattttaaaggttcctcccgcacggccaacagtcagcaacccgtaagtttcaagagcagcttaacaaacatgaagataagatagctacgcaatataactaaactaacaatttaacggcccctaaaaaattcacatgaaatgcaatttgcccggcaccgaaactgatcagaaaataaggattctttgagttaatatttctttggcttcccccccccccccgcccgttacggtcattcgttatttgtcacctgcttgtttctttcagttatttttctgttgatcagtcacttcttcaagccgaacggttgtcccaagtgactttggaagtgcgcagtcgaatgggcgaagcagtgaactttttgagacgaattgtcaacgaccggcgacttggagacgacgacaaagtggaagtgcccggaatgatgtgttttttccaaaactttgacatcacaacgaaa

SEQ ID NO: 62704 - DNA, 619 bp, Heterodera glycines
  Genomic contig location: Contig_ID=SeqID_6739; Location=5124..5742; Strand=-
  SCN-specific regions: Sequence locations=1-56,97-97,121-269,298-619
  Gene Ontology: Cellular component=integral to membrane
aaagccaaattaaagtgaaatgcaataatgtaagaccaattgggtttcgtctgagtagctctgaaagctttttccgctccaaaaaataatcaagccaattggcggtcggttcgtgttgcagaaaattgagttgcacatccatcgaaatgattaacaagaattgggtagataaaaaaaatgaaaaataaattgacacgaataatcagaaatttgccacggacaaaaatgaatagacagaaagtgatttattaggcccaaataaacaaatgaataaaattaaaattttacaataaataagacaagattaggtaacccaacaaaattcacataacatcggtcccacgtctttctaactaaacagaaaatggtacggatatccgtgatgtttgctgcgaaacactgaaagcaaaaggctgaagaagaccacaaccagtcctattccgatgcatgccataactgaattgaatcaataaaaaacggtgccaaatggtgaaagatccccacgctttcttttcccggggtccgttttgctggaggcagcatcatttaacacgacgacgccaagggtgacggcggcgtacaatgagagaacgatgtacgtctcggcaatgagttggta

SEQ ID NO: 62705 - DNA, 78 bp, Heterodera glycines
  Genomic contig location: Contig_ID=SeqID_32392; Location=1253..1330; Strand=+
  SCN-specific regions: Sequence locations=1-78
gtccaatgaaatcatgttcctcatcggcaagtacttgttcgacaggtgacacaagcagtaacacagaggcagcagaag

SEQ ID NO: 62706 - DNA, 690 bp, Heterodera glycines
  Genomic contig location: Contig_ID=SeqID_32394; Location=169..858; Strand=-
  SCN-specific regions: Sequence locations=1-103,125-489,511-525,547-690
  Gene Ontology: Mol. function=heat shock protein activity; Biological process=response to heat
atgtccataaaagtgccaactttggagggtgacatcattccgttgaacatcaagcacgtgaccaaacctggcagcacacaacggtgggtttcatttggatttctatcaaggaatttggctaatttcgagctcgatgtatgtgaacttaatttcctatcatttcaaaataacaaaaactcccaaaaacaaacaaaaaacagaccaaaaaaataaaaatacatttataggtttctcaagttttttaaaggtaacttctttaaaagtgttgaaaaaaggaatcttggaaaaaattatgtatcgacataaaaaagtttaaattgaaaatgtagacggcccaggtaattaactgacaaacaagcgttttgataaattttactgaatttatggacttaggtaaatgtaaaaaggtggacaaattttgtttactttgcagcgcccttatgagatgaatacaattaatagtggagttttccccccccccatttttcgaaaaatttcttttgtttttaaaaaggacacgtatactttcccttatcattatttcctttttccagaatccacgatcgtggcattccgaaccctaagacgggcaaacgcggcgacttggtggtggagtttgacgtgcgcttccccgattcgatagcgcctgccgcgcgggaactaatcgccaatgcattgccaccaaactga

SEQ ID NO: 62707 - DNA, 1316 bp, Heterodera glycines
  Genomic contig location: Contig_ID=SeqID_32396; Location=5..1320; Strand=+
  SCN-specific regions: Sequence locations=1-297,321-528,551-738,761 -903,926-948,977-1316
gcgccgttcggtcgattacgacacgacagagacgggggcggatggtcgccttttgattaatgcgggaaagcccgactcggacccggaagtatttgtggcagaacatctcacaaatgttcttcagcctcatcaaattggcggtgtcaagtttatgtaaggggttgagagaaaaggcacagaaatatgtggcatttaaagcgagtcagcttttgctttcttaaccaataccaaggtttaccaaaaaatcgttactcgattcggcacttttgctgtttagggccccaaaaaaagttcaaaggagcgacccttttgtagagatttggaattggttgaaatagcggtatttatcccttttgtgacaccctctaaattttttttctacgataattataggctctgaaaaggaatctgatccatgcattttacgtgagaacatgaaaatgcgtgttaatttaaaataaatttcttgttcgttttcagcgcaaaaaattaccctaaaaaaatttaaaaaaacttccgaaagggattcttgtttttatttttgttcttagaagcaaaggcttttctgaaattggctctcgttaaggtacgacaacatcatcgaatcgcttgaaacgttccacaagtctgcagggttcggatgcattttggcccatagtatgggtcttggcaaatcaatccaagcgatcacttttctcgaaattttgtttgttgaaggacctaaaccttcgatatatattttttgttttagcattcgaattaccggcaaaaggcacgtgttgcttatttgtccagtgaacgttctgcaaaattggcacaacgaattcaaccgatggatgccagaaactgacgcggagacggcgcggcccattcggcactttgaactgtttgtcattggtgactcagtgaaaacattggaaaacagagcgcaaatgatcggtgcgtaggaaaataaataacattcattttaaaattatttattcagagaattggtatcagtcggggggcgtccttctgctgggctatgaaatgtttcgtcttctcgtccaccaatgtgaacttttgggcgaaaagagtgcgcaacggaaaaaggcatccaaaaagcaaccgttgcggacgatgtacgatttggcggacgatttgggcaaaaccaacgagcaggaaaaggcacaaatgacgcagaaggacgaattgcagaggaacatccgccaggctttgttaagcccgggccccgacttggtcatttgcgacgagggacaccgtatcaaaaacctgaacactgaagtgtcatgtgcactctccgcaatcaacacaaa

SEQ ID NO: 62708 - DNA, 691 bp, Heterodera glycines
  Genomic contig location: Contig_ID=SeqID_32397; Location=576..1266; Strand=+
  SCN-specific regions: Sequence locations=1-77,99-140,164-311,342 -380,503-596,618-650,686-691
atgtcattattttatcaaggaaaaataaggtttgtggcaaagttgtcatttttttacagaaatctgttaacaattcgcattaacaattacaatgtttttccggtggagcctaacggcaccgccggaccctatcccctcgcccatttcccaagtttcttaaaaaatgcgccgcaaaaaaattgttaaaattttaatttgttgaatgcactaaaatttacgatttactaatttcctcccaaatcggaagcaaaaaatataatatttaaacagctttattataaataactcatgcttttttgttgtacgtaagctatttatattcttaaatatttaaattatttgtgttttttttttgtttagcataataaataacactctcgaatttattacaatatattatattcgtttattaagtttttttatactgaatttataataataaaattaaaatttctatttttgggtaaatatgttaataaatttatattaatatttttaaattccagtgccaaattatttttattttttatctctaagaaaacacttaaacataactaataattgagttttttaataatataacttaaatctgtccagagtttatgaacacattttgaataacttttaaatttttcatattatttcaaaccaaaaattaatcatttttaatatttaattattataagaaata

SEQ ID NO: 62709 - DNA, 897 bp, Heterodera glycines
  Genomic contig location: Contig_ID=SeqID_32398; Location=304..1200; Strand=+
  SCN-specific regions: Sequence locations=1-271,293-897
atggaaacgagacatgcctacccattaccatgtgatttgttggcgagcactcacctggtcgagttttacaatgcacacacaccatctgacggattctttttgcgtttattagaacacgaaagtcaattgaaacacgtggaatcagaattgaggctagtaaaggctaatgaactttgaacagagtttacactacacttctgtccatttcacatctttcctctttttcaggcgatttgcccgatttccccgggaagaaagagaacgctatcgacttcacaagaatttcatctttgagggcacttgctgtttggtggttttcgaccacaatgtgttttcaacggacagaaacggtgaacataaattaatggaacgaacaaacgatttggtggtgtgcaaccgatgggtccgtcgttgtcaaattgttggccaaagtaacggaatggcaatggtaagtcaatgtacaagaacaagtaccggtcttaagttgctttaaatttttttcctgaattcagatttctttttgttcaggtccaatgcgtggattacccatacatcggacttgtcgatttgaagaatattttccaggtgacaattaaggtatgttccattaaactctgttttaatctcagattccgccttctctgctgggcatttaccaaaccggggtttatgccgttctcaaagactgtcaaatggcttctcaaattgaggtagcaagacatttatcacagtttcttttcacaacagtaatttgttagtgcgagcattggaggagagcggttgaggaattggggtcggaagattttcggttggtagcacgcttttttgagaaagcagcgcgaattgactacagcggacgcaaaagatttggaatttttaccgcgactgtttcggtaa

SEQ ID NO: 62710 - DNA, 60 bp, Heterodera glycines
  Genomic contig location: Contig_ID=SeqID_6740; Location=306..365; Strand=+
  SCN-specific regions: Sequence locations=1-60
gctgaaattgatccaaatggatgtcataaccgtgttcagcaacctcaaaaccccctataa

SEQ ID NO: 62711 - DNA, 900 bp, Heterodera glycines
  Genomic contig location: Contig_ID=SeqID_32403; Location=322..1221; Strand=-
  SCN-specific regions: Sequence locations=1-62,85-392,426-452,567 -629,655-780,835-865
atgaaccgagggccgcttgcttcggtgtctgaccctgtttcgccagcatttcgaaatgtgtcattaataactggacattgacctcctaataatttactaaaaattaaacattatagtgctttctatttttgtattctccaacaatttcaaatgttacgtgtatacaattaataaattgttcagcatctcccaacgaggtggtggacgccgcgcaccgtcgtcatgctgcacataatgatccggacccacacccgttccagcttgagagcgcccatgtgcagactggcaatgcgctcccacaacaaactgtttctgttgaatctacgcaacctgttgcatcccaaaaaatggaaaaaatccccagactttcatccgaagttttaaacgcttttataaaaagtaaaaaataaataaataaataaatatttacaaaaatgtatataattattaagaaaataaaaataaaaaaccattaaatacaaataattaaattaaaatataaatttaaataaatattaaaaataatttaaattaatttaaaataacaattgaaaaataataataaatggcgttttagccgatttcacaccttttttcgactacacctctgacatttggatggatagtataaaggagaaggaaaaggaggaagagttggaggaaggggacaaagaaaatgccccgattggaggttgtgccaaattggcacaaacaaagtgcgcgaaagggggacgaaggcggcaaatttatgagaaggatgtgcaacgcgtaattctcgccgataaaaaaatgcgagaaaagaaaaaaaggaaagagagaaaaaagagaagaaaattattgagcaatttatggggaaaaagaaaggttaaaataaaaattaattagatatttaaaaataaa

SEQ ID NO: 62712 - DNA, 588 bp, Heterodera glycines
  Genomic contig location: Contig_ID=SeqID_32404; Location=676..1263; Strand=-
  SCN-specific regions: Sequence locations=1-149,189-226,248-271,400-588
atgcgtttttgttgtcggaggagccgtagaagcggcggaagagtaaacggaaagagtcaaaggtacagcgacaaaatgcaaaaggcgaagcagaagaagcaaaagcaaaaggacaaactgagaagactgaaaacacagagagcgcagggacacatcgatgacgagcagtacagggagaagaagaagaattacaagcagaagaaggacaagcaaaagctgaaggcacgcaaaaacaaacgcaaactgaacaatgggcaccaacaaatgtggtgaaaggagagaaaggaagagaggaaacaaaagttggagagacaaagggaagtgaagagagagagagagagaggagagtgatcgcatggaaaagtgacaggacggaagagtaaccggaggagagaagagtgatcgcatggaagagcgtttcgacagatgcaaagggagtgacagaacggaggagaggagtgatcaaaaaggaggcaaatgaatgttggaaaattttatcgttcggataaatgtttcacagtacaaaaagaattaatacaaaagagaaacgaacgctttgatgacagataaatgggtaaagaaattaaa

SEQ ID NO: 62713 - DNA, 1013 bp, Heterodera glycines
  Genomic contig location: Contig_ID=SeqID_32406; Location=221..1233; Strand=+
  SCN-specific regions: Sequence locations=1-136,160-299,321-464,488 -834,856-892,984-986
atggacgataattttgatgtgaacaactttggtcaggttgaatcaggaattgaccgtacatttgctgatcaagaattgagtccaagcagcaacgagagcatagagaaatgtattgacgattgcatcacataaatactttattttctttttagatgatatctgggcccaacgaaaatcaccatgtggtatttctattccctcaacaatttccggagatcctgactctgattttttatcaaaaattgaggctgaacttgcttgttttaaggcaggccaaaggatggaagtgaacggagacttattttcctggtggaatgaaaacactggccgtcttcccgaattgtcaaaacttgcaagaatggtccacagcattcctgctacatcagtcagttctgaaagactgttctcaaaagctggacttatttttgccaattcacttcgaaataggtcagaaatcaataatgtattaatttattttataatttaaggctttccggcaatactgtgcgccaaattttgattgtgaaggccaatttggacgcacttttactggcaccaacaaatgaatatgaatcagatgaggaaagtaaagaaaaagacgatttttgagttttgaagactttatttactagcattgaaaaagaaaaattattattttttggttaaaatataaatttgatcatcccccgaccggggtccccgacccccgacaattgagctcccccccgacccgacccccgacatgtcgccccccgaggtccccgacccccgactttttgccccccgagggctcggggcttaaccctagtttattcaaaaacttacaaattttcatttttatgagctttttaaaaaatgaggttttaaggagtcgaaacaaagattttttccattatttaattattttaataatttatttcattttttaaattagttaattttacattttatttcttttttttctaattttttatgttattttaaacaattaaataattattttaattaaatta

SEQ ID NO: 62714 - DNA, 1255 bp, Heterodera glycines; identical to SEQ ID NO: 32408
  Genomic contig location: Contig_ID=SeqID_32408; Location=1..1255; Strand=+
  SCN-specific regions: Sequence locations=1-111,133-887,912-1044,1074 -1179,1216-1255

SEQ ID NO: 62715 - DNA, 46 bp, Heterodera glycines
  Genomic contig location: Contig_ID=SeqID_32411; Location=515..560; Strand=+
  SCN-specific regions: Sequence locations=1-46
atgtggggaggttacggtggtggttactacgacggctatggctacg

SEQ ID NO: 62716 - DNA, 1680 bp, Heterodera glycines
  Genomic contig location: Contig_ID=SeqID_6743; Location=2006..3685; Strand=-
  SCN-specific regions: Sequence locations=1-314,337-471,507-535,559 -616,638-894,917-1240,1422-1536,1558-1680
atgcctatggagcatcgggcattgcacttctatttgtggtgtttttcgaagtggttggcctggcgtggggattcggttagtttttttcgaatttactaaaattgatttcatttccgatcccatcgaattaattaattaattgacaaatgtttaatgaattaacaggcgcacggcgtgtccgcgctgctctgaaggaaatgattggcatttatccgctatccttttttaccttactctggaaatacacagccccactgagtgcattggtaataattagagctcggtattttgaaaaaagcctggacctggacctggatttcctggacaaattccaggtccaggaaaaatccaggctcttcgagacctggatccaggcctggacctggattttttgaaatttgttctaaaaagcaagcaaaagtttgaaaaaatcaattaattgcttgggaacatctaaaaatatctaatttacactaataatctgtttttaaatctattaaacattttttgaaaacttggaaaaaacatcggtcacttaaaataataaattctaaaattttgtccaggaaatccaggtgttttcctgttttgcctggacctggacatgggtttcctggacaaaaatccaggaaaatccaggtccaggaaaatccaggcctgggtccaggtccaggccgagctctagtaataattaacttttattgccgatttaccattgtttgtgacaaggacaaagccgagtttcggccatcacaaagttttaacggctcgagtgaaaaagccaaaatttggctgtgaagatgtttgcctaatttatgaattgaatgaaattttttgccatttttcggcgaattctccacgcttcaaaccttatgcctcaaccccaaattggggtccaggcacaaattaaattgtaatgggcttcaaaagtcgaatttttgttgcttgaatttaaatgtaaagaacgcattcaacaaaaagaaactattaattaaacaaaaattgctcagattttgttcatttgctgcttggtgatgtatgagcctctccgctaccccacgggtgtcgactaccccttttgggccgaggcgttcggcttcttcttgtccgcctgctccatggtggtgattcccggctacgccctctactacatgtgctgtgctggccaagacggggaccgtcgtctcagcccattacaagtcattaagaattaaaaaaaaaattcaaaatttcctcacattctctctctctctcattctctctctcattcgctctctctctcattctctctctctctctctcattctctctctctctctctcattctcgcgctctctctttctttctttctttctctctctcactccctctctcttctctctcactctctctttctttctttctctctcactctctgtctcattctcgctctctctctctctctacacttaattaagcaataatttttagaaatcccaattataatttttaatgttcatagttcatcacattttttgacttggtccatttattgacctttaaacattcagaaatttcgtcagggcattcatccgcctcaagagtttgactttggccagagttcaagacgtcgtcctcaccatggccaacatgcaaacgacgaagaattggaatttattgataagcgaccaattaaataaa

SEQ ID NO: 62717 - DNA, 1946 bp, Heterodera glycines
  Genomic contig location: Contig_ID=SeqID_6744; Location=588..2533; Strand=-
  SCN-specific regions: Sequence locations=1-541,586-698,736-867,889 -976,998-1186,1238-1376,1419-1690,1727-1769,1792-1946
  Gene Ontology: Mol. function=betaine/GABA:sodium symporter activity; Cellular component=integral to membrane; Biological process=transport
atgccaataaaatggtttacgaaaaaccggaaggcaattaacgaagaaatttcttcaactgatgggaaggaaaacactgctgcgttggaaggaaagcatgataaaggtgaaaaagggaagaacaaacaaactatatggggaattaattattgaaacgcaaaacatgcttaattattgccaaatttaaaaaggtgtgaacattcccgaaattgaacacccgacggatccgccgtcggccaggaaaatctctgtgcttggcgctgaatcggttgaccggggccaatggacgggtaaatctgataactcgaacttctatagtggcaaatttattacataattatgcctattaagtgaatgaattaattgccactaaaaactcggaaaatgaaaataattaaaaatggcataacaaaaatatttttggaaatataatttgttttacctcttaagctttcaaaaatgaatgaactgaaaaagtaaacgtaacttttgaagttttcatgccttgttgtttaatctacttggaatataacagaaaaactaatttaaaaaataaaaataaataaaattttaattcattaatttctgacgcaatacattgaaattttcattcacatagcacaactcatttcggatattaagaaaaaactcaatccactcttctgaaattttatgaaaaaaaatcccaacgaaagatcaaaatttcaaaattatgataaaaaataaatttttaatcttcttctgaattaattttgttactgattgtgatcatccttttctcttttttataggacaatttgactttctgatgagtatgattgcgtacgcagttggcctcggttaattcattgttttatttttttccggtataataaattattattttaaggaaatgtttggcgctttccgtacctttgcttcaaaaatggcggaggttaattaattactcggaataattaatttaactctaaaaattatttaatcacatttgaaaatgctcataggctcgttcctcgttgtttatgcacttttcttcacttttggcgctgttccaattttcctcatggaagttacggtcggtcagtacctacagagaggtaaattacggtatgccttggtgaaacattttttgttaaattactttcaggagcaatggaaatgtggaaaatgtgcccaattttcaaagataaaaatttcattgaattttaaatttttttcctaaaatatattatttatacatttttgcctttttcaggtgttggcattggcaatgtgatgatcgcttttatgtgcatttcctatttttgtgtgattgtttcttgggccgttttttacatgatcagctccttcaattcaacatttccgtgttcgttatcattttttacaattattaattaactttttttttttgtatttaaggggagacgtgccacaattggtggaacaatggccaatgtgtgacggggaaggaaacgcactcggagattatgcgaattgcgtcaaatttgtcccgctatgggatgtccattgagtcatccgtggaacaattttgggagtaagcggcggaaggaaacatatttttttaaataaatgatatttcgtgatcaccataaaagggcttttgaatatttttttaaacgctgaaatttttgtttattttttacatcaattgagccggcacaacaacatcttaaatttttgttaaattaatttttttatttttattcaaagcctttcccaaccaatttcacgcaaaatgtaccaaaacactgccattttttctccattaaatccaattgttttttttcttcaggcgacgtgtgctaaagcaaacgccgtcaattgacgacattggcggcatccaatgggaattgctcggattgatgtttttggcatgggttgtcgtgtatttcgctttgtggaagggcatcacccaggcgagaaag

SEQ ID NO: 62718 - DNA, 270 bp, Heterodera glycines; identical to SEQ ID NO: 57108
  Genomic contig location: Contig_ID=SeqID_32412; Location=566..835; Strand=-
  SCN-specific regions: Sequence locations=1-270

SEQ ID NO: 62719 - DNA, 65 bp, Heterodera glycines
  Genomic contig location: Contig_ID=SeqID_32414; Location=90..154; Strand=-
  SCN-specific regions: Sequence locations=1-65
atggacgccgccgcctacggcactcatcggccgtttcgttcggcttccgccttcagcacttccac

SEQ ID NO: 62720 - DNA, 555 bp, Heterodera glycines
  Genomic contig location: Contig_ID=SeqID_32415; Location=446..1000; Strand=-
  SCN-specific regions: Sequence locations=1-363,386-451,505-555
atgccatcactttggggtagggcatgtggaaaaataggacccctacacttttagcggtgccaatgccaacgcattttgtaatcaaaaaattttgggtataaaaatgccatggaatgccgaaagtgccgagcaaagggggaggatgaggatgccaaagccactattggccgattatttgatcgcaaatactgaaattaaagaacacggactggggcgaggacggattcttccgcattttgcgtggctccgacgagtgcggcattgaaagtggcgcggtcggcggagtgccggacttgggacgtaagtgcaaatgaagtcattattgtccaacataatcgagtttccattcgtcaaaattataatctttttgaaaatttgaattttttaaggctctccgtccgccggtggccgtgaggaaacgaacaacgaaattgaggagcaaatggacgacgaggagaagggaaaagaggaggaagaagaagagggggacgaatgggaggaggaaatttgaaaatgcgaaaaatgtacaccaatttcattaaaatgaggaataaa

SEQ ID NO: 62721 - DNA, 168 bp, Heterodera glycines
  Genomic contig location: Contig_ID=SeqID_32418; Location=378..545; Strand=+
  SCN-specific regions: Sequence locations=1-168
atgtgcccttgtttaaatggtgcgtcgacgctgcaaagtctgtgccgtgttggacggagtgaatcatatagcgtaattgtcccaattaagcaacgcgggattggacggcacatcgtctgccatttgcgggtgtatctccggattcatacagtcggcacttgccctcag

SEQ ID NO: 62722 - DNA, 851 bp, Heterodera glycines
  Genomic contig location: Contig_ID=SeqID_32420; Location=279..1129; Strand=-
  SCN-specific regions: Sequence locations=1-62,84-286,325-851
tttttaacaaaggtctttctacgctttttccgctgtttatgtgaactccgccaaaaatgaagcgcaaagacacatcgccagagggtaaaagtaaatcattgatggcaaaattgaattttgcatgaagaccatgaggagttttgctgctccgtcgtggacgctttgctcttttcgtgcaatccgacgaattgccaacgcgttttgcagaaatttgtggaccattgtttcgagaagatcgaccgagccgtggaattgtttctcaaatacaggcacttttctatccaattttaattaataagaaaagaaaaacatttcagtgagaaagtgcgacggtttgagacaaaaatggagcgtcgaatggcttcattggctgaggaagaaaagccggacactgaggaggtaaataatgataatattcaaaagacgaattgaacaagtacagtttttcactcttcgggtttcgaatgtccttataattagtctcttgttcgtccttgtttataatctgtgatttcagctttatttggagaagttgaacaacggattgtacactttgcagagggcggcgctgattttagccgaaatttgcagcaaaggagcgcccgggtgccacgaacgggtggagaaactgttcaggttgcgactcggcgacggatcggtcggcaaacagttggagccggtcagttgcctccttctctgacttatttcgacgctacaatttttttttcatttgtgacgcggttttggattttcagattttgcgcgagtttcaccgttatttggactccgaggcggacactcagaagcaaagggttgagctgctaattgcgcacttcactcaaaaatagaca

SEQ ID NO: 62723 - DNA, 1245 bp, Heterodera glycines
  Genomic contig location: Contig_ID=SeqID_852; Location=1572..2816; Strand=+
  SCN-specific regions: Sequence locations=1-23,50-91,117-1245
atggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtagtcagtacctaattaagctcggccctccggtcaccaatacctcacaaggctcggatttccggtagccaatacctaattaaacttggcccgccagtaaccaatacctcgtaaggttcggcactccggtagccaatacctaattaagcttggcccgccagtaaccaatacctcacaaggctcggctctccggtagccaataactgagtttgcgatggtaaggagcaataatgaccgaatatgtgttggagaggaagggcagagttgaggaaaccaaataagtgaaggagagggggtgaggtcactgcgtcatcttatcctgtaaatcgattcctctaaaaggaacaaatggaaagaggctaacgccaactgttttcttaacaaaatcctatatttagatattttggtttcgggtttattttaattattttccttttctccgtaatacactttctctactcttctatatctgtttactttcactgttattccttattaatttcagacctacatattgtctaaataatcgtttccattagctatttttcaatatcttttcttccaacactatgttttattctcgaaccgttatcttccaagtgttcgtattcttgttctttatcaaactattctcttccctatacattacctaatgtttgccttactaactcatattaaattctcactatttaatattgactctcttcaaccacatttctgagttctctatctctatctcttacacccattattaattgtccttgattctatggtgcagtacaatatcctcatatgatttcttcatttattcctattacaagacctgcttcacgcatacatttagcccttatctaccctttctcgtcacatacagtcagttagctgtttgtcaaacctactttctattctcggttcaatcttagattcaaaattgtctatttctcttgtttcctttgaatattacttattcaatggaattgtaaatgttccttattataattagaattattttacgttgaattaggcaaggagcattgtttgtgtttatgattaaaattaacaagttttatataagtta

SEQ ID NO: 62724 - DNA, 1401 bp, Heterodera glycines
  Genomic contig location: Contig_ID=SeqID_853; Location=308..1708; Strand=-
  SCN-specific regions: Sequence locations=1-602,624-938,960-1401
atgaagctactccacacagctaagccgggacaaaaaatcagctacaaggacttcaccagcctctacccgtttaccaactttacgaccgactatcccctcggccaccctaaaatcatcagtatcccaccaaatgagcagacggtcaactggcgctctccatccgacaacccctacaaaggtctgctcaaagtgctacttctacctccaaacaacaacattaacgtcactgttatgcccataaaatttgatcaacgcctcctcttccctctctgtgagaagtgcgccaaatacatcacagcaaaatatcccaatggcctcaaagacaacgactattcctgtccccactttaaccctaacgaccgggccttcgtgtccacttgcacccatcttgagttaaacgcagcattggaggccggctacacagtccgcaaagtcttccacgtcctccaatacgaccaatggagtaacaatgtcttcaagtcttacgtgagtgaaatgatggccctgaagatccacgcaaccggcttcccgtcatggtgtgagagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgaggaatctactttcgaaggcggtaatcaacaatgacccttgtgttctccgccaatacaccgacgacaagaaaattgatattatggacattgagctgatggatgaggacaacgacgtattcatgctcacctacaagccgaaagaggagtttgtcgacgaaaacaaatactccaatgtcgtcatctcactctacacaacatcaatggcgcgtctatacctttacgaagtgttaaaaaaagtggccgacactcccggatgtgaaattctctactttgacacggacagcatcatctacgttcaccctgaggacaacgacccactcccgacaggaaaaggacatctcggtgagctgactgacgaaaagccggaccacgacattttggagttcatcagcgctggctgcaaaaactacgggctgaagttggaacgtaaggacaatggggaaattgagtacgacttgaaaataagagggataacactggatgaacaaactgtgcaaacgatccattatgacagtgtgaaagatcaaattatgcgttatggttccgatgaccccgcggaccccattattgtaacatatccccattttattcgccctaatctaatccaaggcaaagtgtacactcaatctctaactaagcattatcaacctgtcttcacaaaaggtattattaatgattcattccaagtcctcgaatttggttatcgcaaatga

SEQ ID NO: 62725 - DNA, 1821 bp, Heterodera glycines
  Genomic contig location: Contig_ID=SeqID_854; Location=687..2507; Strand=-
  SCN-specific regions: Sequence locations=1-283,306-765,788-843,866 -1821
atgaaacgtttttccctctctcaaaattcttcctcctccttccccaaaaaatcccaaccaaataaatgcattcgtaaaattgataacctcacttcaaaaagtaaaaaatatcaactggtgcgctcaaaatccaagttcgtcattgaggaaattgacaaatgtgctgaccccgctgctgagctccgttcatgtgtgcaccattcgattgaggaagcaattttagatggacaaaacacacttggcgctgcaaataaggtgggggttataatttcatcggaacttttagaccagggtgacatcatcctaccaattacaccaattaccgcaaatgtcgtggacgccgttttcaaccagttttgtaaagtggagcagagcaaatcgaaacacgtcaacttatatggtgctccctttataattaccgtcactgtcctaaacaccaatggactaccgcgacaacggacaacaaagggaaaagggcgaccgcctgtctcctcacaatcgcacattttcaaagtcaacaacaacgacaactactgtcttttttacgcgctggaactgatgcgctactattcactgtacaaacgcggaattataacagaaaagcgatggcgatggattaacaacaaccaaaccacggttttacgacaaaaggcgcagcaactgctccgcgatgcggggatccctacaacagagacagagtacgacgcggaagtttatatacatcaagtgcaagggttgtggaacgtcaagtatcccggtgagtacaaaatatttatttttaatgattaccagatgcgcccaatcaccaaatccgatatcaccgattaccaattccccattcttctctaccacaacaacaaccactttgacggcatcaaaactctttcaaaatttttcaacaaacgttactattgcatctcctgtgaatctgcctacagccacaaatttgaacactcttcaaaatgctcttcactctgtcacaggtgccgtgaggtgggcgttgactatccctgcgatccccagcaaggatacgtcaaaaactgtgagcactgtaacaacaccttctacaacaataactgctatgggcgacacctccacaaggatttgtgtaccaaatttcaacgctgtgaagattgtggggtaatttataacataaaggttcatgggagtgttgggcataaatgtggggaacagttttgtaaactttgcaagcaatttcatataaaagaagacgacgacgacgggatgaacccctgtacgaaatgtttcatccagcccctaaagcaacaacgaattaagtcatacagtatcatcgcatacgactttgaggcgacacaggacaagaaggtggagaaccggttcgagcatgaagttaactttgcagcggctaccatcatctgtaccgactgcattatcaacggctactggaacaaatcacttcagggaaaaaagtgccaaatttgcggccctcaccgctcaatcaccttttcaccctttgactacacggagacaacagtcgaccaaaaaatcatcactcaacaaccgctacgcgaattcgttgaatggctcctttttgaccacaacaaaaagtttccaacagtcgcctttgcacactttgggggccgctacgacatgacgatgatcatcaaggaggttttagcgcaaggaattcacaacccggacatcatcaaacaaggaaatcgcctctacgagctgaaaatcagggaaaacgagcacggcccactcaccatttttcacgacaattacaacctaatgcccatcaaactatctggcctcatcaaatctttgggcttcatataa

SEQ ID NO: 62726 - DNA, 349 bp, Heterodera glycines
  Genomic contig location: Contig_ID=SeqID_855; Location=398..746; Strand=-
  SCN-specific regions: Sequence locations=1-53,75-154,193-349
atgaaattattattcgatagtattaagaattctttatttatggttaaaatttcaaaaaatttcatcgagtattaaaaaaggtaggactgtagccctgcaaatcaggactacactggatttacaccattcaaattggtaggaaaaatagaaattgttattttaagtaaataatttttaacatatttaattttacttttaggtacgaaccggtaatgcaccgttataactgcagtaaaacaaacattgctggtcagtcgagcaccaatggtgacttggctggttcgcataaagcagaaacaaatagtgaagcaaaatccgattataagaaatgataaaaaaaactaataaa

SEQ ID NO: 62727 - DNA, 880 bp, Heterodera glycines
  Genomic contig location: Contig_ID=SeqID_6746; Location=800..1679; Strand=-
  SCN-specific regions: Sequence locations=1-147,169-175,205-788,810-880
atgcgaaaacggaggaacagcagttggccatgtcatctttgctcccttctcgtgccaatttcacttttctggttcctttccctttttgctatttctcctcccctgacaatggcactttcgcttttcccacggcaaaatgtgccgaaaatgttacattctccgtttcttcaacaacatgacaataataataataataataataatgtcagaggaccattgggttacagtgatcagcttgaactgttggcacattcgggaagaatggcaaagaaatgtcggcacgactgttcaatcagcgaccccaatgccgaaaaatgctggtggttattttgaatcctatcaatgaaaactctaattaattaccggtataagacagaaggtaaggaacgaaactttggcattttatgagcaaacgctttttcgagtgttaagacgtgtcattttggttgaagtgagtgggtgaatttggggacgaattttaggcatttaaaatcaaaacactttccctcagaccaaccgaattttatggatgaccggccaaaatgaccaccgacacggttcggtgggggtcaattacgagagacttaccagcgattccttccgccggtttttacaattgcctcggaggcaaattgtggcagataaaaatgattgggttggcattttataaaatttgaaaaagtttaaaaatgaaaaaatttagaaaaaggcgtcattcgtttttgagcaaatttcgccggcgattatggacagtgtggggcgattggtgaacaaactgcaccactattacagcaatggaaacggaaaactgaacgaaccgccgccttttctccgcttcgattgtccaaggccatgcgaacggtgccaaaaattaaataaa

SEQ ID NO: 62728 - DNA, 71 bp, Heterodera glycines
  Genomic contig location: Contig_ID=SeqID_6747; Location=339..409; Strand=-
  SCN-specific regions: Sequence locations=1-71
atggaaggaaccatcgctggagcaaatcaaaacaatgatcagacaagcgatggacgaactgcaccaaaacg

SEQ ID NO: 62729 - DNA, 873 bp, Heterodera glycines
  Genomic contig location: Contig_ID=SeqID_6747; Location=718..1590; Strand=-
  SCN-specific regions: Sequence locations=1-104,150-387,409-665,710-873
atgaaaagccttctttggcctttcctttgtcttttttcttttttctctttgaatattttccctttcatttcttccgcatcactcgcaaataaaattggagaaggtaattaattaattaatttaatttggaattaaattttgaataaaaacgcaaaataaataaactttctcagactctcatcacaattcgtcgtgttcgacaaaagttcaacaaaaatgccaatgcggtaaacattttcgtaatttaacgacaacacgaatgattgctggcaaaacgtacgacactttggtgccattgggcgatggaatggacggaaaggtcggaaatgggaaaaaattaccaaaaataggagaaaaatgggaggaaaatcaaaaaaattaacgaaattataaggaaaaaggccattcaatttgcattcctctttttgttttgggttttaaatttgatttccccatttttctcaattatttgcccacttttcaggttgaacacgccttttcccagtcgcttggccgttgtgtggcgatcaaaacttgcacggaggacccaacgcggttgagcaaatgcacgcgggagctgaaagtgttggagcggatgcgcgacatggcaccacacattgtgcgactcgaaaattagtgagtttcgggggggggggggggagcggataattacaataattaagaaaaatattaaaattaatgaaaaatactatttacagtgagacaaagagtggccaaccgtgcacggagggagcagtgatgtccgattttatcagaacagttctaattgggagcgaaaagcgcagaaaaaggcgaaacgttggcgaagagagtgagaaaaaaagaattaatattatggaaaaagaaaaatga

SEQ ID NO: 62730 - DNA, 475 bp, Heterodera glycines
  Genomic contig location: Contig_ID=SeqID_6748; Location=152..626; Strand=+
  SCN-specific regions: Sequence locations=1-49,377-475
  Gene Ontology: Mol. function=protein binding; Cellular component =axoneme; Biological process=eye photoreceptor cell development
caatttccgagaggcgttcgccgtcaaaaaggcgcgaaaaaaggcgcaaaagaggacgaacggaagaggaagaggaggaggaggaagatgaggatgagatggatgaaaaggaagggaaggaaaaggaagaagaggatgaagacgaggaaggggatgagaaggaaggggaagaagaagggaaggaaaaggaagaagaggatgaggaagaagaagaggaaggggaggagaaggaaggggaagaagaagggaaggaaaaggaagaagaggatgaggaagaagaagaggatgaggaggagggggagggaacatatgatgaataggaagaagacgagggaaaacggagtaaagaagaggatgaggatgaagaagaggacgatgcaaccctcaccaaaactgaagtgaaaaaaatagaaataatttgtgaaagagttgtgccgatttgcgaagctctttcaaatttacaagtcatcaaaaa

SEQ ID NO: 62731 - DNA, 1059 bp, Heterodera glycines
  Genomic contig location: Contig_ID=SeqID_6749; Location=89..1147; Strand=+
  SCN-specific regions: Sequence locations=1-81,130-214,237-308,365 -748,771-932,960-1059
atgcaatggcaaagtgagtttaaaaatacttctaatttttatcatttcagaaaaacattcaaaatttaacctttaatgaaagtttaaatgaatataattttaatgattttattgtcattataaaaaatttcttcagttcgcgaccccaaaattccttatcaaattttatacaatgaatttttgtttggcgccgatacaaaattaagaaaatggagggcaaaaattattcttgaaaagtttctttacgacgaatcggcacaaaaattgttcgaagacgaaaaagcaaaagcaattagaaaaggcaaaagaataattaatttttaaattcattttaaattaaataaataaatgtaaatttattttagagaaaaatttaactgtttttcatgagagaattaaatttattggagaaatgaaacaaatttggacaatttattcggagaatttttggtttaacgaaaaaacaattcgggcaaaaattgagcatttggtgaggagaaacaaaggcaaaaatttggaaatggtaaaagaaactcttttggcacatcacaaagaaatgagtgaaattgaacacaacgaaaaggcaaaaaactttttaaattggatttaaataataacaaattgacaattaaggacattgacatgctttggggaaatgggcccgaagacacggcacttttcagggcacttttcatttgcatcggcgaatcattcacggaatgtgccgaaaaaggtggacaaaagtctgccgaacatttggaagaattttcggcgacagagcaattaaaagcgattaattgtgtggccaaaatagtgaaaaggaaggcgcggaaggacgaaattgtggccaaattgcatttagagaaaatggaggaaataattggcggcgaattcaaagagaaactgaagaaaaatagtgggcaatcaaaaacaaaaattaatttaattaattaattaatggaaatgattaagttacattttttagctaaggaattggcaaaacttttggatggaaatggcattaacaaaatgaaagaattactgacagaggcatattaa

SEQ ID NO: 62732 - DNA, 683 bp, Heterodera glycines
  Genomic contig location: Contig_ID=SeqID_32422; Location=139..821; Strand=+
  SCN-specific regions: Sequence locations=1-71,148-282,354-455,487-683
atgccaaattgccacttttttacattttttgtaatcgttgccccaaaagtgcgtcaataaatcagaatttcttatatttttaaatttttaaatggaatttattttcttaatttatataatttttaaaattaaaagatatatatatatcaggggtgggataaattttcatgttttgaagggtaaacgatgctcaaattcgtattgatgagctcaatctgcattttgtgtaccgtttgggggtgatgccggataagcatttgctgatgtaagtctggcgtattgtttttattttcaaattaaattcaattaattaataaatgcccttttttatttaaacatttttttaattttaaggtattgccagaagaagttcgacatgctgtatgtttaaagagcaatgaatttttattttcccaatttataggaaattgaacatttgtaaattcaagccctcaaaaattttctttttaaaattttccaaaattattggcttaatcggtaaaagtttttgtcccaatttttaaacacagccttggggccaacttgctgtttgcccttaaattgaccatcgaatatggcgaacgaggaatcacccgcaggggcaaaattgccaaatttttaaccgaagaagaaattcggcgcgaaatggaggacacctactgaacaaacgaaagaaagaatga

SEQ ID NO: 62733 - DNA, 574 bp, Heterodera glycines
  Genomic contig location: Contig_ID=SeqID_32424; Location=445..1018; Strand=+
  SCN-specific regions: Sequence locations=1-258,285-323,345-515,537-574
atgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccacagcgcggcaaatgtcgtcgcacaaaaaatcaccaccggcattaaactcacgtgagaattttttaaaattaatttttaaattctcaagacggccaaggcgatacaagctcgcctggccaagaaaagtgagttttttcaccatttttactcaaaattttttttttaatttcagccgctccacagctgaatcccaatgccgaaatgccaccgcaggacgaagcagggccgtcaacatctgctgcatcggccgaagaagcgatggagccaccaccaccaactccagcaccagtgccaacgccggagatggacgaggaaattttggaatttggcttttcgctgccatcgacatctgtcacacctatcggcgatttg

SEQ ID NO: 62734 - DNA, 113 bp, Heterodera glycines
  Genomic contig location: Contig_ID=SeqID_32425; Location=91..203; Strand=-
  SCN-specific regions: Sequence locations=1-113
atggcattttcactaatgaacacaataatcttcggtggaaatggcataaatttgtcgaaatgcccaccaaaggaggaaacggcgagtgcaaatctgccaaaggaacaaaaaca

SEQ ID NO: 62735 - DNA, 284 bp, Heterodera glycines
  Genomic contig location: Contig_ID=SeqID_32428; Location=201..484; Strand=-
  SCN-specific regions: Sequence locations=1-153,196-284
atggttgcattttttttggcttaccaaaacttcatcgaacctggttctttctattctctttcaaattgccccaaattttttttacagccacgaggccgcgaagcggccgagtgagtaccttgggcgcaggaaaattattaaggaggaaggttcattatttatttatttttgcaaaattaattcataaatttttttcagaaactgctctgaaacgcaccaaaatttatttacaagttgaataaggcactctgactcttatattatcaaaaagggagatgaataaa

SEQ ID NO: 62736 - DNA, 284 bp, Heterodera glycines
  Genomic contig location: Contig_ID=SeqID_32428; Location=1608..1891; Strand=-
  SCN-specific regions: Sequence locations=1-153,196-284
atgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaa

SEQ ID NO: 62737 - DNA, 906 bp, Heterodera glycines
  Genomic contig location: Contig_ID=SeqID_32431; Location=41..946; Strand=-
  SCN-specific regions: Sequence locations=1-182,214-274,297-321,350 -401,424-462,485-550,620-771,855-855,877-906
atggtgtgccgtgaggaatggcatcgtcagttggacggcgctcgactgcccccatttctctaccaacagattggacgatttgccggtgcactgatcacttcattgtctgcgcccggcgggagcagttcagcggatttgctgggcactgaacgtgttcgggtgggttggcatttttaggtcaataaaagatttttaaaaataaataatccatttaaaatgcttttgaattgtgggacgatcatggcttgagtttttcagggtcttggttatgtacataaacgagaaataaattttcagtcgccagcttaaaggtcgtggaacatttttttaaaaaacaaaatttttttaactttctctgaagttttgttaaagatattttgaaaagacttatttaagaaaattttcagttttttggaatttttgggtgctataaaatttggcaaatcaaaaaaaaaagatcggataaaattttatttttttttttgaggcaactgctggagccactaatgaaacttgttaagaaaaattcaataatgtttttttaaatgccattttttcttaaaatataattttctaagagaatttcttttaaaaaaaaatattattttttatttataaagatttttcagcaactgctcgacccattaatggccaccactgcacagctggagcagttgactacggagagttgcgccgagttgggattgcccgagtgtttggtgcacggaaacccgatcggacgcaatgtgttctttgacctaacaattgcggaacagcaacaacatcaagcagtagtagcagcagcagtaaatcatagtactgacgatgacggcattaagcagcagcagcagcaggcaaagggcggcggtggcggcaccactgttcgggcactcatcgactggacac

SEQ ID NO: 62738 - DNA, 1370 bp, Heterodera glycines
  Genomic contig location: Contig_ID=SeqID_6750; Location=892..2261; Strand=-
  SCN-specific regions: Sequence locations=1-132,154-290,335-390,412 -867,889-913,936-947,970-1370
  Gene Ontology: Mol. function=protein binding
atgtccatcagtttggctgatcggatgaagcttttgttgaccaatggcgatggggcggacattcaatttttggttggccaaggagaggaaaaggaggcacgtattggaaaaaaatcaagaaattcattaaattttttgaacttttcttttattcgaccatcaaaagtttctcaaatcgtaaacattgttgtttttaaggttctaaaagcacacaaactcattttgatggctgcttctgacgtgttcaaagcaatgttccgtttcgacgctcaaaacgcaaagacaaaaagtaaaaaatgaaaaacaaaaaattaaaaaattttaaaaatttttagcctcctcttccgctgaacagttacaatccgtggagatcactgacatcgacgccaatgtgttcaaagtgatgctgagctttatctacgcggaagattcaagcggattgaccggagacaatctcatcgctgtgctttacgcgggtgggaattttttttattgaaattttagccataattagagaccagcagtaaaattttcaacagtctagtggattaggaaagtcattaaaatcgaacgaaaaatttttcaaaatttctccgacggtgccgaccgtaccctaactcttcagaaattgtttggaaaatgtgacgaaaacataagaggcctaagagcaagaaaaaaaggaaaaggccgtcgctcggaagagtctgtatcgtttcggcgccaaaaaagcagactcaaaacacttttatcgtattgagaaagcaagatccatttgcaattgtgaattttcggcctttttgctacggcgccaaaaatgatcaggaaaaagtgatcaaagtttcaaaagccccaaaaagatcattttttaaaaatttctattaaaaaaggaattgagccacaaaaattttcattaaattacctgaaaattggtgggactcaaatctatcatatatttttttataattttttgtttacaaatgattactttttagctaagaagtaccacatttctttgctggccaaggcttgcgcggactttccactggaaaatgaattgcccaatgttttcctcgcttttgaccaggctcagcttctcgatgagaaagtaattaatttaaggccataaaatttcagagctttttatatttaattagtttttgattttgttttttaatttggcttcgcttttttaggatttcgcaattcgttgcttggattacattaatcgaaaggcggaaactttgtttggttcagaagaattccttcaaatcggccaaaatttgttgtctaaaatttttgcgagtgaccaattgaaaatcagtggcgaaatcgcactttggaaagctgtaataattattatgtttaaataa

SEQ ID NO: 62739 - DNA, 399 bp, Heterodera glycines
  Genomic contig location: Contig_ID=SeqID_6752; Location=346..744; Strand=+
  SCN-specific regions: Sequence locations=1-160,198-272,315-326,348-399
atgtttttaaaagtgaatatgccaatgaatttcagggtatcacaaaaagcaaaacaggagatgaattcgcgcactgtatcccatgcaattttaagccttttgaatgtaaaaatggtcgccaattgtctcaaaatcgcaaaaattgataatttttgatgaaaatctgttaacaaatcaaagaaataagaaaaaatttttccggcggcgcctatcggcaccgccggacccacttccctccctcgttctccaaaatttcttggaaaaatgcaccgtaaaaaatttattaaaaattatatttttttagataaaaattacactaaatttgctatttttctcaccaaaattgttaaaaatgatcatgggaggtggaaaatataatatttaatgcatttcgatcga

SEQ ID NO: 62740 - DNA, 105 bp, Heterodera glycines
  Genomic contig location: Contig_ID=SeqID_32433; Location=919..1023; Strand=+
  SCN-specific regions: Sequence locations=1-105
cgtccgtttggggtactcaaacaattatggggagcaaaaatcccacgcagaattaaagtacaggctatagggaagctattcccgaaggattctgtctccccataa

SEQ ID NO: 62741 - DNA, 729 bp, Heterodera glycines
  Genomic contig location: Contig_ID=SeqID_32434; Location=219..947; Strand=+
  SCN-specific regions: Sequence locations=1-232,254-401,423-729
atggtgcaactgactagaaacaaaagtttgacttcgggcggtggcgacgatgggaaaaatggattgctccgcggcgtttgttttgaattgatcaagttcgtgcacgactcgacgcagggatttggacaagcggtaattccctctaaatcgcattcaccatttaccttcattttaggcacaattcgtttacgacaaccgtaaaatcttattcacgaacaaacgaatcgaacaatttgtttgctttttgtcttttaacattatgtaactatataattttaggcattggaaattgacacggaaaaagtccaaggaatcgttcgcgatttcctgcgtgggtctccagtcaaaattgaggttaggccttgtcagactgataagcatgagctggatctcaacggcattgtttcttcgatttcgcaccatcctgatcaacaatcggacagatctttgcggactttccttgaaatgctgtcttcccagccatttctcaatgcgtaattagcagtatttaatttttttaagtttattcttagtgggacacatgacatcattggcgctggtcgactttttaagcgtcagatctgcaaagagctcgaagatggcattgtcacgcgcgagggtattgctaagggagttcgcgtcattgacaacaatggtgaaccaaaggcggctttgtttgctgacggtttactttgtattttgttggttgagtgcttaagaatcgcttga

SEQ ID NO: 62742 - DNA, 154 bp, Heterodera glycines
  Genomic contig location: Contig_ID=SeqID_32436; Location=963..1116; Strand=+
  SCN-specific regions: Sequence locations=1-61,85-100,122-154
atggagaatcagctaatcagtcagctgcaagggtacatcagaaacaggtcgcaaatcagaaataatcaagtttgcaatcaagaacggtcaggatcagactcaaatgtcaggatcttccagggatgcagttacagacatagggttcagcagctcg

SEQ ID NO: 62743 - DNA, 744 bp, Heterodera glycines
  Genomic contig location: Contig_ID=SeqID_32437; Location=95..838; Strand=-
  SCN-specific regions: Sequence locations=1-96,118-174,196-375,398 -638,660-744
atggcgttaatatggtccaaactcaacaaagatataacagatgctccatctgttgacagtttcaaaaaaggtatgagtaaatggattgagtcaaacaaaaaattttgtctgtaaaagcgctccttggacttgactaatttactaattaacgtgtaagtggtcaccccttcgttggatattttatttcttctgaataaacaaataaaaacctaaaatttagtggtgtaaaacgacaaaagctattcaaaaaaagtagcaaaattaagccaaatgtgtattgagatacagtcatggtcatatgtttatggcgacttgctgctaacaaacactttccttaataattagttaccaagaaacgtatgaccagaagtgtcataacattttttgtagcattttttgtgggctttcaaatgataccaatcattagtcgaaatgagaattttttgtcagatcacttccagacttttggtggtacaccccattttcgcgtggtcatatgtttatggccatagtgcattttacagtagaaatgatgaaatcaaaattgaagtacccatacctcagcgggtataagtcatagagacttacggtcttttgcatactgtagaccgttttgtcctctttctgatgaacctaacggttttttccagaaaatttttcccaaccccctaggattttttttgaaaatttccccgatttccagtgtattttggggtgccagatcaccatgaaggagtgatctga

SEQ ID NO: 62744 - DNA, 753 bp, Heterodera glycines
  Genomic contig location: Contig_ID=SeqID_32438; Location=44..796; Strand=+
  SCN-specific regions: Sequence locations=1-91,122-623,657-753
atgcgatacatcatttgccgagagatgaagaatccgaccgaagcgaagaatctgctctcacgtgagtgttttgacagaaaaaaataatgggaaaatttaattaattaatttatataattaaggtgtctcagaatatctccaacaacaccacaactttgggcccacccctccgctcgacgtctctttcccgaattatgtgagttaacacttaaatttgtaacacaaacatattcaattcattaaattagggttcctccccgactcctcgggggggggggcaaaatgtcgggggccgggaacctcggggggtgacatgtcgggggtcgggtcgagggtgagctcaattgtcgggggtcggggacctcggggggcgacatgtcgggggtcgggtcggggggctcggggtcggggaggaaccctacattaaatattcaaaacaatgggcagggaggggttggaccccaactttttggagagtaaaagtcggggaggaaattctcggggataaaattgtagtcggcagctttatgaattaaaaaatgccagcaggcagggaaattccgtaaaaaagggtccctttttcttttgtcaaaagcctcggggagtgcccccggcttttggtctaaattttaattaattttaaatttaaaaattttcagttgaatgaaaatgttacttttgctgctcggttggtcacccaatttgccgcacagcccactaccacggtggaacaaatgcgtaacatcgggattt

SEQ ID NO: 62745 - DNA, 1108 bp, Heterodera glycines
  Genomic contig location: Contig_ID=SeqID_32439; Location=207..1314; Strand=-
  SCN-specific regions: Sequence locations=1-613,637-726,749-814,861 -861,892-976,1014-1056,1078-1108
atgcctccgatccacgatcaatctcgaattgagtggtgccaatgtaaggtttgccaaaatgcgccagccattcatgaactcaaacggtgccgcgttgacaatagttaaaaaggggtgccgaacgtaaactggcggaatgagtgccttgaatcggtgcttcgtcgtcatcccgtccaataaattaaaactgcccattcatcatttgtaggaatgctgggcatttttactcgcttttgcactcaagtatttcgcgaacagttggcatttcttattagaatctgaattttcttctgtttaggaagaaaattagaaaaaatcacagccgggaataaatttaaaaaattttcaaacagaaattttaaaaatcttagaaaatttttctagaaaactgtaaaaaaaattttctagtgatttttttgaaaaaacttattctcggctgtgttatgtctcgactgtatttcggcggcagtgttttgtcctgttccgcgcctcaattttcttttgacattaattccttaatttttttaaattttatgagtgagacgaagcaacaaattatgtgctttcaagtggaaaatttttgacagaaaattattcataacttagcgaaaatgaataaaatttttgatatttttagatagcctaagtgtttcctattatcctgtaaaaatcaattaacattcaaaaaaggtacaaaaaaccaaattttttttttgcacattttggtcataacttctttgaaatttaacgaaactttttaaaattttgtaggctaatagaaaacacatagatctatcgaatgatatcattgaagtgggaccgggccgggaattcccggtcatccgaggtcccggtcccggattttgaaaagctcaggtcccggtcccggtaaagcaaccgggaaccgggaaaaacaagcactggtaagaatgggtgtctgagtgaaaaattagtgaagaaaattggagttaaaaggaaaaaattttaaaaatatattaatatattctttaaaagcagttctgccaattgtgcggatggcctagtggctagtctccatgactttcccttcttctttccattggttaaatctctctacacagaaattaaa

SEQ ID NO: 62746 - DNA, 354 bp, Heterodera glycines
  Genomic contig location: Contig_ID=SeqID_32440; Location=94..447; Strand=+
  SCN-specific regions: Sequence locations=1-354
atgtcgggatatttgcggacaaaaatcgcaatagagctaaaggctcttgaaaaggcgaaaactgcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagctgaaggacctctggagatga

SEQ ID NO: 62747 - DNA, 318 bp, Heterodera glycines
  Genomic contig location: Contig_ID=SeqID_32440; Location=528..845; Strand=+
  SCN-specific regions: Sequence locations=1-166,191-318
atgtcgaagtcaaatgcagaagcagacaaagggaatagccgagcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaaactgttaaaagacacctatggggataaaggcgaatac

SEQ ID NO: 62748 - DNA, 1501 bp, Heterodera glycines
  misc_feature (1480)..(1480): n is a, c, g, or t
  Genomic contig location: Contig_ID=SeqID_6753; Location=55..1555; Strand=-
  SCN-specific regions: Sequence locations=1-805,829-1272,1294-1501
atgtcaaggcacaacaaatcttgtaaggcacattgtgtgatgtgctcacgtgttggaccgcaatttccgtgtcagccaacagatggattcgtcaaggagtgctctaaatgctataaaaggttccgaaactacgactgctaccaacatcatcttcattccaacttttgtatgcggtcaaagatgtgcaaagattgcggtgctgtttgggatgtagcagataacaaaagaaatgacagaaaggggcatgtgtgtggcgagaattattgtgggctatgcaacaactaccacaacactgagcggggatgctacattcaacccattgagccgaaacaacatactccctatcgtattgttgcgtttgacgtggagacaatgcagcatatgttcattggggaatctgaacaacggaaccatttgcctaattttattgctgcgaaattaatatgcccgggatgcatcgagaatggagactggcaaagaggaacaaaagggtgtgaggtgtgcgggccaaacagaacggtcgccttttgccaacgcttcacagaaacaacagtcgacaagcaagtggtcgcagacaatcctttggaggaatttgtcgattggttagtcttccaactcccgctgaagtatgacacttatgtttattcgcactttggtggccgcttcgatatggtgttggtttttcgtgaacttttccggcgaggattcaatccgagcatgttgaggaagggcaataagctgtatgaaatgaaagtgggcaatcagaagaaacgcaatccaaacgtggtgttccgagactcgtataatttgatgccctgcgctttggctgaacttgttccatccttcggcttggatgtggaggacaaaccattctttccgcacatggcaaaccaaccggataactacggaaagcagatataccccacgcctgaagactacttggccgatgggatgatgccggataaacgacaaaaattcaacgtctggtatgaacaacatcagcataaacccttcctccttgacgaagcattggccagctactgcacaaacgacgttgaaattttaacggcagcgctggtagcgtttcggatggaattctttgatgtgtctcggagggaagaaggctttgtagcggaaagggcacacgaaggaattgatgtattgagggagtgtatgacgatcgccggcgcctgtatgaagcatttccggatcaaccaccttccagctgaacacttggcaattgtcccggaacgaggctatgacaatgcacaaaatcaaagtagactggcccgccgtttcttacagtggtacacggaagaacataatgtggaagtgaggatggctaattcacccagaggagagaaaaagtttggtcaatattctgtggatggatgggtggaagcagagagaaaggcaatagaagttaatggatgtgtttggcatgcatgcagtgagtgttatccagacgataatatgatgnatgccaatggaaagacagctg

SEQ ID NO: 62749 - DNA, 982 bp, Heterodera glycines
  Genomic contig location: Contig_ID=SeqID_6754; Location=71..1052; Strand=-
  SCN-specific regions: Sequence locations=1-982
atggaaaaccgttcacctaaacgtccttcgaattctccattcgttgaacttcttcccaaaaaaccccgccaagacttagtcatcaatcaaattttgggtgttgtccaacaaggaggaggagagacatcaccttcaaaagaagctccaaaggattacgtgcagaaattgggtagctctgttgaacatgtcgccaaattccactacaccaaaatgaaatctcgcttcagtatttcggatgttccttctaaccccgagaggcttttggctggaatatttcaacattgtattgatagtgctacaaaagacagccgtgaacgtgggatcgagccaactcaccttggatgtttgataagcagtcctcttttgtcggaaggagctataacaattcctactcgaaaaatctccgacaacactatcgataccatcctcaatttgtttctgaaggtggcgcagtccaaacaacagaaaaacgtttcactgtggggtgatccgttcacggtgacaataacaacagtcgatcgctccggacttcaatttaaacgacgtgtcaaaggaggaacacgccgaaaaatagctgctgtccatcaccgaattaatgaccagtgcctgattaaaattcgtaataacgacaaccacttctgccttttctacgcgctccaggcaacaatggtcgacaaaacatgcaattggcctcgctggaagtttttcgactatgtgaacgacagacacggacaacagggacaacttcatcatgatgcggttgagctcatgcagcaggtgaaagctccgatggacttggacggttacgacgcggatacatttgtgcctcacgtcgttgactactggaacaacgcgcagcgacaacaccgctttgctgtgttcatctttggctcgttgggacagtataagccgctgtacaagtacattgacaacacctacgacacaccattgctgctatatttcaatgaggaccatttcgatg

SEQ ID NO: 62750 - DNA, 121 bp, Heterodera glycines
  Genomic contig location: Contig_ID=SeqID_6754; Location=2786..2906; Strand=-
  SCN-specific regions: Sequence locations=1-20,42-121
aaagtgacatttgcggggaaaatttaaattttgctgtgagttgtattttgatagatcaccaaactgacagctgagggaaattcatttttttgagttgtagtaccacttaatgacctattag

SEQ ID NO: 62751 - DNA, 104 bp, Heterodera glycines
  Genomic contig location: Contig_ID=SeqID_6755; Location=1190..1293; Strand=+
  SCN-specific regions: Sequence locations=1-104
atggtaattgattctcagatcaacaagcatataatgtctgaccagaaacaactgtttttattcggtcaaactcttcccggcaatcagagtggacttcttgaaag

SEQ ID NO: 62752 - DNA, 903 bp, Heterodera glycines
  Genomic contig location: Contig_ID=SeqID_32444; Location=52..954; Strand=-
  SCN-specific regions: Sequence locations=1-861,883-903
atgatccatcatccccagcggcatttcgctggtgttaccgcactgtggaaagaggcgcgaaagaagattaaacatttacggaaaaaggacgtacagcattatttggagggacaccgcacgtacactctgatgcgcccccgcagggtgcactttccaagggcccgaaccgttgcggcggggttcatgaccgatgttcaagtggatttggtcgattttcaggcgctttcgcgccacaatcggggtcaccgatacctgcttgtagcggttgatgtgctctcaaaacgattgtttgttgttccgctgaaaaacaagagagccgaggagatgttggaggcattcaaacaactcattgaccaaatgcccatggtcccgcatcgcatcttctccgacaaaggcactgaattcaagaaccgcttgctcagggaattcttcgaggagcaggaaattgagaaacatgagccagtgcattcgttcgtcaaggcatcggttgctgagcgggccatccgcaatgtgaagcagcgattgtaccgctattttgcggaaaaggagacgctgaattgggtggacacagtacagcaaattgtggacggaattaacagctcgccgtcacgcgttcacggaatgcgccccattgatgttaacttttcaaatgcgcaaagggtgtggaagcgattgtacggacacccagcccttcaaaggcggacgccacgctttcataacgaccaatttgtccgcatgagcagagagaaggggcaatttgagaagggatatctgccaaattacggggacgaaatcctggagattgacgaggtgttgaaagcggtgcgcccgattcggtacaaactgcgggatgaacacggagagaaattcaagggcagcttctatgagcaggagttggcgcgc

SEQ ID NO: 62753 - DNA, 634 bp, Heterodera glycines
  Genomic contig location: Contig_ID=SeqID_32447; Location=483..1116; Strand=+
  SCN-specific regions: Sequence locations=1-634
gtgaaatacccgcagctgcaagtggaccaaaccaacgaatgcgaaggcgtttatttcgagcgcaacgaattcgtggacataattctgtccaatgttttgtcaaacgccggccgacggcgcattgttttctcctcttttgacgccgacatttgcacaatgtgcggacgaaaagcagggggaaaatatgaaatcgacgaacacaaattattgggaattaggggcaattaatttattggacagttagaattggcattttgccctcttaatgcgccaaatcatttcaatacgtcgttaaaaatattctcgtcatttaaacttgaattcttcaagaatgagagagcattttttcaggttgtcggtcaagcagaagaagtacccggtgctgttcctgtgccttggcgattcgagtcggcacgtccaatacgcggacgagcggacgcggttgccaatgtccgcagtgaaatttgcacatgccatcggaatagtcggcgtgaacttcaacaccgaagatcttatgaaggtggacagtgaatcatttgccatttttaatacggcctgattttgtcccgatcaaaccaattacgcgtaattattaccgattttcccccaggacgcgtcgccggtggcaaatcga

SEQ ID NO: 62754 - DNA, 304 bp, Heterodera glycines; identical to SEQ ID NO: 51570
  Genomic contig location: Contig_ID=SeqID_32449; Location=387..690; Strand=-
  SCN-specific regions: Sequence locations=1-304

SEQ ID NO: 62755 - DNA, 101 bp, Heterodera glycines
  Genomic contig location: Contig_ID=SeqID_32449; Location=843..943; Strand=-
  SCN-specific regions: Sequence locations=1-101
aaaattccctcaaaaataaaaggtctattgcgcaccgccctccctatcatgctcgagagcatttgtatgtgtataaaatttatcaaaaaaagagatagcca

SEQ ID NO: 62756 - DNA, 1812 bp, Heterodera glycines
  Genomic contig location: Contig_ID=SeqID_32450; Location=290..2101; Strand=-
  SCN-specific regions: Sequence locations=1-411,434-762,784-1812
atgggcgaagcggagtacaagcggtactgcgacagcatcgcaccaaagacgcagaacgatttcaactgggacgagacgaccgcaaaattgaaacatttgttcggagaaacccgatcattgtttctccgccgtttcgactgtttccaaattcgtcaagacgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcaacctcactgcaagagcttggagaggagtgccgaaaatatcaaatcctaaaggaaagcgcgctctccctcggctcaaatccctgcagcaccagtgccatccgagccaaaccgcagcaaatcagggacaagcagaagcccaaaacgaagccgcagcaaagccacaaaggccaaaatttcctgccgaaaaattcaacggcacctaaaggaaaagtggaccaacgtgatcagccatgctattcatgtggaggcaaaagtcactggcaaaaagactgctggttcaaaaactcgacgtgtgaaaaatgcggacggaacggtcacattgcgaaagcatgcaaaagcggcacagagatccgacgtgttcgtgcagtggccactgattccgtgaaggacacgcacattcacaccgtctcaattaagctaaaatgtatggctattgaaggaagcagcaacaaatggtgggaagtgatcatccaaatcaatgggatggatcacccaatgaatgtcgacaccgctgcccaaatcacggtgatcaaaacggactcatggcaaaagcttggcaaaccaaagctaggcaaaacggccatcaccgtcaggaattgcaatgaaaaagcattcccaatcgaaggcaaattcaaatgccaagttttgtacaaaggacgaacggcaagcctaattgcttacgtcagcgacgaaattcaccaggatttgcttggcatgccttggattgaagaattggaaataatcccgaaggaattgatgtttccaaattcgtcgcaaatcgtcaattcactgccaacgaagccaatttcatcacaaatcagtgatgaaaagtcactcatttcggcacttcaaaccaattacgccaacacttttggacctgaacttggccattgcaccaaattcagagctcatctgatcctgaaaaaggaggcgaagccggtctactgcaaggctcggcctgttcctcatggagcattggatgaagtcaatgccgaaattgatcgtctttcgaaaattggcgcaattaaaccgattgagttcagccattgggcggctccgattttggcagtgaagaaaaagagcggaaaaacgcgagtctgcatcgatttttcgaccgggctaaacgatgcgatcgaactgcatcgtcatccactgccaagacctgaggacatctacaacgcagttggcggcgctaagtttttctcacgggtcgacttgcgtgatgcctatctgcagttggagttgtcggaagcccgaaaaatctttgcgtgctcaacacgcaccgaggcctgtttcagtgccagcgtttgccgtttggagtcaaatcggcacccgcgattttccaaggattgatggacaaaatcatcgccggaattccaggcgcattcgtctatttggatgatgttgtgatcgccaataaatcactgaccgatcacacctcaacaattttcgcggttttcgacaaaatca

SEQ ID NO: 62757 - DNA, 1332 bp, Heterodera glycines
  Genomic contig location: Contig_ID=SeqID_6756; Location=1250..2581; Strand=+
  SCN-specific regions: Sequence locations=1-229,253-525,547-558,580 -773,796-879,970-986,1019-1267,1289-1332
atgaattatcaacaacaacaacctcaatttttttcttcctatcctacagaaaatagcggagatagtaagtaaattagtaaattagccaaatatgaaggaatacaaaagaggagatagaaaaggacgattaaatttagaatcaaaataaataatttcagtaaattgggctcaacttgctcaaagatggattcagacgcaacattcgcagcagcaatcgtttccgccccaaccgccgcctcctcccccgccccctccgtcgcgtttgccttattctcaaggtttggaaaaccagcaatttgttgtttatccacatcgggtctatcctcttaaggagtttcttctgcacctgtgtttcttggaatgccattgtccacacctcccccaaatcgaacacctgggcctggattgtttccaacaccactttcccatgtgtctgttggaccaccaaactggcgacctctgcagaattgtgcccatccatcatttaacattggctaccgatctcatgggatcgcttcggctgctaattattcatatttttctcaatcacagggaccgagtgaaaggcatgatgatgaagaggttttctacagtttactttctaaagcgatactaaaattctcatttgaatttcagtatcaggctcattatgacccgtccctcgagcaagaagaatccacggaccaaaggcctccagaaatgtgttctcctcagggggccatgactcaatggatggctaatccttggaatgcggcgatgtatcctccaaattacatgccaataattggttttcacttttttttttgaaaattttaaaccttcgcttttagacactcaaatgaggaagaaacttcccgcgtggattttggagggattagaaaaagctgagagagaaaaacaaaagaagatagaaaaggaagaatatgagaaaaaacgcaaagaaatggaggaggaaaaacaaaagcaaagggaggccaaaggaatcggaaaatttgtatatttttatttaaaagacataccctcgggtggaatatttttgtacccgtttatggaatattgaatttgcaacatttaggatgacgacagtaacgatgaagaagacgaatgcggagataatggaattgttacaccgaataatgatgatcatcaactcttaccaatacgaaaatttcgcgaatttgttgaccaaaacaaaaaggatgaagcaaaaatttacgaggaaccccggacggatgagcaacggacgcaggaagcggtgatcattttatgaatgtttttattttcccaaacaggttcaaaagtggcaaaattaagatttacatagacacaaaa

SEQ ID NO: 62758 - DNA, 1548 bp, Heterodera glycines
  Genomic contig location: Contig_ID=SeqID_32452; Location=59..1606; Strand=+
  SCN-specific regions: Sequence locations=1-131,153-244,266-1439,1469 -1477,1501-1548
cttaagttggccaccgttgagagtgtaatggccgaattgccatttagcgttttggaccgtttgtttttcgtcggagtgccaattgtggacgcagaagtcagagagcgatttcgaagactatggtaattggaaaattataaaataaagattaattctcaaattaattaaggtatgatcggccttattggaaatcatcaggcaattttgaaggggaggagcaaaatgaggagccaaaaatgccaaatgagaaaaatggtttaaataattataatttgaaagtctatttaaattctcaaaattattttactactttttaatggcactttttgccgtgcctttcttttcagtggtcgtcgacactttgccaatgtttttgaatgtgccgcagcccgtcctccatgagcccgtgggacgcgcctcaatccgttaccagcagcaccaaatgccaatgccatcgttcacttctgccgatatgccgcactttcctcccccttcacccgtagcggtgccaatttcgtcgaaggttttacgtaaaaaatttgtttataatacagaattttgctcaattaacggtgccaactagtgtaacaattgacgagcattacaatgtcgcggcaccgccagcagcacagcggagccgcggtctgtgcgcggaatgcaacggaatcccagatgcaatggcatcgctgtccaacattatgggcagccatttggctggcccactaatgccaaaggcaaatgcgatcgaaaacagtgccgacgctgatcagaagaatgaaaatgatcaacgcactgaagtagcagagttggcacaacatcaccaactgaagcatggaaatgcggctgaacggagtcccatcttcaaaatgccaacatttggaaaaggaaaaagggccgatcagcggaatgaacaggacgggagtggcagtgagcatatggttcatcttcagcatcagcttaataagcatgttgaccgagtacagcatttggggacaacaccttttggaggaggagaaaatgcagcggacggaggccggagagggacacaaatccgagtgccatcgtttgttcccgaatcaaacggatcggtgcagcagccggcggcgccaattacgggggaagaaacgggcaacggtaatcactagcaagcagaaaagggatttgttttgaattctcacaaatataccgtattactgaaacagaactccacttaatttgaaccccagcccctgaaataaagtccacctttggaggggggttgaaatttggaacccccgagggctctaattcataagtgcggtatctcatttatgccaatttttttttgtaaattttcctttgttttagtcattttgagcgtgccgagcagtagcgaggccaaaccatcgcataataaaaatgatgatgtcatggtaaagtcaaacggcgacgaaaagttggagcaatcggaggaggaggaggaaaagcggcaacaaattgggaccaaaattggcaagagggaactgctgacaattgacggggaacagcaacggggacaattgagcacca

SEQ ID NO: 62759 - DNA, 56 bp, Heterodera glycines; identical to SEQ ID NO: 52733
  Genomic contig location: Contig_ID=SeqID_32453; Location=627..682; Strand=+
  SCN-specific regions: Sequence locations=1-56

SEQ ID NO: 62760 - DNA, 661 bp, Heterodera glycines
  Genomic contig location: Contig_ID=SeqID_32453; Location=46..706; Strand=-
  SCN-specific regions: Sequence locations=1-596,618-661
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgattttttttgttt

SEQ ID NO: 62761 - DNA, 444 bp, Heterodera glycines
  Genomic contig location: Contig_ID=SeqID_32454; Location=1..444; Strand=+
  SCN-specific regions: Sequence locations=1-444
ctattcccgagggattcggtctccccataaatctggcctcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattat

SEQ ID NO: 62762 - DNA, 407 bp, Heterodera glycines
  Genomic contig location: Contig_ID=SeqID_32454; Location=1185..1591; Strand=+
  SCN-specific regions: Sequence locations=1-56,82-163,209-209,235-384
agttcgatgaaactttttaaaatataagcctaaactttttggcttatttaaaaaggaattaaaatttttaaaaattttattcatctcccttttgatagaaaaagcatcagagagcctaatttaacttttaaataacatttggtgcgtttcagagcacgttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaagggattaaaaattttaaaa

SEQ ID NO: 62763 - DNA, 678 bp, Heterodera glycines
  Genomic contig location: Contig_ID=SeqID_32455; Location=1229..1906; Strand=+
  SCN-specific regions: Sequence locations=1-60,91-283,305-616,645-678
atgcgtcacgcaatgcgaatgtttctcgtcccggaggacgtctttcagtcggtatttgttcaaccccaagcagcaacagcagcagcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagaaacaccaaacagcagtggaaatggagaaacggaaaaagaagagggtgatgtagatgatggggaacagtgggacgacgcacaatcatcatcatccacggcgtcaacaggtggtgtcgcaccaaaaagaatgctcagagcaagagatggggaagcaggaaaaggaggaggaggagaaacggctgatcgccttcaacaaaacacaactaccagatga

SEQ ID NO: 62764 - DNA, 336 bp, Heterodera glycines
  Genomic contig location: Contig_ID=SeqID_32455; Location=92..427; Strand=-
  SCN-specific regions: Sequence locations=1-80,114-246,280-336
tgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaatatccaaatatttaaaaatctataaaaaatttaaaaatgagaattcatgcgagattttctggaaataagcttaattgggccttgttaagctgtaa

SEQ ID NO: 62765 - DNA, 1054 bp, Heterodera glycines
  Genomic contig location: Contig_ID=SeqID_32456; Location=219..1272; Strand=-
  SCN-specific regions: Sequence locations=1-433,472-1054
atgccaaacattcgccggcacatttatgctcatcacccggcggcacgcgaagcattggacaaacggagtttggtgaaaatgatcagtcgaaagaagccgaaacggaacgacatcacttctgggattgccggagtcttggaaagtccgtcggcacgacaccaaacacgggtaagtgacacggcactcattataagaaaataaaccaaacaacgccaaaagtgctgcatggaagagtaaatttgtacagggtcagcgccattttgtaaaaccttcagaaaagccaaaatgcatggtaaaaagggagaaattttaatgaaatttagaaaacagcaactaacaaatctgttaataaatttaacttaaagcttttcagatagttttcgccactcctgacgatgttttcgccctgcttgaacatctctccgtccgcatttcctcctcctccccctcctcctctcctccgtctccccccgctttgttcgacgccgtcgttttggaggacgtcgccgcgttgaaaagtgcggaggattggcgttcctttcttccgttggtctgtgctgttttccatattctttgtccaatttttggctttccactattgtattttgtcccattttaggcaccccttttgcgggtgttcagtgacccccaccattcgattgcactccctccgtccgccgatagcgaagagacgccttttcagtgttccgttgtgcagcaaattgcgcccaacagagaagaggtaaccctaaaatgaaaggttatttgcactaattgttgtgcaaattccacccaaattcagtcgaccgttttcatccttgaccaacaataccgtagcaatatgaacgcccaaatttggtcgggtcgcgccttttacgcgccgctttacaaagagctcgacttagcaaggccagtggcacacgctcagcaggaattgcgactgaaccatttgatggatcgacttgtgctggacgaacggacggtgaacaccgacacactgacgctggtggacaccggcgcattggaaggccactggacggagacaatgttcaaa

SEQ ID NO: 62766 - DNA, 1201 bp, Heterodera glycines
  Genomic contig location: Contig_ID=SeqID_32457; Location=230..1430; Strand=-
  SCN-specific regions: Sequence locations=1-184,206-353,389-400,424 -800,880-894,953-990,1116-1201
accaacagtcggcacaggcgaccactccccaagtgccgtgcaatccgtccctttgttcggtggagaaatttgcggtcaaagtgtgcccgcgcacgtgcggacgatgcgtggactatttgcgcagcatggagcaaaccaaatattgtgacgatacggagaatgttgacaactgtatgatgctgaaggtggccgggggaatgaggacgaatttgaaaatagtggcaatggcatttagcaaaaaaaaaaaactcaaaatttgaatgctggcaatgacaataataaaaaaacctaatttgaagatggcaatggcattttgctgagaaattgagcaggcacttgaacaatggcatttgaaaaggacaaatggcattttgccaaaaaataaatgggtgtgatggcattttgccaaatttgtcaaaattttattgtcaaaatttttaatattggcaatgcatggatttgaaggagatggcgacggcattttgccaaaaaaattgaaagttgagcccatatcaaaaaatatcgaaaattgaaaaatggctttggcactgttgaacgaaaactccccgaatattagacaaaaagttgagaatcttttttggaatatctttagatttatcttaggctaatatgctttctacaggaatcgggcctttgtgcgtccgccgacgcggccgaaatgtgcgcgttgacgtgcaacgacccggcgaacaaccagctttgcgagcagtacacgcgcaaagtgagcgccgctgtgaccgcaatgacgggccaacccgggggcggtgagcacaaaatgctataaaaattatttattaattaatactatatttttattaatttacggaaatacttttaattttatttaattttttttttgaattttcaggcggctaaaaaattcttaattaattaattaactttcaattaaactatttttttaatattaatagtttaatgaaaaggcataaaaattttgaattttataaatattttaattttttattctttacaaacttattttaaaatattccaatttattattattttattatatcaatttcaatattctaatttattaaatattaatttaaatattctaattaattttaattatgtaaatttaaattcagccgccgctcgggtaaacggcgatctgagcgacgattgtccgtccaacaaaaatttgtgcaacaatgag

SEQ ID NO: 62767 - DNA, 541 bp, Heterodera glycines
  Genomic contig location: Contig_ID=SeqID_32460; Location=122..662; Strand=+
  SCN-specific regions: Sequence locations=1-102,124-332,355-517,539-541
atgagcgcacatcaaagtttgcttgataagctttccgatcagcaacagaacaaaaaggcggcgccttcgccttcgtcgcccgagcgaaaagtgtcgccaaatgcatttccaaaaatggaaattgaaatggccaaaacgctgtgcactcttccgacgaatgtgcgcgacgaaatggcagaggtggaaaaaacggggagacaattagcaaaaggggcagcaattagtcggagtcaatggaccaattaagggacaatctgagagagggggagatgatcattctgagggcatggaataaacatttttgtaatttgtcagccaaatgtcaaagaggaagagagcaaacagacaaaaagcgaagggatggaagtggtcaaattgggagaatgcgagcgcgacgacggcatctgtcggtaatatgattgtgacttttttttgacttttttatatttttgggatttttatgaaatttttgcacttttttttgactttttcgtgactttttaaggcaaaatttggattttagtgaagaaaattctgaaaa

SEQ ID NO: 62768 - DNA, 1309 bp, Heterodera glycines
  misc_feature (17)..(17): n is a, c, g, or t
  misc_feature (36)..(36): n is a, c, g, or t
  misc_feature (87)..(87): n is a, c, g, or t
  misc_feature (121)..(121): n is a, c, g, or t
  Genomic contig location: Contig_ID=SeqID_6757; Location=1..1309; Strand=-
  SCN-specific regions: Sequence locations=1-403,425-568,590-670,692 -926,948-1049,1073-1272,1297-1309
  Gene Ontology: Mol. function=ATP dependent DNA helicase activity; Cellular component=nuclear telomeric heterochromatin; Biological process=DNA replication
aaaaaggaactcacttntgcattaaacaaatattcnttaatgaatgaggaacaaaaaagaaatttttgattgcgttaaaaatgtttntgaccatcctgaaaaaaataaaggaaattgtttntacattgatggaccaggtgggacgggaaaatcttttgttcaaattgctttatttcacttagcccgtggttttggtaaaaaagttacgaacatggcttttagtggaattgcagcaacactattaaaaatggacgaactgtgcataaccgttttaaattaccattagatttaaatagcaattcttattcatcaattgaaaatggttctaatgaagcaattgaaattcgaaatactgatgtgttcatttttgatgaagcccctatggcacctaaatatgttattgaaataattgacaaaaaattaagagaattacataataatgatattatttttggaggaaaaattttgattttaagtggagactttcgccaatgcttacctataaaaaataaagcaacgaaagaagaaattttagatttgtgtttgcaaaaaagtgatttatggattcattttaaagtatttcatttaaatcaaaatatacgaacaaattctgaagcactaaatttttctgagcaacttttagaaataggaaatggtaaaagaaatgaacaaaattatatttttcttccagaagtctgtgatatcaaagaaaaagatttaattgaagagatctttggcgaaataattaatacaaaagaattttctaaattatgtagtcattgtattttagcaccgtataacagagaaattaacatttataacgaacaaattttagaaaaatttcaaggagaggaatatgtatttaaaagtattgatgaagccgaaagcaaggaagcccctattcttcctgaaatactcaataaactccaaacaaatagccttcctgatcatgagcttaagcttaaaataaattgtgttacaaaattaataagaaatttaaatgtaaatatgggattatgtaatggaacacgtttacaaatacttgatattgaaaagaatgtgttaagggttatgattttgacgggtgatagaacaggtgaaatcgattttatcccaagaataactttgattgaggataaaaaacttccctatgtgcttaagcgccatcaatatcctttaaaattagcattttgtatgactattaatggtgcgcaaggacaaacatttgaaaaagttggaattgatttaacaagagacgttttttcacatggacaattatatgttgcattatcaagaacacgaagctggg

SEQ ID NO: 62769 - DNA, 80 bp, Heterodera glycines
  misc_feature (8)..(8): n is a, c, g, or t
  misc_feature (59)..(59): n is a, c, g, or t
  misc_feature (78)..(78): n is a, c, g, or t
  Genomic contig location: Contig_ID=SeqID_6757; Location=1216..1295; Strand=+
  SCN-specific regions: Sequence locations=1-80
atggtcanaaacatttttaacgcaatcaaaaatttcttttttgttcctcattcattaangaatatttgtttaatgcanaa

SEQ ID NO: 62770 - DNA, 3067 bp, Heterodera glycines
  misc_feature (3055)..(3055): n is a, c, g, or t
  Genomic contig location: Contig_ID=SeqID_6758; Location=122..3188; Strand=-
  SCN-specific regions: Sequence locations=1-47,79-206,246-333,355 -566,588-617,639-650,672-898,930-931,953-1013,1035-1318,1344 -1546,1568-1576,1598-1748,1771-1788,1810-1887,1909-2246,2274-3067
atggttcgaactaaacaattatttccctctgagcttcaatgttcttcatcttctttacaaaataattcctcagaaatctctgaaaaccaaacgggttccaagctcccgtctaaaaaagcggttaaaccggttcaaagctccggaaaaaagcggacaagaacaatgtttgattcttttgaaagaatgcatatgaatgagaaaaagaacattgggaatgaaatgaatttggaaaatgttataaatttggatatgattgattttgaagaagttaaagaaagcgatgaaatagaaagaaaaagaaagaaaattggaaaagatatgaacctggaaagcgttataaacctggatatgattgatttagatggagtaaacgaaaccactcaaacacaaaaatctcaaccaaataccaaacgtataccgacgggttttttgtttaaaagtgcagcagaactaaacaatgtaaaaaaattctctttacaagagtttaacattgaatgtatattttgcaaggcagtgcattttatagaagagcaatcaatcaaaaattcaaaagtgaatgaattccattcatgttgcaattttggaaaatcaaaaaatttgttggaattatttgatgaatatccatttgaattaaaacagttgtttacagaagaaaatgaaacttcgaaaaattttacgaataatataagaaaatacaataattcattcgcttgcgcttctttagcttgcaatagatttggttttacaactccaggcccaagttgttttaaaatatcagggcaagtctatcataaatataatgcagtagcacaaccaacagaacaaaaatttttgccgacaaatggacaattgtattttttggataatgatgacgcacaaaacattcgattacattcgcataatttaaatataaatatattagataaaatcgaattaattcttagaaaaatatacccgttcgctaaagcctacgaaatgatgaaaaatgtaatcgatgaacaaaacaagtcaacagtgagaaataaaaatgaaaaacaggaagtaaaaatgttaatgagtttgcgaaacggtttcgatccaaaccgatacaatgttcaacaatcaaacgaagtggccgcaattatagtagccaatgcaagcgatgagataccagcagcaaatataattgttgtcgaaaaggggagtaagcaaatgaaaaatatctacccattagaccccaatgtcgaaccattaatttatcctttgttatatcctttgggaacgaaaggatggaatttcgatataaaagatcaaaaaggcaaaaaaatttcattttgtgattttataaaatttaaattattttacagggaaaatttttttttacctcatcattttgcaaagaggctttttcaacagtgggtcgtagaccaagcggcccgtgttgaatgggatagattaaatttcattaaaacacaccaaaaagagttaagagcatgtagctataaaggattagaagattacctttttaacaaatccgaacaaacaggagcagttattggaaaacaagtcattttaccttcttcttttttgggtggaccaaggaataaagaccaaaattacattgattctatggcaattgttggagaaaatggcaaaccggatttgtttttaacatatacaattaatcccgaagactcagatataaaaaaatgtttattaaaaaatcaaaaagcagaagacaggccggatatagtagcaagaatttttaagttaaaatctgacaaattaattgaggaagttgtaaaaggtgaaatttttggtaaagttgttgcttattcttgggttatagaatttcaaaaaagaggtttaccgcatttacatttcttaattactttacatccaaaagacaaatttaaaaatacaaatgatattgatcaatttatacgtgctgatcttccgaataaagaacaagaacctattttgcggtcattagtaagaaaatttatgttgcatgggccgtgtggagaatcaaataaaaatgctccatgtatgaggaatgaaaaatgtcgatttaaatatccgaaaaaatttagagaagaaacccaattaggagaagatgggtatgctttatataaacgcccgaacaatggtgattttgaatttgttaaaggccaacgattaactaatcaaaatgtagccccttacaatccgtatttattattgcgttttcaatcacatattaatgttgaaatctgttctgaaataaatgctgttaaatatctctataaatatatttacaaaggatacgatgcagcaacagtagaatgtgtaaaagaagagccaaacggtgaaaaaacatttttgaaatatgatgaagttggtcaatacttggaagcccgttatttaagccctgttgaagcatgttttcggttgttaaaatttgaattacagggtaaatctcattcaatagaaaggcttgaggttcatttagaaaacgaacaaacaatttattttgaccatgatgcaaacaacgataatatagaagaagcgatggaaaaagatagtaaattaactgcttattttatttttttaaagaaaatccaactgctccaaaattcaaatacattgaaatgccaacatattgcacttttgacaaaaaaaaatagaaaatggaagtggccaagaaaaggtccacacaaagtgattgggagaatctatacgataaatccaaaaaacaaagaattatattatttacgttatttattaattcataaacatgcgacaggctttgaagatttaaaaactgaatacacatcatattcagatgcctgcttggctttgggcttaactagagatgacttagaatgggataaatgtttaaacgaagcgagccaatttaaatttccaagaggccttcgctcactttttgcaaatattctcattaactgtgaaccaaaaaaaccaggcttattatgggataaatataaagacgcattaagttatgaccttaaaaaattacattctgaaaatactgcttatcaaatggctttgtcacttattgataaaaaccttttanatcatggaaaat

SEQ ID NO: 62771 - DNA, 1563 bp, Heterodera glycines
  misc_feature (614)..(614): n is a, c, g, or t
  misc_feature (646)..(648): n is a, c, g, or t
  misc_feature (682)..(682): n is a, c, g, or t
  Genomic contig location: Contig_ID=SeqID_32462; Location=198..1760; Strand=-
  SCN-specific regions: Sequence locations=1-62,113-309,332-396,418 -483,511-632,681-793,815-879,902-1139,1168-1371,1411-1446,1469-1563
cttgatgaattgagaccgacagaagcatacatgagcataaaactggtaggaaaactaattgctataattaaaatttaatcatttttatattaaattttttaaatataaatttgaattacagaaagctgacgaccctctggcgggtgtttggtggaacctttatatcaatgaaaaaaatgcaaaacgaatcagtgaacgatttaacaaaaatattttgaaaaaacaccctgaaatttttcgtaaatttcccatgcaagtgttttacgggagacaattctcgcattgctattcaaaattcatgattgcatgggctgctgggaagctgaaggaatgcccaggtaaaaataatgaataaactcataatgaacgaaaagatttgaagaacactctgttaaaaacataaaattttgtaaaagctaaaaattgtctcacatttttttcatgaataatattcccgtaagaataatttcgttgaaaaatggtatcagtatttttattattattgtttttcaattgagtaaatgcataaaataggcactaaaaagtggaaaagaggctcaaaaaagctcaaatttaaggggtgtaaaatggacaaatttttattcaaagcagcnaaagcaaaatgagtattgaatatatataattnnnttaaatcaaaattatttttactaataaattttgngcataacgccaaaataggcaaaaatagctttttaagatatttttggctttttggctctaaaaataaaaaaattagaaaataggccctaataactcgaaaagtagcttaacaaccaccaaaaaacatgtttttggtgcgcttcaggtcaatgggagctcaggaaaaaataggcaaaagcagaaaaatttcgatcgatcatataattaaaaatttaaatttccagggccacatcactgcgaaatccagccgattgccggattgaattgcacaatttcaaaacgtatatttgtgccacataaattgtcacatggagtgactttatacgttgcacctaatgagggcgtttttcaattgtccaccacaggatgcacattctgatcagtcgaaattgatccgcttcaaatatcacttggtttctcaatgctattaaaaattttggcgcttattaaaattggcaattttttaaatgtttttaattgatttatccattagcactgtgctcgctctgttctgatttctcagaaatgttctggttataagaatattcagattatggggtagcgactagagaccggaaatttcaaatttgcggatcccgctgcgggattggaatccaaaatttttttgcggactgggatcccgcaaaatcccgcgcggaatccgtcccgcgccggtctctactagccaccaaattttttattatgatttcttaaaaaatttataattttggcgttttgtttcgttatttttggtcttatctcaaaattttatttatttgggacttctggactttggttttttttgttttgtgattttggatatttttgtttctcaaatcgcctcccattttttctttattattgtgcttcacttttaataaa

SEQ ID NO: 62772 - DNA, 767 bp, Heterodera glycines
  Genomic contig location: Contig_ID=SeqID_32463; Location=143..909; Strand=-
  SCN-specific regions: Sequence locations=1-109,137-215,237-319,341-767
  Gene Ontology: Mol. function=voltage-gated potassium channel activity; Cellular component=voltage-gated potassium channel complex; Biological process=potassium ion transport
tcaatggaatgatgtaaattcccccgtaggcaaaaaattcatcgccgaagcaatgccatcggcgggggggggggaaatgccgcacgtccaaaattgaaaaaaccgaatgaacaacgaatgaatgaatgaatggcaccggccgaccattttaatgggttttttttctcttgggagaattttattgcccgaaatggccttagccgccttttcaaccaacagcttaattaattaaattattgatttggctttggcaagtaaaaggttgcatttttaacattatttttacgactctttgctaattccatcagaattagcttaatttttgttattcatttcaataccgtatcccccctaattgtcactcttctccttttttttttaccgtattagcagtgcatttggataatttattttttttcttttacttattttcgcgcacccattaattattgtcagtgtcgccggtgacgtgcatggacgagcgagtggtgctcaacgttggcggaattcggcacgagacgtaccaggtaaaggaagtgccggagggatatgccaatgccataatttgttgggatttgtcctaattattcgaatcaaaaaattgttaggattgacaaatttatgaaataaattgatgaatttgttcttcttaggccactctgaagaagatccccgccactcggttgtcgcgtctgacgcccgctcagtccaactacgacccaatgcttaacgaatactttttcgaccgccatcccgcagttttcgaa

SEQ ID NO: 62773 - DNA, 554 bp, Heterodera glycines
  Genomic contig location: Contig_ID=SeqID_32465; Location=79..632; Strand=-
  SCN-specific regions: Sequence locations=1-262,308-350,381-423,445-554
gttggtggaagttgtatcgcgtcgcttcggcccagcacgccgcgcatcagtgccaatggcatgcaatttgctggcggtgtgcaccaaaatcgtcaacacggcagtggcagcgaatacagcgccgaatggtggctaaactgatattttaaaatttatacatcagaaagtgagaatgaaggtgcctcaaaaattctcgggcaatcattttaaaaaaaaattcatgcagcgctaatttgtttacaagttttatgcctgccataagatttttttaaatattttattcagaatttaattatatattaaaattctgaaattctacctttgtagggaaaaacagaagataaacatagttataatttatataaaatgaaaattatatagatgttgaaaaaattgttaagtgccgcgcagcaaaattatgccaattttgtgatgccaaatttgaatggaaaatatcgcaaagaacagacaatggacgaagcagcagtgatccgcccaaaaagagcctcctctttggcaatcagtgtactgcagaggtggaagcaattaataaa

SEQ ID NO: 62774 - DNA, 597 bp, Heterodera glycines
  Genomic contig location: Contig_ID=SeqID_32470; Location=434..1030; Strand=+
  SCN-specific regions: Sequence locations=1-34,73-293,338-597
atgttaccaccggtggtcttttattggtatcaagaaatataatatgaaataataataataataattaaataacataaatcataaacaggttcacttccagcacatttgtgctcggatattgtgttccattggtgcttatcatttatttcaattcacgcctaatccgaaaactgtacaggcacacaaagtgtgatgtggaaattatagaattgtttcttttcctcaaacaaatttaatttttaagacagctcagaagtggaataccactccgtcaaatcactatatatacatcgtattttaatattttaatttataaattaaattattatttttatttgagtctgatcgccgctttgtatttcatttgttggactccatattggtgagttaacattaataagtttgaaattgtatcaaatttcaatttctaatataattggttattaaggcggatttcgcaacataattttcacaaaataaggaaaatttatttgaaaatattatcgtcaaaatttttttctaaaaagtaggcgaatttatgtcaaaaataagccaaaatttgttttaagggaattatgacaaaatttttctctcaca

SEQ ID NO: 62775 - DNA, 1362 bp, Heterodera glycines
  Genomic contig location: Contig_ID=SeqID_6759; Location=2455..3816; Strand=-
  SCN-specific regions: Sequence locations=1-768,790-1045,1086 -1190,1212-1362
atggttcacagtcacaatcaaaaagttggaagaggagttaaaagcgacccaaattgtcaaagacagtgctttgtcactcgtttccacgaaatctccaacaaatgccatccgaactcgccctcaacagtggcgataaacaaaacccaagaccaaattgccgtgcaacaaaactactcggcacagcaaaaacccgtcacaggatggaaagcaaatcgtggacaaccgttccagccatgcggctcaagtgggggtactgatcactggagatcagattgtcgtttccgtgaaacaacatgccacaagtgcctaaaacaaggccacattgttaatattagcgaaaaggggcattcacgccaaagaaccaacaccgttcattccacacggtccaagtcaaagcaacatgttcacaaattggcacaacgcaaggatggtggtggaaaattttggtcgaaatcaacggcacaaaaaccgagatgaaggtcgacaccggagctcaggcgaagtctttagcattgaaacatggaataaattaggactaaccgaaattgttgccaaccgacattgagactcgcaactctaacccgatgacatttacgcagccttaagcggcgccgcatttttcagaaatttggatttaaaagacgcatatctacaaatggaattggatgacgaatccaaaaagctctgcgtttgaacacgcatcgtgtcctttttcagtgccagcgtcttccatttggcgtcaaatcagctcaaatatgtgctggtattcctggagcatttgcttatttggatgatgggataatcgcgtccaaaacccttgaagagcgcttttcagccatccaccaattttttacgcgcttcaaagcatatggattgcgcattcaacttgaaaaatgcaaattcttacagacagaattgcctcttcgctcatttctcggagcccttacttactacagtcgttcatcaaaaaggtgcgtgaactcagggcaccactggaccaacttctgcggaaagaacaactttggaattgcggtgaagaccagcaaaaagctttgaaaaagcaaaagacatcatgttgtcagatctgcttttaacccacttcgacccctcgcttccgataatcgtcgcggctgatgcttcaaaagatggaattggagcgaccataacgcgaattatccgcgaccagaagaagatattttgatagcaaaaatttgcacagaatctgaatgtttcatcgacaattttgcagtcacaaattgatcatcttcccgtcactgccaccgactcaaaaagatgaaagtctacaaaaagtgataaaattcacaaaggaaggatggtcaccaaataaacagccactacaac

SEQ ID NO: 62776 - DNA, 108 bp, Heterodera glycines
  Genomic contig location: Contig_ID=SeqID_6759; Location=5669..5776; Strand=-
  SCN-specific regions: Sequence locations=1-108
gatttgaagaaaggagctcaaaaaacgcatttctgcattaaaatttttcgattctgatgtcattatcggtcactagaaatcactattttggcgactccgtcactaaaa

SEQ ID NO: 62777 - DNA, 1353 bp, Heterodera glycines
  Genomic contig location: Contig_ID=SeqID_6759; Location=7077..8429; Strand=-
  SCN-specific regions: Sequence locations=1-128,150-239,261-319,342 -350,372-785,811-912,938-968,996-1109,1131-1245,1267-1353
ttccgacatggagcagccgtgcgccgagggctgctgtacatccatcttcggcttctggcaccaaatgagtttgacatcagacacggccaaattggccaaggaggtgggcaatttagacacgcccgagggcagtttagaatgccggtcaatatgattgacgcgagaaggggaaaaggcgagaccaatgaatgcattgcgttcgactaaccctgaggcgtgtcaaagcatttgcgcaacggacatttttgccccatttcttagggctttattcggtcattgagccccattcgtaaggattttttcggacatttgcgccccattcttaaaaaacctcaacaatgctctttttgtgtttaaattttaccaaaaaacccgtatgcttttaaaatatagataaattttgatttttctatttgtgactttttttaaattttatttttctgtttttaacagaagcgaacaccgttcagcatggccgatgatgatgggcttgacagcagcgggcattcctcgtccagcgcaagtgccggcttcataccgaaggtccaacatggcggcggtggtggcaccgtcggcactgctgccgctgctgcacaggcgtcggcctcgtccaccggggtggcaccggtacatccgttgacagtcacctacatgaaggcgtcgtggaccattgacaatcggtgaggggtggacacacatgaaaataaggtggggaggtcaaccggaattttttcgaaggggtctggggggttgaggagggggaggggtcatcggccaattttgcggaaagaggaagagaaagcggaagagaaaaaggatattgccggccattacaaaatccaattgccctttattaaagtttttttgcgcgaagtgccctctagagacagtgttaaatagcgaagctatttcaatttttttttaattaattaaaaatcttttacagtgcccgtagggtactggttgggaaaataaaataaatatatattttattacagggacatttgtttggtgatagcggaagatgttcaaaaggcacacattttctacaaaattttgaacaacgaggcgttgaagatgttcaaggtttgtacagtgaatttttgacgtataattttggatttgttgaacaaaatttgtctcatttagtttggtgacggaggcttttcatcgtccacacaatgttcaagccgtacgggcggcagcggcggcttgagtgcgaactccaacagcaacaaccagcaacatcgacacgcttatgcatcttctacacaacgtgcagccggcaaaaagcattcgacgtcggcggcagcggtgcgcaaaatgaccgccaacaacaacactgaagtataa

SEQ ID NO: 62778 - DNA, 531 bp, Heterodera glycines
  Genomic contig location: Contig_ID=SeqID_32473; Location=1..531; Strand=-
  SCN-specific regions: Sequence locations=1-57,83-210,236-391,418 -496,518-531
ggttcgatgaaactttttaaaatataagcctaaactttttggcctgtttaaaaagggattaaaaatttttaaaatatttattcatctcccttttgatagaaaaagcatcagagagccttatttaacttttaattaacatttggtgcgtttcagagcactttctgaaaaaatacttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttcagaaaaaatatttatgaattgattttgctaaaaa

SEQ ID NO: 62779 - DNA, 160 bp, Heterodera glycines
  Genomic contig location: Contig_ID=SeqID_32473; Location=687..846; Strand=-
  SCN-specific regions: Sequence locations=1-26,64-160
aaaatataagcctaaactttttggcctatttaaaaagaattaaaaatttttaaaaattttattcatctcccttttgatagaaaaagcatcagagagccttgtttaacttttaaataacatttggtgcgtttcagagcacgttctaaaaaatatttatgaa

SEQ ID NO: 62780 - DNA, 779 bp, Heterodera glycines
  Genomic contig location: Contig_ID=SeqID_32474; Location=390..1168; Strand=-
  SCN-specific regions: Sequence locations=1-5,28-421,443-476,501 -533,555-753,775-779
atggactatctgttgttcagcagcaacaaggtggtgcgtgccatttacccggagatcatgcagaacgcattggcggaagcaattttgccaatttcgccgtcctcacagcgtcgcattggctacttttttgcggttgaatgtgacgtacacgggggcaggttagcgggcgagacattgggcatttagcgaaactataccattattaatgtgaatttgacgagaatatgcattattaggggatacaaggtcgagaattataccatattagggcgaaatggccgagaattatgccattttttgcacattgatcgagaactatagtaccgtattattgtaatttaatcgagggttgcaccgtattaggttgtactattgagggcgcattgatcaagaatcataatatattagggttacggagaattacgtatttatctaaaattttcgtataaaacagttaggtaattatcaatgttgggaatttataaaaaatttttaatttagccaatttatcaaaaatcaaaaaaaactaggccgaaattaagatatttttgaaaaaccagcacacttcgcgcaccataaaaaccatttacagcttcttctacgccgacatcatggacaacacgctgtaccgggtgaagccggacggggaaggggcagcaccaattctggtcacccacaacgacggactggtctcaatggcattcgattggatgtcaaaacagttgtactatgtggacaatgtgcgcaactcgttggaggtggtcaaggtggaggagcag

SEQ ID NO: 62781 - DNA, 304 bp, Heterodera glycines; identical to SEQ ID NO: 51570
  Genomic contig location: Contig_ID=SeqID_32475; Location=400..703; Strand=+
  SCN-specific regions: Sequence locations=1-304

SEQ ID NO: 62782 - DNA, 280 bp, Heterodera glycines
  Genomic contig location: Contig_ID=SeqID_32475; Location=780..1059; Strand=+
  SCN-specific regions: Sequence locations=1-280
aaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaatttctcaaaaaagagatagccatttttctgggatagagtataaattaaaaatccctcaaaataaaggtctattgcgc

SEQ ID NO: 62783 - DNA, 630 bp, Heterodera glycines
  Genomic contig location: Contig_ID=SeqID_32478; Location=188..817; Strand=-
  SCN-specific regions: Sequence locations=1-57,79-630
atgcgacaccaaatttcctggtccgatgaggctgtccttcatgtactgttccccgttctgctgccgctgctgttgctcaccggtgtggtcagaagtgggcaacccatctcgggattgccggacgatggcggattcgacatgccggagaggtcggacggggccaaagtgggccatttgagacacgcattcagcattttggagccggagttggcccagtcagtttggagccgagagggcctgaaaaatccgatcagacggaccacaaccattccaatgaatgatcggttggacattggaaacaccggcgaattgcaaccgaaaggtcgtttttctgatcagagattaagagcaattaccttcttgatcactcattcactgtcagcaggcgccaataagccgatgaagcgaaggccgagaaaagccgagactgtcagcgaatacgacacactgaacgacgactttctgacggagtacgacctgctgaatttggacttcagtttggacgaaccgcaggacgggaaaaagagtgccaaagaggtggaagtgccggagaaggaattcgaatgggaagaaggcgaaaaacgaaaaggggaggagaatttccctcccaaggcgagcaatgaattttaa

SEQ ID NO: 62784 - DNA, 374 bp, Heterodera glycines
  Genomic contig location: Contig_ID=SeqID_32480; Location=508..881; Strand=+
  SCN-specific regions: Sequence locations=1-222,244-268,291-374
atgcctctatttgccaattgcgtcaaagcatcgttctgctgctccttcagctacaaaatatcacagcaaacggaagaaggcgtcacacgtggcgacattatggagaagatcgtcaacttcaagctgatgcaatttgtgctcactttggcattcatttggcaactcatttcaatgcgccaattctgcggcacttttgccgacccaaaagtcaattcatttaaatttcacaaatgatcaaaatgttgtgattttcaggccttcatccatgaaaacatttcagttggccattgcaaacgttttacgctcataggaaaggactcaaaaactggcgatttcggcgctgtgttcgaccaggacaaatggcacaaccaaat

SEQ ID NO: 62785 - DNA, 736 bp, Heterodera glycines
  Genomic contig location: Contig_ID=SeqID_32481; Location=155..890; Strand=+
  SCN-specific regions: Sequence locations=1-509,531-662,688-736
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggggcgcttctgataagtttctgaaaaaaaagataagcctaaactttttggcctgtttaaaaaggaattaaaaatttttaaaaatttattcatctccctttttgatagaaaagcatcagagtgcctaaactagcatgta

SEQ ID NO: 62786 - DNA, 849 bp, Heterodera glycines
  Genomic contig location: Contig_ID=SeqID_6760; Location=279..1127; Strand=+
  SCN-specific regions: Sequence locations=1-287,309-624,646-849
atggaaaaatggtacaatttacagccaaaagtgacaccaaacaaataccaagaaggcgaacgcgtcatggttaaatttccgggcacaaaccaacgatcgactcacaaaaagttgcgatggaatatatttggtccttatgaaattaccgaaatttcaaattcgtcggcaaaagttgtgccaatagacaaaaggaccgctgaacccttaagtgtgcctttagaacgattaattcatgcgcctaatggaatcccaaatatttgcacagctccgcgcggcagaaacgcttataaaaatgtaataaatgtgatggccatcttagaaattttggaatgtggaaattttgagaatgttgaggcggaaaatttagtggaaaattcgaattcatcagagacgatgaaaattttagttgccggtgatagaatggagattgacgaggcaaaaatcagctggacaagcacttgtgaaggcggagagcatgtgctctgcaaaaagctacttgccgcagatttggacccgattctcgacaagtcccaaggcatcggcgcgatgacaatccaaacgccgctccaagggctgctcactcttttcattctccgggcaaatatcgccatgtcagcgagcaaagaattgctcaaggtgttgttaaagtggaaaagaacggacggaataagtaaattgcaggcgattttaaattcggacccggacttcgaactgataaaatatgtcgaggagaggggagacgcaatccgatccggaagctgcccacgcaacgaagaagtcaaaacaatttggcaaaaatggacaaattgctgtgcgatggttcacggaaacctgaaaatgtccggctaa

SEQ ID NO: 62787 - DNA, 56 bp, Heterodera glycines
  Genomic contig location: Contig_ID=SeqID_6761; Location=2206..2261; Strand=+
  SCN-specific regions: Sequence locations=1-56
taaagcactcgtgttgtgctcttcaagattctccaataaagcactcgtgttgtgct

SEQ ID NO: 62788 - DNA, 5666 bp, Heterodera glycines
  Genomic contig location: Contig_ID=SeqID_6761; Location=1..5666; Strand=-
  SCN-specific regions: Sequence locations=1-272,294-354,377-437,460 -732,754-1358,1381-2119,2142-2622,2644-3104,3127-3903,3925-3981,4003 -4223,4245-4333,4355-5594,5616-5666
atgcgattaaggatgaatttgttgcacagacgacattccaaatcctccactcggcggttggcggagtcgtaaattggtagaccggaagagcgggagatgacgttgttgttgatgttggcggatggaagattgcagccaaaatattcaggcctccgccgctttctcacccccaaattggcctccatttcgcgcatttgctgctcataaatctgttgcgctttcactgcagttggtccgggagtgtttcctttggtgcccagcaattgcattgacatttcttggaccatgttgtacaattccatgcttctgtcttccatcatttcggcgtcaacttttccgtgcgctttcgactgatggttttccatctgatccttccgatagtcttgcactttgcatcccgcatgtttgcaacggaaacgataagtattcatgtctttgccaaggtggtagaacatgtgcatctgacgagcgccggcagtgatcggtttgtcgcattcggcgcacaaccccaacacgcgtttcttggaggtcattggtccgggtctgttgcgcacaatgcgtcccaagcaatcgtcagcattggcaatttgcttcaactcttcaactgcagcaatttcttcgttttgtttcaaaattactgctttgtgtgaaaaatttgtgattgccgtaatcacttttccctttctgcctttatctacagaagactcaaccctaattctgtcattctcttcttttggagtgatcaaaacatttttgtcgtcaaaatccggcgaaattgaaagttcaacaaattttgttgaatatggttcaaccaaagtactgtaaattacacgcatagaatcagacttgttgtccacacactcaaattccactaattcgccgttgggagcatcaaaaattttgaacccaaggagcccaagtgcatttgttccaaacaaaattggatgtccaataggcgcatccgtaatgtggaacataatttcaactgcttcacaacctcttctcacaactggcaacaaaataattccataacactcgacacgctttccattaatgtcaacgacattccgggttttcggccaaattttgagatttgtgccttccaatttctgactttccaaaatatttttaagaaactccgccttaataagtgaaacttgtgcaccgccatccatcatcgaaatagcgggctgatcaaaaattgtaacattcgttgtcattattttgccgattaggcacagttcctttttgccagcagcttcaaaattgtcttcgtgctcctcccaaaaacttttgaaaaattcctccatctcgggttcattgttcagaacacctgtgcatttgaccgcgtcctcattgtctttcacttcttttctttcaataaggaaattttgtttcaaaaaatttcttgattgaaaatgttgaggacggtgctgattagcattttgttcgggtttgctcataaaattcgtatttgggttactcggcattggggtacagtttgcaccagtcgttgggatatgttcgaagtttcgcatttggccattttgttcggcttgacgcctgaagcaatttctggcaacatggcccaattttccacaattgtagcattttgggcggttgtcgttcgtttgctgtgtttgcgaattgttgaaaaatcctcccgttgaattcgcttcattttgcctccctctttgtatagcattttgcgatgccatccgacgggttgccctttgagtcgcttctgctctcgccgccatcccgacaaaatgatcaaatgtcattccgggtgtccttcccaattccaaactgagtgccaattccgaattgtcgaatgttcgaatcaaatgcttgatagcataatcatcgaccaggtgatcagtcaaacctgggtatgcgcgtcgtaccagggtgatgacacgttcagccaaactgtccaaatcctcgtcgttttttcgtcgaataccggtcattatctgatcaaaagcactccattcacgggcatccgtttcttccaactgccgaaacatttctctttttatggactcatatcggtacggttcggtggaacacgcagacttaaaagctctctcagcccgaccaaagagttttgattctaatgaggtaatgcgttttgcattggaccattcagcggtattagcgtcaaaacgcttgaaaaactccttaattttttcagcgccttcatttccctttaaataaggtatttgactcataatcagagcatatgcgacttggtccatcccgggaccacggatttcattttcagtttgacgaatttcagcacccgcattttgagtaccaaaattgtttggacggtttgtaatcggagggttttgctgctgggcaacaggttgaagaacttctctctgctgatttgcttgtacaattggctgctgttggctaggtacacccattgcataatttgcatgctgcaaaactggtggcggaaattgctgattaaaaatcggcggttgttggaggtttgggtttacatagccaaaattttgctgtggagggtagccaaaagcagttggataaggaccgtaaggaaattgtcccggataaccccagataaacccaggaaatccttgttgaaaaactggttgggctggcatgggttgggatggctgttgtggttgcgtttgttgaattgggtgcggatgaatttgctgaggatgcgactgaagaccggtgggtgcggtaactctttggttctgcatagctacaccattattcaacatgttttgaaaatttgcttgtaaattttgattgtgcggtctgcattctacggtgtgctctacgcgcaactcttcaaacatattttcgtatggggttgaagtcctaggtctaacattttgcggcgcgggatgtaaaatgcgatggccatcattcgaattttcgtttctaatttgccattgttgtccgttatttctcccaacgttttgcaatcgaattcgcaaacctccatcaacatgctgttgctcgaaatttcctccgcctcgtcccgcttcatttcgaactgcttgttggccattctgttcatccggtgccgcgacgtccaaaagcgcattgcgaatttcgttggatcccatgctttcttctgactctaaaagttcaccatcaacccggttattcaacgaaacatttcgattttatgtgttagcggtgttattcggcctgcttaaattccctacaactccgttttgctgttgctgtaatgccgccgcatctcgagctcgttgtctggtgaatggtggagagcggttaatcatctttttaaaacaacacgagttttattggagaatcttgaagagcacaacacgagtgctttattggagaatcttgaagagcacaacacgagtgctttattggagaatcttgaagagcacaacacgagtgctttattggagaatcttgaagagcacaacacgagtgctttataattcggtgggatgcatgaagagtccaacacgaggacagaaaaaatgataatgtcgatatatgataatgtcgataaaatccaaaatccaacacgaggattatcgcaacttatatggccgacgtaaaagttttccgtttagtcgtcactaagcaagccaaccttttgttgcaggagcgccaagttgaaaacaaaagcttgtttgcgtccacttttcccaattcaaatgtcaaaacggcgattgtcaacagttctctgcgatctgtctttacaaaacaaaacaaaacacaaataaatttataccaaacagttaaaatacgacgacaaacaaaaataataaattcagcacaatttcttctccaaaattaaaaactacataaaacaaccaaaaacatcacaaaatatattgagtctcttaaaaatatacgaaacgccacagaaattaataatttaaaattgaaatgaagtcaattagcacatcaccgcccactagaaaagacggtcccctcggcttacaataacaaataaaataagcaaaaacaattcggctaccgatcggtggggttcaaggttgtgctgcttaatgacgacgacggctgatcatctcgtttccgcctctgtgagcctgcgagctataatggtgacgaacagcataggggtgagatcgagaagtgcgagaatggctgagagacaattcagagatgtgatcagatacagatggaattgagcgagatgaacgacgaagaccaagagcattatcatcggggaagtttgggatttgggtaaaaatccaagcgcgaaaacatttcaatccctcagacaaaattttcccatccgaacgaatccgtgtcatgtcgaacgtctcgccaaaacgccacatctccaccaggcttcttccgctcgtcgtcagtgcgatgaaccattcaccagcgactgtttccagggtcggcaggagttcattgtacaggttgtgctgctctcggacgtacggtggtggcaaccaaacaaaatgaacatgtttgaatttggcacaaatcccacgaatccgtccacattcttctgcgatctgcgccacggtttcgcctcgtagcatggcatcccgtcccaaaatgatcagtgccgccacaactttggaagtcagcaccgccttgtccagtgcccgaataatatcgccaattgatccgttgacggtcccgatgaaatgtgccgggatttggtttcctgctccaccacagagttgtgcaccagtggagtcgccgattacgaccctcggttgttccaccaatgtcgttttttcatggacaacgactgcgcgtacttcttcaatggcccaactaccatagtcaaaaattcgcttccaggcaactctgtcttatcgccgatgtactttcgcggtctggtggcctgaagtcagatgaagttgaagattctgttgtgatcagtgaaattgtcatcagaaaggatggagaaaacaatatccatgatggaacaccaaaagctgaatgggttgaagcgacacggaaaagcgaattgcactatatttatgatttcctggaaaaacacaaattgccagaagatcataaagataggcaacgaatctcgggcacaattcaaaaatattcgctgttaaatggtcttttgtattttaatgaggcaaattcggaaaaattttcggcttttcgtgccacaaaaatatcggcaaaaatttgatagctgaaagggcatgaaggaaaaatgcgccggcccattttaagtcacaaaaaagttattggcccagctctccgaaaaatattttttggccgaacatgcgagcggattgtgttaaagctgtgttagaatgccgaatttgcgcccacacgcgaaacccgcggtcaaacacaccagaattacggccaattattacaacagaaccattcgaattagtttgcatggacattctttcgattggcatgtccgaacgggggaataaatatgtactagttatggtggaccatttcaccaaatatcttattactgcagcaatcccgaacaaaaacgttgagtcagtggcaaaagcatttgttgaacaattaatcctcgttttcggaaacccgaaaaaaattcattctgatagaggcggcgaatttgttaacaaaactgttgctgaaataacaaaaaccctcggaattgaacgaagcacaacggcaggctatgacccaaacgcaaa

SEQ ID NO: 62789 - DNA, 371 bp, Heterodera glycines
  Genomic contig location: Contig_ID=SeqID_32482; Location=1024..1394; Strand=-
  SCN-specific regions: Sequence locations=1-371
aaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 62790 - DNA, 606 bp, Heterodera glycines
  Genomic contig location: Contig_ID=SeqID_32484; Location=195..800; Strand=-
  SCN-specific regions: Sequence locations=1-21,43-175,208-365,410-606
atggtggaagagcggattaaagagcaaatgtttaaggatgaaaagatcaaaaatgacaatttattacgccatatttttaaaaaaatccaaaagcaagccaaagacatgtttggacatcttttatttgagtaagttttttgttggaaatccctttttttcaaaacaattacaaaacataattaaaattttaaaattaaattataaaaacctttttttagaaaccaatcaaatgaaactgacaatgagaagaaaaataatgctcatgcagaaattctgttcttttttatgcatctttacaataaaatggtcaaattattaaaaggcgaacactacggaaacaataaaaatgctgtaaatacacatacttttttaaatttaaattattgaattaaaaaattatttaaaaaaacgcatttaaggaggatttgcgagtggcgcttcataaatggattaaagccgccaaagagcgagttggctttgagttccaacaatttttcaagaaaaatgttacgatctgagcaggaatatattggtatagaaaaacattgcgatatgtacatttgtttcttttggcaatttgtaatattaatatacataagaaataaa

SEQ ID NO: 62791 - DNA, 309 bp, Heterodera glycines
  Genomic contig location: Contig_ID=SeqID_32485; Location=551..859; Strand=-
  SCN-specific regions: Sequence locations=1-24,134-246,268-309
atgggtacatacgtacaaagagccgaagaacgaagcggcggcggcggaggacgacggaacggaggaggacagagcggaagaggtgggagacggacagccgacggaggacgagacggagcagcaggaggaggagctgagctgcaccatcaaagtgcacaaggtgggcagcagggacaaaagcatttgcagacaaatggcaaaaatgatggccctaatcgcgccaaatttgctcatatcggaaaatcggggtcccatccaaaaggaaagcccgacccgggattcccgagagaaaatagcctcaatttgtaa

SEQ ID NO: 62792 - DNA, 233 bp, Heterodera glycines
  Genomic contig location: Contig_ID=SeqID_32486; Location=714..946; Strand=+
  SCN-specific regions: Sequence locations=1-47,82-204,226-233
tttttgcccctccgttgtcctcgtcaacgacaagcactaacagcaccgccagcagcacaaccaccatacccaacaccaccaccggtagcagcagcaattgcggcgattactgctcgagacccggccgtgttgggtgccgtgccgcatcgagttccgcaccccggccgacttccccgccgtggaaggcgtcgcggccggccgtttccaccgccctggccgcactgtgccgcgtt

SEQ ID NO: 62793 - DNA, 642 bp, Heterodera glycines
  Genomic contig location: Contig_ID=SeqID_32488; Location=54..695; Strand=+
  SCN-specific regions: Sequence locations=1-21,43-176,239-300,323 -434,456-457,479-547,569-611,635-642
atgttggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcttagaaacatctaaaaatatctacttaataataataataatgtatttttaaattaatttaatctttttttgaaaattaaaaaaaaacatcggtcacttgaaataataaattctaaaattttgtccaggaaaatccaggtttttcgtgttttgcctggacctggacctggatttttttttcacattggacctggacctggatttcctggacaaaaatccgggaaaatccaggtccaggaaaaatccaggttgccgaaaaatgacctggacctggatccaggaaaaatccaggcctggatccaggaaaaatccaggcctggatccaggtccaggccgagctctatgtttacattaaaatatgattgcaattagaatgtttttttaattctttcctatcatttttatttaaaacaacacgagactgggaccgagctggaaaatccataccagatcccaaaagtttattttatttaaatttttcttgataaata

SEQ ID NO: 62794 - DNA, 883 bp, Heterodera glycines
  Genomic contig location: Contig_ID=SeqID_32489; Location=513..1395; Strand=-
  SCN-specific regions: Sequence locations=1-180,202-360,382-479,501 -748,770-842,864-883
  Gene Ontology: Mol. function=plus-end-directed kinesin ATPase activity; Cellular component=plus-end kinesin complex; Biological process=anterograde axon cargo transport
atgactcaattgggaaacgcggcggcttctgtttcccgcaatcgcccaaatttttcatcggcaaaaacgccaacggcactttcatcgaacgcatcgatggcaagcagtagcagcaacacaggcgaatgtgtcaaagttgcggtgaggtaaggcggtgagagactataattagaaggaccatttgcattttacttttttaatttgccgtgtcattttgggtgtcggcctctctcttcggctgagattgcccagggccattcgaacattgtccgggcggacgtcgcccggggctttgtcgagttgcaaagccccaaaggcccgtccaaaagctttttcttcgactccgtcttcggggaaaagtgcagcaatttgaacaatttattgggagtataacaattaatttagcgcgaaacaattcgaaatttacgatgaaacggtgagaggaattgtggattcggtattacaggtgaagcgaaatgggaaagggaagaaagaaagaatggagggacaaaacaaaacgccaagggattcaacgggacggtgttcgcttacggacagacgggcaccggcaaaacgcacacaatggaggggacgaggggggagcccactcagcggggtgtcatcccaaatgccatccaagtgggttttgtgccctttccatgccattcgatgcgccccttcccgcaattatttagcacattttccaacacatcgcccattctccgccaaatcagcagtttttggtgcgcgcctcttttctggagatttaccaggaagaaattcgggatttgctgaaccgaagtgccaacaaacggttggagctgaaggaaaggccggacattggagtgtacgtgaaggatttgagctcatttgtcaccaaaag

SEQ ID NO: 62795 - DNA, 2484 bp, Heterodera glycines
  Genomic contig location: Contig_ID=SeqID_6762; Location=1680..4163; Strand=+
  SCN-specific regions: Sequence locations=1-177,199-233,255-289,311 -345,367-401,423-834,856-924,954-1111,1152-1303,1329-1552,1574 -1700,1727-1817,1844-2484
  Gene Ontology: Cellular component=integral to membrane; Biological process=erythrocyte differentiation
atgttggtcaaagacgcacaagtgaagccggacatttcgaagccgcgctgggaccagtcgacgttcagtggtcgcgcacggcacttcttcaccgtggtcaacccactgaaccttttggcatcgaacaaccaattggaaaacagtcgcaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtggccaaaaatggcattaaaaacagtcgaaaatcgtcaccgattacgagtgggtgccaaaataaatggcattcttcttttttcaccatcagacaacagagtacagccaaattaccaatgttttaatacaggaaaacaatgaattcagaaatttcaattgggcttttgcgaatgggtctgtggggggacgcctaattttgcgaaggggtccgattttgttgaaaatcttattgaattttgagttttcatttgttaatccccatcttacttttttcagtggtgccctaaacagcaaagttccgcaaatctttttggttttgtgatttcgatgatttgaattccgtcttaaaaaaattttcaccgaaaactctgaaaatcatactggaaaacatgaattcaaaatttttctgtcgtgtcaaccctacctggaaaatttcgtttaaaatcctagtgaattttgagtgagccctgaaattctttgttttaacccattttttccaggacaggcaattactccgaggatttgtccgtcgatgagctttggcgtgccaaacatttgtacgactcggcattccatccagacactggtgaaaaggtgctgctgttaggacgaatgagtgcacgagtgccggtcgtcacattaatgtgcgttaagtcccccaacgaaattcttgaaaataaattttgaaaattttttcagccttggcggtatgctaactttctacaagtcagtacagtgctcttcatttatttacattcgttcaattttaaaaatttcaggtctgcccctgcagtttttggctggcaattcgtcaaccaggtggattaaaaaaaaatttcagaaaattttcatttttccatgattttttcagactttcaacgcaattactaattattccaaccgttcgggcgatgcgttgaacaactcgcaactgttgcaggcgtatctgatggccaccggtgggaaaaaaattttacctaggcctacccaaaaaccacaaattgaataaaaacgttcccaatttttaggcggtgcgacgggcgtagctctgggactaaatcgtgcagtaacggttcgaattctttaactctatcaacaaattttcagttttttctacttttccctaattttttttttttttttgcagaaattgccagcaatttggggtcgcctggtgccattcgccgccgttgcatttgcaaattgtgtcaacattccgatgatgcgacgaaagtgcgggaaaaaaatgatgatagatagagagatagatatatggcatttcttttggcgtattttaaataaggattgtgttgaatgattggtcggatctgattttctcaaaaaaagaatcggaatcgatgacctttttgattttcaaattaaaaaataacgcctaaaaaagtgcccccaatttttgcaacaaaaatttttggcctggaaaaaaagccaaatctacattcaaaaaaacattttacagggaattcatcgacggtgtccaagtggttgatgcaaatggtgtgccgttgggccaaagtcgcaaattggcatggatagcagttccgcaagtggtcttctgtcggattgctatggtcacgccggggatgggtgagagaatggcacaatttttatttccgaattccgttggcatcaatttgttttttttggactaaatctaccaaaattctgaatttttagccccaattaaataatttcccaattccgcagtttgcactccaatactgatcaatcgccttgatcagaagcaatggttccgcgcacgtccatggctttctccgttaattcaggccgcagtttgcggatttctgctcacttttacaataccattgggttgcgcagtgttcccacagcttagtccaatgaaggtgtaattgagaaatgaaaaaaaactaaatttttaatggattttcaggtggcgaagttggagcccgaattgcaggaacaaatccgtcagaaatttgtggccaaaaatgtgccagtgcctgaattggtctattacaacaagggcttgtga

SEQ ID NO: 62796 - DNA, 83 bp, Heterodera glycines
  Genomic contig location: Contig_ID=SeqID_6762; Location=4367..4449; Strand=+
  SCN-specific regions: Sequence locations=1-83
atgcctccaatttggggtagtctgatgccgttcgccaccgttgcatttgcaaattgtgtcaacattccggtgatgcgacgaaa

SEQ ID NO: 62797 - DNA, 146 bp, Heterodera glycines; identical to SEQ ID NO: 56264
  Genomic contig location: Contig_ID=SeqID_32494; Location=156..301; Strand=+
  SCN-specific regions: Sequence locations=1-79,113-146

SEQ ID NO: 62798 - DNA, 146 bp, Heterodera glycines; identical to SEQ ID NO: 56264
  Genomic contig location: Contig_ID=SeqID_32494; Location=408..553; Strand=+
  SCN-specific regions: Sequence locations=1-79,113-146

SEQ ID NO: 62799 - DNA, 146 bp, Heterodera glycines; identical to SEQ ID NO: 56264
  Genomic contig location: Contig_ID=SeqID_32494; Location=660..805; Strand=+
  SCN-specific regions: Sequence locations=1-79,113-146

SEQ ID NO: 62800 - DNA, 146 bp, Heterodera glycines; identical to SEQ ID NO: 56264
  Genomic contig location: Contig_ID=SeqID_32494; Location=912..1057; Strand=+
  SCN-specific regions: Sequence locations=1-79,113-146

SEQ ID NO: 62801 - DNA, 862 bp, Heterodera glycines
  Genomic contig location: Contig_ID=SeqID_32496; Location=207..1068; Strand=+
  SCN-specific regions: Sequence locations=1-5,101-558,580-623,645 -647,695-862
atgggaagaaaagaagaagaaaaacgaaatgaagagaagaaaagggaaataattagcaatttctataaaataaaagagaaaataaaggaaaaaggaagaacttattcaaaaaaagaatggaataaaattaatgcaaaaatagcgaagaaattggggacaaatcgtcaatatattgctgaatggatcaaagaatttggtcttcaaaaacaaattcataaaaactataaatcaaaaactgatgaagaaaagttagaaattgtacagaattttattgaaatgataaatgaatataagcaaaaaagaaaatatacgagaaaagaatggcaccaaaattatgccgaaatttgtaagaaaattggagtaggccatggaacaattgaaaattggaagagaaaatttggcattcgcagtaaattaacaaagaatgaaaaaatggaaaaaatgaaaatttattcgcaaataaaaagaaaaaacccaaaaatgagtgaacgggcaattgcaaaaaagatgaaaattgatagaacgaacatttcaaaatggaagaaactgtttggataaaagaatcattgaagattgaaacgatgattataagaaaaattggataaatttgccgaaaaaattatcagaaaaactatgacaatttctagttttttttcaaattttttgtatttgtattaaaaaattattttaaataccctaaattttgaaatttttcttagtgaaaataagtgaaaacagtcaattcaaggattgggagggtatcataaaaaactgaacaatgttggaactgggctcccagtatgcgtaaattttcgattttagaggccctgtaaaactccttggggttttgctagggtgaaaa

SEQ ID NO: 62802 - DNA, 180 bp, Heterodera glycines
  Genomic contig location: Contig_ID=SeqID_32497; Location=593..772; Strand=+
  SCN-specific regions: Sequence locations=1-180
atgacgaagtcgaagtccagtagcggaacgactcgtaccaagaagcgtaccgctgaccaagttgtaaagacggtgttccgtcgcaaaatctgtctgttctgctttatggcctcactgattgttttcgcgctggtccttggtttggccatcactttgacagttatcacagtgaacaattgg

SEQ ID NO: 62803 - DNA, 138 bp, Heterodera glycines
  Genomic contig location: Contig_ID=SeqID_32499; Location=1315..1452; Strand=+
  SCN-specific regions: Sequence locations=1-138
atgtcgacgcaacaacaacaacgtaagacgcgttccccaattgtattggagcgtggagtctctggtcgtgtcaaatggttcgacttctggaaagggatcactccttccattgcaaactttcaattttgtcattacgtc

SEQ ID NO: 62804 - DNA, 415 bp, Heterodera glycines
  Genomic contig location: Contig_ID=SeqID_32501; Location=239..653; Strand=+
  SCN-specific regions: Sequence locations=1-356,378-415
atgagtgccatcggcgacggcactcacagcgatggcactcagatggaaaaaagtaaaaagtgtaaaaaggatcatgacgatgactcagtcattaaaggtaattgcgacgacgaataatattgggtggaagattttttgaatttcagctgaaaattgtggctgggaagagatgcgatgtgaccatgaaattgaagctgatttgacattgaataacaggccaattgaggacgaaaatggacgaacggaaagccaaggacaaagggacaaaggggaaaacagagacagttcgtcacccgctgctgatcagttgcgccacactcacagcttcgagtgccaacagtgcaacagccaattggacagttttgagcagtttatcagtgagtgtttacagcgaatgatcaatgcatggaaatga

SEQ ID NO: 62805 - DNA, 408 bp, Heterodera glycines
  Genomic contig location: Contig_ID=SeqID_6763; Location=198..605; Strand=-
  SCN-specific regions: Sequence locations=1-226,249-408
atgccgctgaccaatttggccaaagtgctcggcccgactgtggtgggcaccaactcgcggctgctgacggtgcaggacaaacaccagcaacagggcaccgcgtacatgacggaggccaccaatcagatccaaatcatgcaggcactgctcagcctggaccatgtgggttttttttttggggggagtgggaatttcagtgcaagggctgaaaatggaattttctcaaataaatttgaaaattgttttttgtcgcaggcctattggacggaaatgtacgatgggccggctgctcggttggacaacaatggggcagtgccggtggtgccgaaacaccagtggcagacaacgccgacgtccactcgcggggccgagaggggcggacacttggtgcagtcgattgtcagatga

SEQ ID NO: 62806 - DNA, 182 bp, Heterodera glycines
  Genomic contig location: Contig_ID=SeqID_6763; Location=33..214; Strand=+
  SCN-specific regions: Sequence locations=1-182
atagtgaggtcagagaatcaaacaagaaaaaaaacggaacgtaaagccataggaaaaattatgaggaaattaaacgtttatgaatttacagcaaatgatcgcatggatttaaagttaggttaggccactctctacacacatatttcgatcgcctcattgccccattcatctgacaatcgact

SEQ ID NO: 62807 - DNA, 1752 bp, Heterodera glycines
  Genomic contig location: Contig_ID=SeqID_6764; Location=55..1806; Strand=-
  SCN-specific regions: Sequence locations=1-43,68-363,387-933,955 -972,994-1752
  Gene Ontology: Biological process=body morphogenesis (sensu Nematoda)
atgtccgagtcgaatgtgtacgagccgccgacaagtgaaaatctgcaacaacaacaacagcagcataaggcagcgatgtcggccaagcaaatcagcacattgaacatgtaggaatgaatacaaaggcaaatccaggtccccaaaaattcagccattttggtccgccccgtccgtgtgtcggccgcggttggaccaagggcaaaccgatcaaccaatgtgtgcacacttacgtgcccgtcagcaacctgttcagtgccgcgttctcctgttgcggcgtgtgcgcccgtgggctcggcattcgcggcttccgttgttccggtggaggcattatatatatatattttgcgaaattttgaaaaaaagccttttttggggaggggaaaatgccgaaaatttcatgcttaccatgctttccttccggcagaatgcaaactccaggttcatgagcactgttgccagttggcaccgccgctgtgtgtgccaatggtgccgacgcctcaacgctgcaacaatcgacatcggccaacgttgggcgacctggcaccggtgctgccgccccgtatccctggccaaatcatccgttgcgtgtacgcgcttgagcaaggcttcctcgacaccgtcgggttgtaccgagtgccggggtgtgttttgcgtactgttaccgtatttgactcaccaattttttatgatttccaacaaaaattgaattaaattggatatatattttttgttttagttgtgactccgaagtgaagaagttgaaggaccaattcaactcgaaattcgtgcccaaactggaccaaactgactcggagaccatcaccggctacatcaagaaattcctgcgcgactgtcgggttggttgatgggtttttgaaaaatggaaaaaaaaatttcgacttttgcattttggaatattttttgatgcaggtaaaccacaaaaattttggatggcttttaataatttaattcattttttaatgctttatttcattttgccaggagccactcatccctctgtcctcctacagggaatttttgaaggcggccattgagggagacgaagcgcagctgaagacgttcattgaggaattgccgatgccacaccgggacacggtgattggagtggaagacggagacaaattggacaaaaaagcatttcttatcttcgatttcagttggcttttttatgtgcgcattggcaaagggtggcgatgcattccaacgaaaatcaggtaaaattttgggtttgcagacaatttcaaccccattttcataaatcaaacaaagtcccatccctttaacatttctcacagatgccgctgaccaatttggccaaagtgctcggcccaacggtggtgggcaccaactcgcggctgctgaccgtgcaggacaaacaccagcaacagggcaccgcgtacatgacggaggccaccaatcagatccaaatcatgcaggcgctgctcagcctggaccatgtgggtttttttttgggaagggagtgggaatttcagcgcaagggttgaaaatggaattttctcaaataaatttgaaaactgtttattgttccaggcctattggacggaaatgtacgatgggccggctgctcggttggacaacaatggggcagtgccgccggtggtgccgaaacaccaatggcagacaacgccgacgtccacccgcggggccgagaggggcggacacttggtgcagtcgattgtcagatgaatggggcaaggaagcgatcgaaat

SEQ ID NO: 62808 - DNA, 389 bp, Heterodera glycines
  Genomic contig location: Contig_ID=SeqID_6764; Location=1479..1867; Strand=+
  SCN-specific regions: Sequence locations=1-261,286-389
atgcctccaccggaacaacggaagccgcgaatgccgagcccacgggcgcacacgccgcaacaggagaacgcggcactgaacaggttgctgacgggcacgtaagtgtgcacacattggttgatcggtttgcccttggtccaaccgcggccgacacacggacggggcggaccaaaatggctgaatttttggggacctggatttgcctttgtattcattcctacatgttcaatgtgctgatttgcttggccgacatcgctgccttatgctgctgttgttgttgttgcagattttcacttgtcggcggctcgtacacattcgactcggacattgaccggttcttcgtcagacggcccggcacagcctttgacggacgacttcgctaaacccaa

SEQ ID NO: 62809 - DNA, 1028 bp, Heterodera glycines
  Genomic contig location: Contig_ID=SeqID_6764; Location=3358..4385; Strand=-
  SCN-specific regions: Sequence locations=1-866,992-1002,1025-1028
  Gene Ontology: Mol. function=protein phosphatase inhibitor activity; Cellular component=cytoplasm; Biological process=eye photoreceptor cell development
atgtctgacgataaaaaggtaaaacgaatctggggcgggtgcattcttatggcattgtgccataacattcatttttgtacatttgcttttcagcatcaagcattcaacatggcacgcactttggtgaccagcagaaaagacgtaaagtaaagggggagcaaaatttaaataattttacaatttttagtcacccaaattctatgcaacagttttggacgacatcggctcgtatttggtccgcgcagtgcctttgtacatcaagaaaatcgcagacgaaccttctcctcctgcggacaatgagaatgacacaattacgaggaaaagagtatgtgtgccaattttggcagctttcccccccccccaaaaaacagctttttattttgattttattgaaaagtttttcgatccataattagggactttaattagtttttaatagaagtttcctttcgcattcatttacatccaaatgtttttccctcccctccaggcacatcaattgttagccaaatttgtgttcatcctcggctggttcttccgaattgacggtgctgaatcgtccacggtgggaaaatgttgccgttttcaaatcgtaatcaactcaatacaaacagaacgtcatcaaacaagccgtcgcaacgacagccgtcggttctttggatgagcaaacgatggtggaactgttggccaacgaaggaatgaaagtgcgcaattttggaggcattttactaataaaccaataatggaatattaaggaattgcgcacttctctgaagatgcacggtgccatccaacagtggggcggtgacaaaaaagtggcgcataaatttgtggcggaattgggccaaaagttggagacgaaccaagaggaggaggaggaaacggacgatgaggacgaagaggaagaagaaggggacgtcgaactgggggaggaaagtgatgatgagatggaagatgaagaggaggaggatgacgacgaagaagaggaagaagccatggatgacgacggggaggaggatgacgaatga

SEQ ID NO: 62810 - DNA, 56 bp, Heterodera glycines
  Genomic contig location: Contig_ID=SeqID_32504; Location=89..144; Strand=+
  SCN-specific regions: Sequence locations=1-56
gctatacggaagctattcccgaaggattcggtctccccataaatctgggcgcatcg

SEQ ID NO: 62811 - DNA, 707 bp, Heterodera glycines
  Genomic contig location: Contig_ID=SeqID_32508; Location=428..1134; Strand=-
  SCN-specific regions: Sequence locations=1-34,56-61,91-264,302 -573,631-707
  Gene Ontology: Mol. function=protein binding
atgttccgttttgacgcacaaaatgaaaatgcgggaaatagtaataaaaatacaagcaaacaattaaaattaattattttcaatatttatggtaattatcctaattattttcaattagtttccgataattgccctgtggtggtggtgcccgacgttgaaccagcagcattcaaagttatgttgagcttcatttacgcgggtgatttgagtgaattgaacggagacaatgcaatggcagtgctttacgctggtgaattaattccgataaatttaaatttaataaagtttttaattttaattagccaaaaagtacaatatccccgccctggttgccccatgtttacaaattcccatctccgaattgcgcaatgttttcttggcttatgctcaggcccgtcttttcgacttggaggtgagcacaattcttatttagtgtaaaaattaattttcgtttcagccaaatttaggtgccaccacttaagtagttcacaaaaaacttagcacttgaaaacaacaaaaattcaaaattttgtttttgttttttacttcgcttcctcctcctggccggtccggtttttataaaatagaaatttttgaaaaacaactttataaatttttataagaaaatttcattaaagaaaatcgcagaaaaatttttcaatgatttttaacttaacatttattttaatgttctaaacaagaataaa

SEQ ID NO: 62812 - DNA, 1167 bp, Heterodera glycines
  Genomic contig location: Contig_ID=SeqID_32509; Location=12..1178; Strand=-
  SCN-specific regions: Sequence locations=1-12,79-242,291-729,753 -967,998-1167
atgaaatgtaagtattttatttatatgatttttttttattgtattttttaaatttatcctgaatttgattttattataaatattaatgacgaattagattttaaattaatgtgtttatttttgcatttataaatgctttttgtgattttaatttataacttgaatttggataccccttgatgatttgcgcaataaacacaacatttcctaaagcgactttttttctttttaaattgcttatgttttttttaattttaaaattatttattattttgcttttatttttttaacttctttgaaaattgatatgtttttatattaaacaccagttaaaattttcctggtgaagggattgattttattgctacttgttgttcatcgcgtctcaaaggcattggcggataagagtgccgattttattaaatttccaaattcacaacaacatgaaatcgcaatcaaatgcgattttctgaattattgcgatttgccattcgtgatgggatcaattgactgttctcatataaaattgaggttataagaaagaaatattgagttaattatagttcttaagggtcccggatccgcgaagaaagttatataaatcgaaaagcattttattcattaaatatgcaagccgtttgcgacatgaggtgcaaatttatgaatattgatttgcggtggccaggaagcacacatgattcctttgttttgaggttcaaaagaataagctttaaaaaaataattaatttaaagcaatcagatgtatgggattattttgagtccggcttggcaggcaattcaattttgctgggagatagtggctatccattaaaaaaatggctagtggtcccatttcgtgatccaaaaagtgttgccgagaagcgtttcaacactgctttatgcaaaggccgttctgttattgagcacgcatttggaatttttaaacggcgattttcgattgcaaagttattaaagattttttaaaataaaaaacgctatttcagaacatcatgccgcttgcaacttaaacggatcgcaacttccattctagcagccgctgttctacataatattgccattgaaatgtgtttgcctgaaccaccggcggtggaagagtcaaacgaaaatgatgatttaaacgaaatcaatgaggatgaaaatcggaat

SEQ ID NO: 62813 - DNA, 1221 bp, Heterodera glycines
  Genomic contig location: Contig_ID=SeqID_6765; Location=264..1484; Strand=+
  SCN-specific regions: Sequence locations=1-117,165-299,321-1221
atgaccggcttcgtcacctgtctgggcttgctccatctgatttttgtgctcaaatacatcaaagatgaacaaattcgcactgatctgtactggctggtgtttatgccatcggtgagcaattcattaattcattagtaattaatcaattaattaattattaattatggagtatctatttttttgacaattttgagacggaaggaatgaaattgaaacccatttaatgtaccacaaatctcagttcagtttagcaaaaacccattgctcgtttcctatggtctttaccattgtcgagattcaccccctccctaaatgttcccttttaattcattaattacttaattaccctctcccccccccctcttttcctctcaggtgatcgccgcttgtggcctcgtcggcatggttttgccgagggcggccattttcatgtacgcaattgcgctcgtctattacatgatctgcatttttgtactcgtctgtttgatgtgcacggtcagtccaattaaaaattcggcaaatgcaaatttagttcaaattttatgtttttataattcagctgaacggttcccgcaaagcgatgtgccgaaaactgatggccaagggcaagcgaatttcgattagagtttgcccgttgggctgctgtttgttctgcttcgacaaatttgagccgacagagtgcgtttggcggggggggggaaattggcaaaagggactgatcagagaatgtccaaatctcgacaatgtatgctgatcaatttccccaacatttgatcagaaaatgtcgaaactccacaaagtaatctaatcaaaaaatattcaaaaaggacattttgatctgctgatcagagataacgacaaaataagcagaagagatgaaaaatatttgttaacaaagcgaacaaacgcataaatgatctgatcaatgggataagattacagagagtcctctgcttatcaatgccccaaaaataattgctcttacaattgccgcttcattttgttcgaccagtcaaattaagctataaaactgatcaaaattgtccatctttttgctgaccattttctgatcattcgttttgaatacaacgaatttatgaaccaaaagccacgaaaaaacaaagttcaggaagaatttccgccgctttgaatggctcgtgttccaatcgccgattgtgcgcattctgctcgaaattctgaacatcaccgtgtttatggtga

SEQ ID NO: 62814 - DNA, 219 bp, Heterodera glycines
  Genomic contig location: Contig_ID=SeqID_6766; Location=477..695; Strand=+
  SCN-specific regions: Sequence locations=1-219
ttttttgcttctgttccgtctcgtagacttctgccaattgttttggtccgtgcagaagttcatcgccgatttcatcggccccctcaatttgatcccgagtacggccgacgtttccacgccgttgccctcctcggcggtggcacaatgtgagcggtgaaagccccggcgggtgccaatcgcaaaaccccaaaaatccggcattttttggaaaatttatca

SEQ ID NO: 62815 - DNA, 1027 bp, Heterodera glycines
  Genomic contig location: Contig_ID=SeqID_6766; Location=1399..2425; Strand=+
  SCN-specific regions: Sequence locations=1-384,411-487,509-757,779 -805,827-957,986-1027
atgcttttcgcctctctgttggccaccgtttgctttcggccctcgcgctgtgccttttttgaccggcatcggagtgccaatgccattgcaaatgcaaattccctcgaggagtgtgccgtggatggcggtgcccattcggtcgcctctctcagcgcctgcggcggtgccgaggacggagacgagtcgcgcaacacatcggtggagtcaatccattgtcggtggcgaaactttgatggggacgaaaatggggacgaagcgattagagggggaaaagggcaaagaatggcaaacgaatggcacggcaaaacggcggacagagagcaaaagtattgatcagagaatgaatggggcggacgattgattgatcagcagcaaagagtgattggaaagaggcagcagcagcagaaggatcgaagaaactcagcgattggaaacaaaaaaagtgatcggaaaaagtgatcgggtagattttgacgaaaattgataggaaaattgctcaaaatgaaatgccaaaatttgatcaacgagtgatcgctcgaagttttgaccaaagtaatttaacaaggccattaatttttgtgttaaatttcccataaaaatacttaaaaattaattccaatttttagatatttttgcacaaaaatttgctcaaattaaaaaggccattatttattttagaattttccaaattaatttttctttttgctttactttctcacataatatttatgtgtttgaattaatattttaaattaacattttttcattggatgttaatgttttgcttgtattagtctcggttataaatgtttattttgatgaattttgatggcaaatttatgccattgccaaccaaagccaaagccaatcaatttgttgtcgttttattccattttcatggaaaattctccaattatcgatgtctattattaaaagcaaaatattttttgtcgaaactttaaaaaattttaaaattatttaaaaactttactttcattttttggactgtgaatttttacggttctta

SEQ ID NO: 62816 - DNA, 1117 bp, Heterodera glycines
  Genomic contig location: Contig_ID=SeqID_6766; Location=2781..3897; Strand=+
  SCN-specific regions: Sequence locations=1-239,323-393,426-707,730 -919,941-1117
atgccatcgtcgtcctccacccttttgtttctgttactgctccaatttgccgttatcctccgctgtaatttcgtcgcccgtccgtcgtcggcgccgcccgacttccgcgacgcgcggagcatcgtccgctcggagggcgaatggacgcggcgaatgggcgaggaatttgtacggcacaacgttttgccgttcatccgccaattccgacggcagctgaaaccgccgcggaaccttgtgagaaaaaattaataattttaaataataaaaatttaattaaaaatttaaaaatataaaaataattaaaataaaaattaaaattaaattataaaacatttactaaaaacaaaaaattgtactgtaattataatccaagagcataaaatcctaaaaataggttttaaattatttttaaatgaatttgaaaatgcatttaattaatttgcagcaatgggcgcccggcgctggcaatttgttgccatttggcccaaatcagcggaacaatcgcaacagtgccaaatggggcgacgatgaaagcgtacaattcacgcacgtcgatttggacccggcggagcagcgaaaataccgaaaaagtgaggaaaaaactaaaaaatggataccattttaaacattttttattcgtctgtttaccgatcgatggccaaactgattggaactcaactgatcacacttaaatagaatacaaattactaattaatcagttccaacattcatttaatcactggtcctttttcgtcaaatcagtttattgtgtccatttttgagcaccttttttcgctcctatttaatcacttcgtccttgatcacttttaccatttactcactgctttttgatcatttatttgtgtgtctttttggccacagttttcccattttctgccgcttcatttgatcactttcttttccttctgatcatctgatcattcttttgatcactctctctctctccccttctcttttagaccattctgtcgcctcattgttcgacttgggcggtctggtcgcgcgcgaactgtggaaacagacgaagcaccggtgcatccattgcgagaacggcgcctgcgagttggcggacccgcagtgcggctttccgtaccag

SEQ ID NO: 62817 - DNA, 438 bp, Heterodera glycines
  Genomic contig location: Contig_ID=SeqID_6767; Location=1047..1484; Strand=+
  SCN-specific regions: Sequence locations=1-157,181-411,434-438
atgagcagtaatgggatggtgggctacggtaacggtggcaaccgtaatttcaataatgtgggcggaagagagtgggacgaccgcggaagagagtgggaggatggcagaggagggagagagtgtgcaaacggaggagtggcgagatggagagacgggcagagagtgtgcgaaggggcggagagtggaagagaaagaaacggaaagcgaaacgacagaaacattaatggggacagaggaaaccaaaacggaatggacaattttgcatatgataacccgtattatggtggaggagggaacggattgtttgatgagggcggcgaaaatcaaaggaattattacgacggaaatgccaatgccgtaaataatttcaacgcaaaggcaaaaaggtatgaagcgattggggaggattttaagggaaactaattaaaaccaaatcaa

SEQ ID NO: 62818 - DNA, 49 bp, Heterodera glycines; identical to SEQ ID NO: 51181
  Genomic contig location: Contig_ID=SeqID_32512; Location=673..721; Strand=-
  SCN-specific regions: Sequence locations=1-49

SEQ ID NO: 62819 - DNA, 431 bp, Heterodera glycines
  Genomic contig location: Contig_ID=SeqID_32513; Location=280..710; Strand=+
  SCN-specific regions: Sequence locations=1-26,50-221,257-269,319 -351,375-386,428-431
atgcaccgccgatgccctgaaggaacatttaaaatttttaaaattttatgcgaaaatcaaattcaaaaggtaaattttgtcgaaaattttattaccaaaatctgccaaaaaaatttttttaacctaccatcggcagcgactgttttttaaagtaaaatagttttttttgacaaaaattttcgattttccttattcgtatctcgcaaagaactcagtcattcaaaattttcaaaaattttagttaaattaaaaaaatccacaaaattagcatttttaaatataaaagtttgtttttttcattaaaaatcttaattttaaggattttaaaggtcgaggatctgaacatcggtcccattgtactgaacatggaaaaaatgtaaacagtgatttttaaaaaatagattataattttgtttatttttaaaaagtaa

SEQ ID NO: 62820 - DNA, 1027 bp, Heterodera glycines
  Genomic contig location: Contig_ID=SeqID_32513; Location=1..1027; Strand=-
  SCN-specific regions: Sequence locations=1-249,363-374,398-430,480 -492,528-699,723-765,799-810,834-864,989-1027
ggttctcaaggcgttcaactgtaccattcgccgttcgcttatgtgccgttggacccggacgatgtggcggtgcaacggcagtcgctgagtcggctcgaatttgtggacattttgtacgccggatatgacagtaccacaaaaaatgtcaccccagcactgtatgtggagggcgtgccgccgttgatgaacggtatccgagtggagcgcagtgcatacgatggcatttacttttgggagccggaagtgaggaaaaaaaataataaaaatcataaataataaaaaattattcatgtataaatatattaaaaaaattttatttactttttaaaaataaacaaaattataatctattttttaaaaatcactgtttacattttttccatgttcagtacaatgggaccgatgttcagatcctcgacctttaaaatccttaaaattaagatttttaatgaaaaaaacaaacttttatatttaaaaatgctaattttgtggatttttttaatttaactaaaatttttgaaaattttgaatgactgagttctttgcgagatacgaataaggaaaatcgaaaatttttgtcaaaaaaaactattttactttaaaaaacagtcgctgccgatggtaggttaaaaaaatttttttggcagattttggtaataaaattttcgacaaaatttaccttttgaatttgattttcgcataaaattttaaaaattttaaatgttccttcagggcatcggcggtgcatgtgataagtgccactggaaaaattttgaatttttatatatatatttttttgctgtaaaattgttatttttccaaaataaaaaatttattttgccctcaaaaattgagcacaaatggaaaaaaaattataatgaaaattttcattttaagaaaattttgaattaaaaattctatttttcaaaaaaagcataaataatctaattttttttttataattttcgaatttttagggtcccgttttaattgccaactcaacaatttcacataatcgtggccatgg

SEQ ID NO: 62821 - DNA, 660 bp, Heterodera glycines
  Genomic contig location: Contig_ID=SeqID_32518; Location=553..1212; Strand=+
  SCN-specific regions: Sequence locations=1-317,348-537,575-660
atgcgcacccgtccgatttggccagttaagcaacgattgctgactagccaaaaggttcggtgccgtgatgaaacgaaccagcactgcttactccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 62822 - DNA, 544 bp, Heterodera glycines
  Genomic contig location: Contig_ID=SeqID_32518; Location=1..544; Strand=-
  SCN-specific regions: Sequence locations=1-62,84-544
tgaaaaaaatatttaatgaaacaaaaaaatcgattttttcaagtgtccgttttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgaggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtt

SEQ ID NO: 62823 - DNA, 146 bp, Heterodera glycines
  Genomic contig location: Contig_ID=SeqID_32520; Location=289..434; Strand=+
  SCN-specific regions: Sequence locations=1-79,113-146
atggctatctctttttttgagaaattttctatgcaacaaacgctctcgaacatgaaacggagtgcggtgcgccatggccattttatttttcaaataatttttatatttaatagatattccagaaaaatggctatctctatttttga

SEQ ID NO: 62824 - DNA, 146 bp, Heterodera glycines; identical to SEQ ID NO: 56264
  Genomic contig location: Contig_ID=SeqID_32520; Location=541..686; Strand=+
  SCN-specific regions: Sequence locations=1-79,113-146

SEQ ID NO: 62825 - DNA, 146 bp, Heterodera glycines; identical to SEQ ID NO: 57274
  Genomic contig location: Contig_ID=SeqID_32520; Location=793..938; Strand=+
  SCN-specific regions: Sequence locations=1-79,113-146

SEQ ID NO: 62826 - DNA, 66 bp, Heterodera glycines
  Genomic contig location: Contig_ID=SeqID_32520; Location=1045..1110; Strand=+
  SCN-specific regions: Sequence locations=1-66
atggctatctatttttttgagaaattttctatgcaacaaacgctctcgaacatgaaacgaagtgcg

SEQ ID NO: 62827 - DNA, 473 bp, Heterodera glycines
  Genomic contig location: Contig_ID=SeqID_32521; Location=470..942; Strand=+
  SCN-specific regions: Sequence locations=1-257,290-473
tgcggtgtgctcgactcggtgtccatccatttgtccaggcccgggccgggccaactccatctccaggttcagctgcagcaaccggtcgagttggtctggtcaccggtgctgcatttgatggtcaacgacgtggtcaggtcagccgctgctgtttcacaaacaaacacattcgaagtcgaactcacctcctcgtgaaatttcttttttttatggccaggcctctaaattcggaaaaaaattattccttcctgggaatgtattataattttttaattaaatttatttttaagtgtgaggagcagaccacgtacggattcggggacaccatttaccgcccattaatcccgcggcttgaaaatcatcgcgtgttgacttcctttatcggtgaaatatccggtgctggccagtattttcgttacgacgacgacagcggccgtttctgtgtcgtgtctatcaacacgcatgaagctaac

SEQ ID NO: 62828 - DNA, 764 bp, Heterodera glycines
  Genomic contig location: Contig_ID=SeqID_856; Location=837..1600; Strand=+
  SCN-specific regions: Sequence locations=1-707,737-738,763-764
atgccatcggtggaagacgtgccattgattcgcgaaacgtgtcttgccattgaagccattctgagctgtgctcgtgatgagcggggttattgacctgaccacatccatctaacaaattataaaatgttcattattgattcagaaagggtctttgtcagtctcatcgttcgctctttggtccaatttttatgtgccgacgacgacgaactcttccaacaaaagggccccttgagggaacttcacgaattcgcatttggccgactcaatgcgattttcgcgcaacacccagaggtgattttggcaacgttatgtttgccttccacttaataattttgttcgttttcagactttcaaggcattgcttcaggcggcgccggacattcggcagaaaattgaaacggccacaataaaacagcaacaacaaaaggggcgcactcagcagaagagagtgagcagaagcggcgaagggggagcagcacaacagcaacagccgaccatcaaattgtccaccgatttcagcgcttttgccgcctcgggcggcggaagcggcaaattgcccgagggttgaaaagcatggaatgtttgtattacggtgcatttacagggattcaattattttgttttaatttgacggaatttcataacacttttccaacatttactgattgtctccttgtggtgcgtgaaatctcttcgttcctaatgttttctaatttttatttttatttgtacaaatgaatatatatatatatataaatatatga

SEQ ID NO: 62829 - DNA, 5019 bp, Heterodera glycines
  Genomic contig location: Contig_ID=SeqID_859; Location=555..5573; Strand=+
  SCN-specific regions: Sequence locations=1-95,119-306,329-760,782 -1197,1260-1297,1323-1470,1494-1988,2030-2118,2140-2362,2398 -2650,2688-2733,2755-2937,2960-3126,3148-3417,3443-3871,3893 -4141,4163-4163,4185-4639,4661-4772,4794-4930,4966-5019
  Gene Ontology: Mol. function=acetylglucosaminyltransferase activity; Cellular component=cytosol; Biological process=response to nutrients
gtgaatttgcgcttgtccttcgcggccaaatcgcgcgagaagagggcgaacttcgcgaatcggtcgcttggcattttaattttcaattccattgactcctccctttccccctccccttaaggtcggttggttttcgcgtgccctccgtcacaacccaaacagtgccaagtccgtccgtcggcccttttatctttcatttgccattcgaatttttcaattttcccggcagaattctactcgaactcggaaaaagccactaccttttggcggaacatagaaaagcgattgaactgttcacaaagtcattggaacaaaatgaaaagagaaatggcaacgcaaattgggtgagcaaagaaagaaattcgaatttcgggggaaaaaagcggcgagaatctcgacaaaacgacagttgcagctaaatcacagtcttatcagcagtccttggtaaactgataagtctgttagtctgttgtacccagtgatttgattcgcccgtccaatacaatccgatcattttgaattgagatattcctattaaaatctgatccatttaaatccatttacgttttgcgtgttgataattgataagacttccatgatatttacctgatcaaaatttgaataacaatgctcaatttttagaaattatactattggcaatcgctcgccgtttaccacgtttttcagccgccggaatgtgccaaaaaagtgccctttttcggtcattgatcagttttccattttgatttttaggcacaaatggccttgctttcctctcctcaaatcaattccagcgccgatatggtcattttttacccaatttaaattggagtgactcaaattgacttttgcctctccccattaagctgatgtttttggcgcgtttactcgacgagcaaaacgaaatcggcgccgccgtcgaggcgtacaaacggagcattgaaatggaaccagaaaatgtggacataatccacaatttgggaatgctttacctaaaggtgggtgggcgatttgaacagaaaagtgccaaaaatggaaatgccattgccgctgaaaaggccgaagaccaaccgaacgcatttacaacttttggcaaggcgcttagctacgacccgaattttgttccttcggtgctggccattgcttccataatgcaaacgaacggcgattgggacgtggcactcacaaaatacaagtgagagagagagagagggcggagagagactatgtgggagagagagagaacagagggaaagagaccatggaggaggaggggtacggtaaatggaagaatgatagaaagagagagagagagagagagactatgggagggggggggggaagcgaattttcgttcgatcgaaaatgccgacacattccgatgattccgatcactgataataacagttggaaatttctcttgctgcctttagggcggccacttctgagtttgaccattcgtgtgccctttggaataacattggcatgtgtttcttcggcaagggcaaattgttggctgctttggtcggtcattcattcgttcactttctttttttccccttccaatttcacattcgctttttaaggtgtgtctgaacaaggctaattatctttgcccgttggattggaaggcattctctcctaattacccctaattacgtaattattgtgactgatctctcccccttgggcaggttctgctcaatctttcccttgtctactgcactctccaccaattcgcctccgcctatcactttgtctccgccgcatttgcgatcactcctcagaatccgttggtcctctgcacgatggccggtgattacgagttgaagatcagtgaaatggatcattttcccatcgattgcctttgaatttcgattccgtttgggtgcccgagggcatgggaaagtctgatcagttttaggcatttaacttttgcccaatcgaagttggcaaaatttactcaaagagagaggggacggagatcaaagaaagggcccccagagataacaaattaattaattaattggggttaattgtttacaaattgttttcagtgattctcaccggcctggccgactttcggaatgccaaatcggcctacaaacgcgcccttaagttgggcccctccctttgggccgtccgtttcaatttggccattttcgagtcgcgtcgggcgaattatgccgaagcgactcgccgtttgacggaattggagtcggacggatcattggcgatgggctcgacgcatggcacggcataccccgaggtgtgccattcattggggtgccaaagggaagctaacgctttccaggaactgcttcaactcgtcgtacgcattcgaaagcattttgaaaagttggaaaagcaaaaggaaaagaaagagggaggagaaaatcagcgaaatgaatgaacatcatttttctcaccccaaaaaagataaacagatttttcttcaatttgtttaaatatacacgaaaacgaactgagtcatcagtagggcggggaattatatggatataaaatcgcaaaatatggccataaaatatggaccaaaaatcgcgaaatatagacataaaatggcaaaaatatggacataaatttttcaaattgagggtataatttccctaaatttctttaaaatttggcgaaaaaatgattttttggaaaattttccggtttttgggctcaaaaaggccaatttagctgctggaggccgttctaatagaggttttttggaaaaatgccaaaatatggacataaaatatggataatgccataatatggacaaatatggacataaatcgcgaaatatggaaaaaatggatatggaactccatcctaggagcttcaaaccaagctaaaaacatggatttccatataattccccgccctagtcatcagtgtttcaataaaaattatttaagccgtttttagctaaaaagcaaaatttgaattttcactttttgttcaaattctggtccgaaattgatcgaaatggacgccggattcgtaatcagcaacttcggaaacttgtttttatgttaaattacacaaattgtacgtttcgtaaaccgccaagtgggcattttaaatattttgtttaggttaagttctttctctgtcagtcttattttttccttcctaagcagaaattaacagtccgatcaaatacccttttaatttacattttggtgaagaaatgaaatattacaaaagaataaaattcctaatatgctaataataatggatcggtatggaatacaaattattagtacaaatatataggcatttccatgaactgaggaataatcaagcggtgttaagggttgtcagttaaataatcctaaagcaaaacaatcccatcaaagtgccccattttcggcgtcccaatccgcccattcgtcgccttttgaattgttctttttccgtttctttttgagcagcgtcgccagaaaagtgtccggaggactgaattcgttcgcctcgtttttcacttggacaattttcgtgcaattctctccgtcaaccgctaaaaataatggaaaagagaaaatgagtaaattcatggatttattagagggttaaaatttatcgaaccgatcccttcttgtaattctttttatttagaaccaatgttcgaaatttctcgagttcactataagtgcaaaatttagttttaaccgaaagtcgattaggtaaatatctccggattaacaaatcattttcaaattatgtttactctcaatgtgaaagataaaaatgttcgaatacttttcgaattcaatcgcagaaattgggccaccgcgtgcaaatgaaagcgtttcacgcgcgaaatgatttcctccgcgaaaacatcggccggcgattcgccaaagaattctctcaaagcgaattccattctgtagaggcaatcctaaaaaattaactattaaatccaaaaatccaaagaagaaacataacaaattggacgttccgtcgtttgagcaaacagtcgcggaattttttgtcgagtcgctgaaaacaatcggacgacgatttgccaccacccgacgaaggctgaccatctaaggaagaaaagaccaaaaagggaaatgacgtggcaataatcagaaaaaaaaataagtggatggcccatcaaaaaattcatttgtttattaataatttgcctttttatatgtttagtccccattttttttggttggttcattgatttttccatgtatataaacaatttcattaagtttttttttaagaaatgcatttttcgtagaaagtcactcacttttattgtgcggctgactctccgactttttgatgtccgtatttttgaccgattgttgcgaatgctgcgccttcgaagcgtcgcgtgccatgagaatttcgtattcgaattgcaaaagcatctttttctgtcctgattcgtctttctccaggaagtcattccaaacctaaataaaaagtgcaagactcactcaaatgggacaaatgcaatagtaagccaaaaaccttcatttttgcctcatctcgcaaaaggcgtgagaacgcagaaatcgtctcggggattaaatcggaaccatcaaagcaaatgtcctgagtgtcggcaaaactcgtcaaaagcctagctaaaagcaaagatacaaatgaaaagaacaaaagacaaactaactgttttccacacgacgccacttctgcgcccccatgtttcgcttcaacggaaatccgtccacaatttcaatcggccgatagcttttcgtctttttgcgtcggtggcctccgatgggttggctttgaatttggaccgacacttcgttttcctcttcggcattgtcgctgtcggattggtcggaatcgaagagatagcggaaaagaatgggaaattacggaattaaagggatgaaaataactactttgcataatcatcggcaaatccattttcattctcagcacattcttcaattcgaattggaattctattgatcgaacggttgcgcaaaatacccatggtggaatgattta

SEQ ID NO: 62830 - DNA, 1228 bp, Heterodera glycines
  Genomic contig location: Contig_ID=SeqID_859; Location=3733..4960; Strand=-
  SCN-specific regions: Sequence locations=1-222,244-244,266-514,536 -964,990-1228
atgcttttgcaattcgaatacgaaattctcatggcacgcgacgcttcgaaggcgcagcattcgcaacaatcggtcaaaaatacggacatcaaaaagtcggagagtcagccgcacaataaaagtgagtgactttctacgaaaaatgcatttcttaaaaaaaaacttaatgaaattgtttatatacatggaaaaatcaatgaaccaaccaaaaaaaatggggactaaacatataaaaaggcaaattattaataaacaaatgaattttttgatgggccatccacttatttttttttctgattattgccacgtcatttccctttttggtcttttcttccttagatggtcagccttcgtcgggtggtggcaaatcgtcgtccgattgttttcagcgactcgacaaaaaattccgcgactgtttgctcaaacgacggaacgtccaatttgttatgtttcttctttggatttttggatttaatagttaattttttaggattgcctctacagaatggaattcgctttgagagaattctttggcgaatcgccggccgatgttttcgcggaggaaatcatttcgcgcgtgaaacgctttcatttgcacgcggtggcccaatttctgcgattgaattcgaaaagtattcgaacatttttatctttcacattgagagtaaacataatttgaaaatgatttgttaatccggagatatttacctaatcgactttcggttaaaactaaattttgcacttatagtgaactcgagaaatttcgaacattggttctaaataaaaagaattacaagaagggatcggttcgataaattttaaccctctaataaatccatgaatttactcattttctcttttccattatttttagcggttgacggagagaattgcacgaaaattgtccaagtgaaaaacgaggcgaacgaattcagtcctccggacacttttctggcgacgctgctcaaaaagaaacggaaaaagaacaattcaaaaggcgacgaatgggcggattgggacgccgaaaatggggcactttgatgggattgttttgctttaggattatttaactgacaacccttaacaccgcttgattattcctcagttcatggaaatgcctatatatttgtactaataatttgtattccataccgatccattattattagcatattaggaattttattcttttgtaatatttcatttcttcaccaaaatgtaaattaaa

SEQ ID NO: 62831 - DNA, 2343 bp, Heterodera glycines
  Genomic contig location: Contig_ID=SeqID_860; Location=217..2559; Strand=+
  SCN-specific regions: Sequence locations=1-168,197-410,440-974,1159 -1540,1562-1687,1711-1896,1919-2177,2199-2343
  Gene Ontology: Mol. function=transcriptional elongation regulator activity; Cellular component=nucleus; Biological process=regulation of transcription from Pol II promoter
atgtgccgcggaagtcaaagcggcggtcgtcgtacacgacgctcattatcatcatcattagcagcagaatatgcaccagccattgaatttgacgacgaattagttgggcctgaactgttcagcagaatggccagagaagcggcgccaattaacggtaattaaaattccaaaaaatattttttattttttatttttacagagttcaatgaaacgacggcaattccactcaaaggcattagtgttgtgggcggtgacatcaatggtgaacacgacaaaaatttattcgggggtacggtattatatattttatacagtcaaaaattttttcaattatggtaattagtagagtgcagcgggaccgggacctgaacacggacaactgagtaccaaggtcccggttttgaccgggaccgggaaattcccggcttttttcccggttttcccagccaaaaagtcccgggttttcaacccaaaaagtcccggtcccggtcttgccaaatttcccggtcccgctgcactctacaaaaaaggcatttaccagtgtaattttgaaagagcgcgcaaaaaattacgccatttacgctatttggcgttatgaataataagagaaagcaattaagaaaatacataatgtggaaaaaaattatctgtccttattttcgggtgttcacaactggaaaagtattcaatattttaactattttttataatagagcatggaagactcccagcagaatattactgaacagtctgtatcggctcccaccactgatcgcgacgaatatgaagatctttgcaaattggtcaacccaatctcaaaagataagagggttgaacaggaaggagccaaaaaaggaagtgatgaggaggacattggagacgaaggagccgaaaaaggaagtgatgaggaggacgttggagacgaaggagccgaaaaaggaagtgatgaggcggacgttggagacgaaggagccgaaaaagaagatgatgatggagttgaaaaagagggaggaggcgatgaggagggtgttcaaggggaaggagtcgaaaaagatggagatgaagttgaaaaagaaggagacgatgaggaaggtgttcatggggaaggagtcgaaaaagatggagatgaagttgaaaaagaaggagacgatgaggaaggtgttcatggggaaggagtcgaagaggagggcgttgaaggggtaatttagtatttttacgatgtttctaaaaaaacaaagttaagacttcaaagcaaggagaggtatctcagcttatgcaggacatttttggtgacaatgaaatgagcgaggacgaagaggttggaatgtttaatttcgttagctcatatcaatttgcactaggacaaagacaaaaaggctgaatttgaggacgaggatgagcccaaactgatcagagttgaaccggctgaggaggatgtggagcagtaagcggaatgaaagtggaaggaattcaggaattgtttaatggtcctccttttagggatagcctcggacgcacatgggactttgacgtgatgttggccaagaagaagcaggaaagacgccgtcgtcgcagaaaggacggctccattgacctaatggcggacgctgacgaccaaatcagagaattggtggaggcgatgaatgaggcagcaaatgtgagcaaaaagtgacaagactctttttattgcagcgtataatcatcagcacattctataaaagaccgacgttgggcccccccccccttccacaagcctttttgtaatggtaggggttttccatttaactagataatccagggttttggtatggctgttactaaaatataccgaatgccaaacgcataatcttcgtcaaaaatttaggaagaccgaatgtcgaacatggataggagaccggcagttaagaagcgaaagatgttgcaagttgtgaagaacactttgttgaagactgacttattcgaagcgatgcttgacaacggtgcaaaacatggcattaactgcttattctaagcaaaaacctgaatttagggatgattagcgccctctccgaatggcttgccccactgcccgacaagtcattacctgccttggagatcaggcgagtttaccgcctttacaaaatatttctcattgtcagtttttccttttattcagatgcacgcttttgaaaattcttgaaaattggcccaatttggagcaggtaatgccaaactgtccctttaatttcttgctggatctgacaagctttttttgcaattcataaactttccaattcgaatgaccatactccgtttcgatttgcgatatttataaaattttattagaatgggattgaaaaacca

SEQ ID NO: 62832 - DNA, 1163 bp, Heterodera glycines
  Genomic contig location: Contig_ID=SeqID_861; Location=2276..3438; Strand=-
  SCN-specific regions: Sequence locations=1-6,29-171,195-649,671 -735,757-1118,1141-1163
atgaataggcaattcaaattagacaaaacccaccgtcaagacaccgtccaactcaggatcattgtcaaaaagccacttgtcaaattcattgatccaattcaaaaggacgtttttcggcgcaaaaaccaacactttgtgaatattttcggagatgcgtgtgtgagacaaaatagtatgtaaaaaagcaatgatttgcagcgttttgcccagccccatgcaatggccaagaattgctaaaacaattggctggcatttgaacaatacgacaattaatttttatctacttacctcctccgcccggctcgttcaatcgcgacagagactcaattgtgcaattgtagagaaatttgatgccctccgcctggtgctttttgagaacgcgcaccaacgacggatgcacccgcaccgggtccggactgtcgttcccactgtccgggtccaatatgattgcctttagtgctggttgactgccttcccctgaaattactttcaatttagcaagtgggaagcattgcgttttatcgtttcatagccggagaatggtggtggtacggagtgttaggatggggagtacacgaagtaaaaattccaagccaaaataggccgttgacaaaaaattcgtttcgattggtaaacccaatgccaaatcatggaaactccttatcttactgaaaaggggaactgtctaccatccatcccactcacctttgtcgaccaatgtcgtagtcttttcaggaaggaaaaagaaggaaataagccattggatggtcagaaaaatgccaaacagccaaaaggggaagacgccgttgagggaacggaggaattgcaccaaggggacggacaaactgccgaggcaagcaatcacattgcaaagggcacttaagcggggagagaatcttggcaccaccgcaaatgccaaacaaagtgccgaccgaccaggacatgttgcagacgggggtgggaaacagctccatggacaacaggtgtatgatcttccaattcgggtcgattgccgcggtgatgaaaaggctgagggcggcggtgagccaatgtttggacagattgaagaagagccaaacaatgatcagagtccagcacgccaaacctggacaggggatgggggcattggaaaggaaaagcatttggcaatgacattttcctaa

SEQ ID NO: 62833 - DNA, 3801 bp, Heterodera glycines
  Genomic contig location: Contig_ID=SeqID_861; Location=394..4194; Strand=+
  SCN-specific regions: Sequence locations=1-562,584-1063,1085 -1089,1114-1142,1164-1276,1298-1528,1568-1758,1780-1905,1928 -2289,2311-2375,2397-2851,2875-3017,3040-3801
  Gene Ontology: Mol. function=transcription factor activity; Cellular component=nuclear heterochromatin; Biological process=chromosome organization and biogenesis (sensu Eukarya)
cgttgtgctgaccaatggttgtgttgcgacggcggaggaacagcgagcggaaatgtggtcagatggcagcagcagtgactttggcgtctaccaatgcctgctgtttctgttcacccaactcggctatttggcggtggccccgtcaatgctttccaccactttcttcgagccatcctcggtcattttttatgatggcatttaatcttggcccgatccttcggttgtccattttccgatcaatccccatttttttgtcataattttgccagtatttttcaggctttttgcgacactttccgcctcagttctccgaatggttcttcttctgtcttcactttgtcttcttcccctccgtcggttgagtttcattctctgctgatggagtggggcgagcattgtcacttttccgttcgtactgtttggatgtccagtgccgtgatggtcggcgcggtcgttggcgctttcgtcgccggttttgtggccgattgtttcggcagaaagccggtggttgtcggtaagcagtgggcacaattaaatggaatttctttggaaatgcttttcatctcccaaatacccaccatttctaccgcatttctctcatcccctcccgaaggttccatggctctgatcagtgtggccaactctctgatcgccctcttcggcgcctcctcccctcctttggcactttcgctgtttgctttgctcggcttggcctgcggtgcttacatggtcaccaacatggtgttgctcatcgaaatcctccgccattcctccacccgtcttttggccgtctctctcaacggttggcccctcggaatggtcggcacggcactgctcgcgttcgccgtgcgccattggcgcttttaccatttggcggtttctgtcgcgtcgctttttctcttcattataattgtaactttttttcagcgtttgttttgtcccgttgtatcaaatgcaaattttccagcattatttggccttcgaaagtatcccttggctcattcagtcgggaaaccatcggagagcgcattcggtccaacagaaccttttcaaggtgatttaattttgaaagggaattcctgagtttacatgactttttaaacattttttgaatgtcaatggatcaaaaattggcaggtgaattcctttttggccacaaaggacggcaaaaagacggcgatggcaccgtttggagtgaatggcgtcgctgcgccgatgacgcgaagttcttcccccctcaacaactgttcgttgaacgaaaacactgacgacgcactgttggaggaggtgggcgggggcagggaagaaggcacggcacagaaattggctaattgtgagcattggagggagagtttttgacacttcgccacagagagccctcctccagggatggtaccaggatttcggcttacaatagatgggaaacggctttcaaaaacttctactttgaaaattttctgggaagtggtggggaattgatcgtctccaatcttatataattttgctaaaattcctcattttcccgactctttcctcccctcccccgccctttttaagcctttacctttcccttaaagtccgaggagggcactcaaccagcagcgcatcgtcaacgtcagcgcatttacacctatttggacctcttccgtcaccgttcggtgtgcgtccgaatgctcactttgctcttctgtttcggctcctccgctgtcatttcgttcggcctttacttcaccgccgaagtgctgcccggctcgcgctacctgaacatcgccatgatgggccttggcaaattggtgctcggctttttgccctttcttttgtccaatcgcatcggacgtcggcccattctgctcgtctctgttggtgagtgttttgctgttaattaggaaaatgtcattgccaaatgcttttcctttccaatgcccccatcccctgtccaggtttggcgtgctggactctgatcattgtttggctcttcttcaatctgtccaaacattggctcaccgccgccctcagccttttcatcaccgcggcaatcgacccgaattggaagatcatacacctgttgtccatggagctgtttcccacccccgtctgcaacatgtcctggtcggtcggcactttgtttggcatttgcggtggtgccaagattctctccccgcttaagtgccctttgcaatgtgattgcttgcctcggcagtttgtccgtccccttggtgcaattcctccgttccctcaacggcgtcttccccttttggctgtttggcatttttctgaccatccaatggcttatttccttctttttccttcctgaaaagactacgacattggtcgacaaaggtgagtgggatggatggtagacagttccccttttcagtaagataaggagtttccatgatttggcattgggtttaccaatcgaaacgaattttttgtcaacggcctattttggcttggaatttttacttcgtgtactccccatcctaacactccgtaccaccaccattctccggctatgaaacgataaaacgcaatgcttcccacttgctaaattgaaagtaatttcaggggaaggcagtcaaccagcactaaaggcaatcatattggacccggacagtgggaacgacagtccggacccggtgcgggtgcatccgtcgttggtgcgcgttctcaaaaagcaccaggcggagggcatcaaatttctctacaattgcacaattgagtctctgtcgcgattgaacgagccgggcggaggaggtaagtagataaaaattaattgtcgtattgttcaaatgccagccaattgttttagcaattcttggccattgcatggggctgggcaaaacgctgcaaatcattgcttttttacatactattttgtctcacacacgcatctccgaaaatattcacaaagtgttggtttttgcgccgaaaaacgtccttttgaattggatcaatgaatttgacaagtggctttttgacaatgatcctgagttggacggtgtcttgacggtgggttttgtctaatttgaattgcctattcattttttattattttagtattccgaaattgactctctaactgacaactccgacagattgttggccatcaaacgatgggccaaatcaaaaaagccttcagtgttggtcatcggctacgatatgtttcgtcgactcaccggatcagatgaggacagaaatgtcccaaaacgcgggggaaaagtgcgatcgcaaaagccgaagaacaaatcgaaaactgagaaggagctggacaggctgaagccacagtttcgcgctttgttattcgagggtaattcagtttattttttgctttttgatgtactgcaattttagccccccatatgatcatttgtgacgaaggacacaaattgaagaactacgaatcggcaatttcaaagacaataaatcggatcgttgcccggcgtcgcgtttgtcttaccggcactccgctgcaaaacaatttgagcgagtactattggtaaaaattatccattattttttatgatatattcttggaatttatgttttttagcatggttaatttcgtcaagccgaatttgctcggcaacatcaaagagttcaaaaatcgtttcgagcacatcatcaacagggggaggacggctgacgcgagcagggaggacgttgtgtttatgaagcggcgttgccatgtgctccatgatcgtcttcgtggcattttggaccggagagattacactgtgctcaaggagtcgttgccaccgaagcaggaatatgtgttgatgatccgactcacccaggcga

SEQ ID NO: 62834 - DNA, 3928 bp, Heterodera glycines
  Genomic contig location: Contig_ID=SeqID_6768; Location=817..4744; Strand=+
  SCN-specific regions: Sequence locations=1-23,48-434,456-924,947 -1142,1164-1764,1787-2212,2234-2524,2546-2643,2665-3073,3095 -3389,3411-3902,3924-3928
atgccttctaagcaacaaatgctgaagaagagaaagaaagaagagcacctgcggcgggcggagcaatctgtcagtccaggtcgctcacctatcccaaattgccctcctcagggcaatcaaaattgtcctcttcaggacaacccattgagtgcagatgggaatggggcggcatcaccccggggttttaataccccaaatataagtgctttgcaattgagcaccccggcctcttccattggaagcagaaggggcatacccccaaaagccggaacggagtcaataacgacttcgcaaaacagtgtgtcgtcagctggcacacaaaacacatcggccactcaaaatgttgagtcgccgccaaacagtaaaaaattgaaggtcgaagatgttgatcgaccactgtctgttattgaagcaattacttcaacgcctgtttccacacaaaaaagccgtggtgggcggccggccaaaaaaagaggcggcccaggcaggggcaaaacaaatgattcaatgagcgaaagcttttcaatggatcagggctctgaagctggcataaatgcggcggttttacccaatgtgcctgaaaaaataaatttcagcacagtgcaaattaatttcgcaaccacgcggaatttagcctgtaaaatttggaaatggggagcaactgctctttacgaatgcgatgcaagaaggtcaggcccaagattcattgaaacgtgctggaatgatctggcacagtttctgaatgacgcctttattgtcgaatatttggcatacttggcaagcatatcacaacgaaaagtggtcattgttgatccagctgtgtggcaaatgggcattgaccgtgtcattgaatataaaaatatgacatttgggtatgaccctaatgttccggccgaagtcatacttttgccagtacattttcctggacactggactctcattgtccatgatgtgcaatatggtacacattttgccgattctttgcctaccccatatggaaggttggatccgcaactgacggataaaattagaaagatcatttctgacattttgccgtcaacagtgctgaccggtattgttaatgccgtaaatcttacagtacaacatgatggaaacagctgcgggtacttcgtgtgcctgtatgctgaatcatggcttatgaacaatcgcacgtttgttctgccagacttatccatcaattatgaaaagaagcgtattttatggcacattaacgagctgtatggctctgataatgtgccatatcatccaagggaaggggtgccaactccttgcccaattgtctatcgacatacggatgaagcgcagtcgaaatccaaggccgctgagccaatggaaattgatgagcatgatgacataatgatcatcgaaccacagacaagtggacaggctgctaatgccattctcacccaagcccaagtggatggtgaaaaccaagtcgacacgcttggtttggtttcggagtcttgtgttccgcaagagccaattgctcaggctgacgatgcaatatttgtcagaccgaagacgcctccgaggcgatcaacgcgcataggcagacggcaatccacttcgattagccgttctccttctcccgcaccgagacgtcgctcatcaacaaatcctgttgagaaagtcacagcatttacgaagcgttgctaccttgtccacaagggttggtgctgtgctgccgcagcagcaaaacattttccggaatactccgattcaggtaaacttggcgaaaaaaagtgcgctcattgtggggcactgctcttcccgcatgaggacagcagccattgctgtcgacagggaagggttgttttgccaaagcttaacccgcacccaaaagagcttgaagagctcatcgtgtgcgacaaacaaccccgccaagggaaggagtttgttcggaatatgtcgcgttacaacaatttgctccaatttgcgagtgtttcggcaggaaataagccttgccctgcaggcggacccatggcagtaattctcaacggagaattccatcgccgcataagcagcatgcaggctggcacgacccagattcctggcttcggtcagttatacattctggatccagtcgaagccatggagcagcgacgaaaaaatcccaccttcacgggagagaaaatcacaaacgataaagagtttgtgcagggtcatcagcttaatgatgagacccttgaaattttggaacaaatgatccaagaaaatcatccagctgcttctgcttataagcaggctcgtgaacagctccatgagttgttaagacaacaaaggactgaagagcttcggttcttcagaatgactttgttgaacgagcgctcagctccgggtggtatgaaagacccaaagttgcatccccaccagataatcaccccatcaacgggtgaagggatgtttgcaattcatgcagatcctactggtgccccggcacctaaagggatatgggtcgaaaacaagcaagggcagttaaacgaaatagccccgttcagtccatggactgatagcttgacttatccattaattaagcctaagggcgatgatggatatcacattggtattccatatgccaaacccgcacaaaaaaagcggagaagcgatcaatgtgtcgatcaaatgtttgacactgatgcaatgtccgacgatggctcatgcgagactgagtcaattgctgcatcagatgctgagtcggtcgcatcgaccgaatcattgattgatcgcattgataagacgagaaaattcatttctctgcgagattactgcaagtaccatctcgcaataagggatgaaaatttggagtggcaatatcaccacattctgtcatgtggcggtggtcttggccagcgctgggtcttagaccaagcggccaaaattgattggcaaattgccagttttttgcgccgtccagacatggacctgcgcataagtactccaaaaaatttgttgcattatttggtaaaccaatacaataagcagcaagctcggcaaaaccctaatgcacgacaaaagactgtcgatgacattggtagtgttgttcgcctttctgaaaagaatattaattctcttcagtattggaaaaaaaggtatgaagactgcaacaccatttttgcgcgttgccacgacgcaaaaaaggcgcggctcttcatcacattcacgaacaaccgtgagtggccagagttcaagcaaaacatttacaaaaatggtcaaatgttcactgaccgttttgacatgtggatgcgagtgtggtgcggcaaaattgctgtcttccaccaagagctctacgagaagggtttctttgggactatccttggctcaggagagtccatggagttccaggggcgtggtggcccacacgcacacattgtagcccagactgacctggacgcagttccagaagtcatccaggaatacatatgggctcatattccatctttgccgtgcaaagacgatgactcacccatagcgcaaatgcatcgcgaagtccgcgaactaatgcatatgcaactgcacagatgcagtgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaaaaagggtg

SEQ ID NO: 62835 - DNA, 2611 bp, Heterodera glycines
  Genomic contig location: Contig_ID=SeqID_6769; Location=103..2713; Strand=+
  SCN-specific regions: Sequence locations=1-799,821-2039,2061-2611
atgtttgaaactgatgccatgtctgatgatgactcatgcgagactgagtcaattgctgcatcagatgatgaatcggtcgcatcgaccgaatcattgattgatcgcattgataagacgagaaaattcatttctctgcgcgattattgcaagtaccatctcgcaataagggatgaaaatttggagttgcaataccaccacattctgtcatgtggaggtggccttggacagcgctgggtcctagaccaagcgtcaaaaattgactggcaaattgccacttttttgcgccgaccagacatggacctgcgcgtaagcactccaaaaaatttgctgcagtatttggtgaaccattacaataagcagcaagctcggcaaaaccccaatgcacgacagatgactgtcgatgacattggcagtgttgttcgtctttctgaaaagaatgtaaattctcttcagtattggaaaaaaatgtatgaagactgcaacaccatttttgcgcgttgccacgacgcaaaaaaggcacggctcttcattacattcacgaacaaccgtgagtggccagagttcaaggagaacatttacaaaaacggtcaaatgttcaccgaccgctttgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagacggacctggacgcagtcccagaagtcatccaggaatacatatgggctcatattccacctttgccagacaaaggcgatgactccccaattgcacaaatgcatcgcgaaatccgcgaattgatgcatatgcaactgcacagatgcagtgatagttggtgcggtccacgtgaccccaactttgggcggtgtaaaaagggcttcccagccccgtactcgaaatgtacgattctgcacccagacaggcccgcgttgtattaccggcctagcccaaccgatggtggtgcccaaattgaagtgaacggcttaatatacgacaactcacaggtcgtgccgtacaacccatacattttgctgcgttaccgagtgcaccataatgtactatttgcgtacggtaacaaggcaaatataaaatatgcacttaaataccctttcaaagggcctggacattgttatgtcgagtgcaaagaggagtccggcagcaaaatcggtatcgatgagccggcccaatatgccaaaatgaacttccgtggagctacagaagcttttgcagttgtgcattcaatgccgtttgcaaagctttcccaccatgttgttcatttgtcaattcatttgccaaaccagcagcccgttgtatacagggcattccaactggtgagcaaagctgaggaaattcagcgaggcgaactcccagagacgccatgctctgcctattggaagcaatggcaaaacgaatggcagcatgttccttcgctcaaggacatgctttttgaaaaagtcccagagcaatttcgatgggcaaaagaccgatgggttccatataaaaagaagcctaccaagaggcccccaatcggtcgtgttgtacctgtccctccaacggaccgggaaagatttgcactttatgtgttgatgacgcactttcccggcgatccgtaccacttaaaactggtcaatgggcagcagtgcaacaccttcacagaggccgctctacagcatgggcttcttgaagatgaccaaatttggcacaaaacgctcagcgaagcatccttgcatcgctggccggaccagatgagatttctctttgtgagcatcctcgtctttgggcagccgagcaatgccctagaattgtggaacaagtacaaagaccaaatgtacaatccacagggcatcaccagtgcggctatacgccaagcacgcgagcagcaagccttagccgacattgattggcgattgcactactttaatttaagctgcgtgcactgtggtctcccagatccaccaaattcaatagccaaaaataccaatttggcagttgaagaatttttctttggtgatgatgatctgaatacgccgcctggccagccaaaccaaaggccacaacaataccccccacctccactcaacagcgaccagcaaaaggtctttaatgctgttgtgagggcaataaagtctgacccgaaggaccagactgtgcctcgccgtttcttcattttcggcgatggaggtacaggaaaaacattcctgtttggccaaattatcaagcgcttgcgaaagcccccatacacctataaagtgcttgctacagcatccactgggtgtgcggctatcttgctgccatatgggaaaacagcccattcaacgttccgtctcggcagagaagtctcgctagacaagcttccaagcattccgcttgagagcttctttgcccgacggatacgtgaggcccaactcatcatcattgatgagatcaccatgcttcacaacacggtgatagaggtcatcgaccgggtgtgcaaagaaatggcagttcgccagcacaaggacctcctcttcggaggaaaaacggtcattttcagcg

SEQ ID NO: 62836 - DNA, 141 bp, Heterodera glycines
  Genomic contig location: Contig_ID=SeqID_32522; Location=251..391; Strand=-
  SCN-specific regions: Sequence locations=1-7,31-87
atggcccccaaatgccttccgctcgaacttttgttcgaaattgtgccttttatccctgccgaaaaagccgtcccgaatgcgctctcttcctgtcggctgctgcacaaacttttgctgccacgtgtcatcaaatggaaagag

SEQ ID NO: 62837 - DNA, 447 bp, Heterodera glycines
  Genomic contig location: Contig_ID=SeqID_32524; Location=296..742; Strand=+
  SCN-specific regions: Sequence locations=1-419,443-447
atggccttggcctgtcctggtgccgccgctgaacttctctaccatgctggtgttgatgcaactgttccggcgtcgatcagggtctgcgaagaagcagttggtggcgccgctctccagcaagaaacggtaggacgaggaaagtcccgcgctgctttcgccaccggcgtcgttccattctgccggcgactgatccccgtccttttgatcactttgatcaccgtacccggattgattaaaattcagctgattatgatgttgattgcccgagtcgttggtgttggtgttgctgccgtgccgtcctggctgcgagcggctgctaatccgaacggaacggcgagcgtcgccgcctcggcccgttgttctgttgtgatggtcaactgctgaaacgacgccgacagttgtggcactttcgagcactgaaaatgataatttttgggaaggggagaa

SEQ ID NO: 62838 - DNA, 714 bp, Heterodera glycines
  Genomic contig location: Contig_ID=SeqID_32525; Location=215..928; Strand=-
  SCN-specific regions: Sequence locations=1-31,54-77,103-190,217 -560,600-653,676-682,706-714
atggttaggaaggcccagtttttcaatgaaaaataaatagttttattttttcaccgcttaatacgagacggattttcatatttttaattataaattaaaaatgatgaatatccaggcatgagtttttagtgggtattctctggtcaaacattaaactaggcccatgcctatcaaaaaggctgatcattagttgaaaatacattttttgaaatttatattatcggaatcgcaaaatttaggccccctgctgattggaacagcggagtgatcggcttgcacacgtcgtttggcatcggctgcatcgtttttgccctgttaattgcctccattctttccggtgaagaaagatgcagtaattaaaaacataaacggaattgggcttaacacagcgccatcttaaaaatgaaactctgtaatatatcttctacatatgtataaataaagtcaaatgtacagaagtgattaattcggtttttccaaggcttaatgcaaagataaaagttagaagtattactgatagaaaaaatttctgtataaacaggcctcaaattgtcgaagacaaatataaaaattaatcaaaaagaaaaaaaatatattttcatttttcagatggatttttcaattggttcaaatcaaattaaagaaaggagaagcaaagaatggaaagaaagaataattactaaattatttgtcaattaaaaatgggaaaataaa

SEQ ID NO: 62839 - DNA, 741 bp, Heterodera glycines
  Genomic contig location: Contig_ID=SeqID_32527; Location=424..1164; Strand=+
  SCN-specific regions: Sequence locations=1-186,208-248,270-488,511-741
atgaaggaagcgagaggtcatttaaagaccgacatcgctaaacgtcttgaacttcccgttctcgagagggagaaatgttacctcaccagttttggggaacggaaccccagacattactcgagcaacgtggtcaagatcggattcctgggaatgaatggagacgcatacgtttgctctttgaacgaaatggagttcatggtgaaggcaatgccaatcgtggcactcaattcggtggatgaggaacagcttcgggaaagaaagctgagattcccgacgaagctacaacaaccggacattatgctcggaatggatatccgacatgacttgaacatacgggatgaagtcgaaaaactgccaagcggatttacactgtcaaattcgcgcctgggaagaatgataagcggaattggacaatgggagaaaacaatttcgccgtgggctcaagtgacgttcatcggttcgctcgctagtgccgtcctggaccaaagggaagaagtccatgaaccagaaaatgttctggaagaccaaatgaagtccttttttggactcaacatcatcgggatggatgatgacaacactcagttggatcgggacgaagtcatgaaaaccttcagaaaaaatctgacattaaaaaaaacggccgttatgaatgcggactcccatggaatgagagagtcaatgagctcccgaccaactacaagcaagcacgagcaaggctgtgcagcacgatacgaaagctga

SEQ ID NO: 62840 - DNA, 613 bp, Heterodera glycines
  Genomic contig location: Contig_ID=SeqID_32528; Location=41..653; Strand=-
  SCN-specific regions: Sequence locations=1-613
atgaaaaaacctggatggataaattttgaatttgttatttcaaatgaccgatgttttttcaagttttaaaaaaatcatcaaatctttttttaaatccaggcctcgaggagcctagatttttcctggacttggatttttgtccaggaaatccaggtacaaatggaacccaggtccaactcaaaaatggaatccagtctcaggtccaggcttttttcaaaagtgtcgagctctaattttaactgttttttccattttcagcaaaaagtttcatcaccgcaacactcatgggaacaaatagaagacgaaagaagcgtatggataatgatcaaaatattcgagtcaatgaaatatatcgacaaagccgtagaatccataaacaaagacgggtggcaattgttaagtgtatttggattgccattttttttgttttttgggtatttgttatgcatctgatattagtaagagaacaattatgggttaaatgggtcattgtaagcacagttggtttatgctatgtgcgtttctttgtgtttgaatgtcgctatactatttacaattatgaacccattttacccactgtaatcacaggcccgtaatcaaaaaaaaaaataaa

SEQ ID NO: 62841 - DNA, 572 bp, Heterodera glycines
  Genomic contig location: Contig_ID=SeqID_32528; Location=779..1350; Strand=-
  SCN-specific regions: Sequence locations=1-21,53-344,366-572
atggtttcattcaatttaccgccaaaattattgtttttctttgctatggccatgcttttagcgaggaaaagcactcaaaaagtgccaaattcgaccaaaactcatgccaaaattggtaaaatttgattaaaataaacacactaaactttccatgtattacagattatttcaaattggcccatgaattggtggacaaggcatcaaaaattgaaaataccgaatcggaaattgcatggtggaaaaagcatacttttggccttttgtgcgatgcaaactttgccaaatttgaattagaaatggatggaaattttggaaaattgcgcaaaaatttttgtgaattgatgagaaaagacttttcaaatgaaaatctgctgaaaatgtttgtcaatgataaagaagcattgggagatttgatgggatttgtatcaaatgataagcaaatcattgacacaaaaaccattcttcaaaaaatcaaaaattcttcaattctcagcaacaaaaatgaacaaaatcttgcgacaatgtttgagtatttaaacgcgggaatagcgataattacaacaaataattaa

SEQ ID NO: 62842 - DNA, 1395 bp, Heterodera glycines
  Genomic contig location: Contig_ID=SeqID_6770; Location=1264..2658; Strand=+
  SCN-specific regions: Sequence locations=1-495,517-597,622-633,655 -792,814-833,858-1206,1228-1261,1338-1395
gactccaataaagtgtattttgaatcgctttcccgcctcacttgacccccagcaattccaccatccccgatcgaccgtcaagcgtccacccccaatcgccccagctctcgccaaatccgggccgttgccagccaacaaactcccattcagtaccggccgctcaatctccgaccgactccccgactcgccctcttcatcccgtcccccccatttgtccatcaccgattgcggaaaggacaaagtggtgcacgacgacccgggacgacgccctgtgcacaacgacgacccggcattcgacaacaaatcgtcaaatccctcaaacagcgaaaactcttcgtcccgcagccaatcttcaaaagtgagaaatcttcaaaagtttttgcttcaaaagggtaaccaatccccacactcaaagacaaaaaagtttttaaagggataaaaccctaacctaccaaaacacacacaaaacagtcatttttctcgaacaaaaaccgacaaacacacccaaaatcccattacaaatcaatcaatacccatcccattcagtgaaaagaacaacccgatcggcatctcgcgcaccgacaaacccaaacgaagttgaagaaaaagaaaagaaagagcattttcggaccgaccaacccaaaagaaacggagacgaaaccaagcaaatcctcagacggacaacagtgataaaagtgaccactgtgatcaaaaatttctaaactgtgatcaaacccaatttaattttgtgataattgtttacctcaataaaatattaactgattaaatcgcagaagggaataaattggccaaccaaaattaagaaacaacacaaatcatttttaaaggaaaaaatgtctggttttatcaggagcaaaatccctctcctcaatcgagtgctaagaaaagaaatccagtcgaccaaaacaaaaatcgaggaaaacaaattcgaatttgaccaaaataatctggacgaatgcacacgggtgttcaataaaacaaaggaaattatacaaaaaattgagccaaactttgaaaaattaaaaactttgcataaaaaatggcaaaatttgatgagaaaaatggacaaagaacagtggaacaccgaatggaaaatccagaaaatttttcgcgaaaaacatgattatttaaagacaattaaggaaacagacgaaatcctcgacactctgaaagacataaatttggaggtaaaaagaagactcaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgatcaaacaaacc

SEQ ID NO: 62843 - DNA, 2673 bp, Heterodera glycines
  Genomic contig location: Contig_ID=SeqID_6771; Location=483..3155; Strand=+
  SCN-specific regions: Sequence locations=1-139,161-429,484-921,943 -988,1012-1471,1496-2152,2174-2375,2397-2411,2433-2673
atgtctggttttatcaggagcaaaatccctctcctcaatcgagtgctaagaaaagaaatccagtcgaccaaaacaaaaatcgaggaaaacaaatttgaatttgaccaaaataagctggacgaatgcacacgggtgttcaataaaacaaaagaaattatacaaaaaattgagccaaactttgagaaattaaaaactttacacaaaaaatggcaaaatttaatgagaagaatggacaaagaagaatggaacacagaatggaaaatccaaaaaatttttcgcaaaaaacatgattatttaaaaacaattaaggaaacagatgaaatcctcgacactctgaaagacataaatttgggtgtgaaaagaagactcaaaacaattagagcaaagtctctttcggacactgaccaggaatctgactcaaatgctgatgaacaagaagaggaagatgaagaaatggaagaagaagacgaagaagaaaaagaatacgacagtgaccaggaagacgattcaccagaattgacctcaaatgaccaaataaaccgtaaacaaacaccttttgtcaattatcgatcgagaataaaacttccaccccaaactctgacacacttctccggaaaattctcccaatggcccagcttttgggacgatttcaaatcatcagtccacaatgaccaaaacttagagaacatacaaaaactgaaatacttgcgaggactcttacatgacgaaccataccgaattgtgtcccctatccgactaaaactgagagaaaaattcaaactttactcgacaaaagaattaatgaattttctcaattcacacactcaagctcgtgaagacatagaacgaatggaagattcaaacagacaaataagaaatttcccccctcaccggccacctcaaaacagaccacaaaggcaatcatacccaaactattcccaaccccagctaaaagcaaaccaccgaaaccatcaaaatctgcctctctcgccctatcccatcacttctgcattaacaaccaaatcaaaacccgtccgtttggcagaatttaaaccaaaaccatcgcaacccaaaccacaaacaaaaataatattttgtcgattctgtgaaagagacaatcacttgagcaaagaatgcaaaatttattcaaccacggaaaaaagaagtaatcgagcgcgcgaattaaaactttgcctaaactgtctgaaaaaaggacatcatttgaaggaatgcaaatcacctttttcatgtttcaattgcaaaagcaaacacaataccctcctatgtacccgaaaaacaaatcaatttaatcaaagagaacaatttaccaacgtaaacgtcacgcaaaaccccgaagaattcgaagaaacccaaaattttatgtctttagattgcgatcaaaatgatgaaattttacaaaatagtgaagaagaattgcttatgactacggaagcaccagtattaaatcctgaccaaaacaaaacccaaaaagaaatgatattcttcgataatgggtcacaaaaaagttatataacagacgaatgtgctgattcccttcaattaccaacaattgacgaaaaattattggcaatatccacctttaaccaaaataaacccaaaatcatttcatcgagactagtcaaaattggaatcaaaacactaaacggtgaaatcgagtacgtaacattacagactgtggaaaaaattactgatgttacaaaaatggtcaacagagagactgttgatatacgcaagagaaaaataccaattaaccatgcctgtccacaaattctgattggtatagaccactattggcactttatgctaccaaactcacaaattcaaatactcccctccggattttactcaatcgatacaaaattaggaaaaatattatccggaaaaggtacgattgaagacacaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacccacaaattttggattatgtttgggaagattaagaaatgtagtcaaacaattgatcaaaaacaaacagttggaaaattataataaaatactgcaagagcaaatggacactaacgttaatgaaattgctgaattcaaatccaaaaatttaattcactatctcccacatcaccccgttataaaagagagttcaaacaccacaaaaattcgaccagtttttgatgcttcagcaaaattaagaggaagcaatttcctcaatgacgaaattcaccaaggaccaaaattattacctgatttgtgtggaatgattctccgattcagactcaaaaatttcgtcttaataggcgactttgaaaaagcttttctaagagttggattaaatgaaatagacagagacacaacacgctttttatgggtaaagcagtcatatttggacgagataaaacaaaattaccgagaaatcgaaatgagagacgtagaattaagacgtttcacccgaatacccttcggagtcaatgcttatcggtttttattaacttctgtt

SEQ ID NO: 62844 - DNA, 82 bp, Heterodera glycines
  Genomic contig location: Contig_ID=SeqID_32535; Location=990..1071; Strand=-
  SCN-specific regions: Sequence locations=1-82
gcctcagaatccccaatcacacagggattctgatgtcttcacgatgtcaaaagtaaaatctgatcacgtattcgtgatcagc

SEQ ID NO: 62845 - DNA, 828 bp, Heterodera glycines
  Genomic contig location: Contig_ID=SeqID_32536; Location=76..903; Strand=-
  SCN-specific regions: Sequence locations=1-192,216-358,380-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaaggcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatttttt

SEQ ID NO: 62846 - DNA, 647 bp, Heterodera glycines
  Genomic contig location: Contig_ID=SeqID_32539; Location=82..728; Strand=-
  SCN-specific regions: Sequence locations=1-647
atggtgcttcttacggaaaaaatcgccaaaattttaaactgccgtatcagcgagctacgtgatcggcttaatcatccttccgattgtgaaacggttgtgaaagcgttgaaaggacaccgtgttaaaacaacatacaaagacagaaatggatacaccaaaagctttgcttttggtggaattacagcacaaggagctgctataactatggcctatggacgtctgggtcgtcctttcaatgttaatgtggccgcacatttctacgtccgtcaccacattaaactccgacatcctttcctccactgtgctgttgagagctttccggaaggacaagaggatcgcttctatcctcttgaattatgcgaaatggaggatggaccaaacgaaccagattggcttggtcgtattttcacagaaattcgtaatgacaactacacagacagcatgagccctgcaaaccgagaagttttaacgccggaagacacgtcaatgtctcgtgaagggcgtgatgagtgcagtcaaaatatttcttacaccttatggtaattaattttttttttcaaaattgtctcttctcttccttaattttgtacttttccagccaaaaagtactctttcctatccttaattttttcgaaaatgtgttttag

SEQ ID NO: 62847 - DNA, 495 bp, Heterodera glycines
  Genomic contig location: Contig_ID=SeqID_32539; Location=967..1461; Strand=+
  SCN-specific regions: Sequence locations=1-5,28-192,216-232,257 -257,280-470,492-495
atgtccacatcctctaataaaaattatttaccaaaaaaccaatgcccaaattgtgatggtaattacaatttttccttactgtacacaaaaattttttaattttagatgaagaagttgacaatgacccttcacccgaagaagttgagaagtggacgccggaagaagtgatcgagtgggaccgccgctgtgaaggacaaatgccagctgaagaagagctttggcaagaattcctcgacaaaggagaggcaaatgtcagtaaataaaatttttgatccattttttaaatgatttcattaggttctgcgtgagttctttggcggaaaaggggcgcttgaagttgagaagagccttcgagaatacgcgaagaaaaaggaacgccgagacgcaattttgattgagaaaagaaacgaatacaaaaaaatgatggaaaaaaaggataaaaattgagtgttcgaatttcaccatccgctatatcaatggcttttattttattca

SEQ ID NO: 62848 - DNA, 311 bp, Heterodera glycines
  Genomic contig location: Contig_ID=SeqID_32541; Location=1..311; Strand=+
  SCN-specific regions: Sequence locations=1-82,168-209,232-311
aatttatttaaatattcaatttttttagctttttttcgaaaaattttttgtcttttttcggcaggcactgcctctgacaatgttttttatttatttagaaaaataaattgattttttttctttttgatttattttaattatatttcatccttaaattttttaataaacattttcaaactttcaccttattaatgtaaggcgaatttgtccttttttaataaattctcttgtgaaaaggcaaaaaaataggctcttttaaatatgcctatttaaattactttcattgctttcctttgcttacgaccatacca

SEQ ID NO: 62849 - DNA, 356 bp, Heterodera glycines
  Genomic contig location: Contig_ID=SeqID_32541; Location=392..747; Strand=+
  SCN-specific regions: Sequence locations=1-42,72-127,213-219,242 -246,277-356
ggaatcgaaggtgttgtaagctttttttccttttttcacttgtaaatttatttaaattttcaatttttttagctttttttcgaaaaattttttgtctttttttcggcaggcactgcctctgacaatgttttttatttatttagaaaaataaattgattttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 62850 - DNA, 320 bp, Heterodera glycines
  Genomic contig location: Contig_ID=SeqID_32541; Location=828..1147; Strand=+
  SCN-specific regions: Sequence locations=1-40,70-125,211-217,240 -244,266-320
ggaatcgaaggtgttgtaagcttttttcctttttcacttgtaaatttatttaaattttcaatttttttagctttttttcgaaaaattttttgtcttttttttggcaggcactgcctctgacaatgttttttatttatttagaaaaataaattgattttttttctttttgatttattttaattatatttcattcttaaattttttaataaacattttcaaactttcaccttattaatttaaggcgaattttgccttttttaataaattctctttgtgaaaggcaaaaaataggctcttttaatatgcctatttaattactt

SEQ ID NO: 62851 - DNA, 340 bp, Heterodera glycines
  Genomic contig location: Contig_ID=SeqID_6772; Location=63..402; Strand=+
  SCN-specific regions: Sequence locations=1-340
atgttgactgcgctgacgcctgaactcagaggcactttgtccaaggatctcatttttagtggtactttcttcatcgtcctaatgattttgtcatcactatacaattcccttctgttccaggacttgagcagctgctcagagacccggacgaggatgttcgtgttcagacggtgtccgccatcgctttgctttacgctttcgcatgatttggtggccatcaaaaacaaaaatacaaaagagagaacgacagcctagtcacaatgagaattgcttaaacgcacgggcttcccctcacttcgctatgtcctgttcaaaaatgacttttaatttaataataata

SEQ ID NO: 62852 - DNA, 902 bp, Heterodera glycines
  Genomic contig location: Contig_ID=SeqID_6773; Location=613..1514; Strand=-
  SCN-specific regions: Sequence locations=1-103,199-735,768-825,847-902
atgtccgaacgcggcagaggcggcggttttgtgccgaaaagacgaaacgtcgtaaaagaaattgtcatcgatgaaagtcaggagaatttggtgatgattgtgcagaaaaaggtggaggagtcggagaaaacgaaggaccatcagtcggaggaggagaagaaaaaagagagcgaaaagggcgacggggcggagaaagaggggcaaacggtgggcacggggacaatggcacaacagcagccgaagaaggagccgtaccacgcgcaacaccaccactttaccagaaaaccaagttggactaaagaccctaaaggaatgccaacatgtaaaatccaaaattaattctcggacgggtacacccccccccccccttcgggattgtctctgaggggaagggcacattttggcaaatggaatggcatagaaagcaattaatttgcattgtcattttccaaaggcattcgatgggaaacctttataatattttgctcttttagtagtttgctattattgcaaaactgagggtcacgtgttggcggaatgtgagaagagaatgcaagcggaggcgagaaagtcggcagcgaacaatggcaagcgaaaattaagaaaccaaaattgaaattggggaattcttttggattttcaaatttgtttatttgtccgttaatcccttttcagtgccacgtgttgtcaattacacattccgtcacacgaagagcgatcagcgacatcagcagaaggccaaagaggaggaggaggagcacgtggagttggagacgtacaaggtcaaaatgggggaggaattttccaattttaaaggaggacaaaacaagcaagtcggttttggaattgagattcgaatttgggtcggaattgaggtcgagatcggattctcctttcattaa

SEQ ID NO: 62853 - DNA, 173 bp, Heterodera glycines
  Genomic contig location: Contig_ID=SeqID_32543; Location=592..764; Strand=+
  SCN-specific regions: Sequence locations=1-173
atgatttacccgatagttcagtccggtccgagtacggctttggaaaatgtttgcggcatcgcgaaccctccagacatgccgcgttgcagtcgtgcaacatcattgatgtcacgtagtgccagaggcgacgctgttggtgtgcctccggtgattggtccgaagattgcggaagg

SEQ ID NO: 62854 - DNA, 827 bp, Heterodera glycines
  Genomic contig location: Contig_ID=SeqID_32544; Location=423..1249; Strand=+
  SCN-specific regions: Sequence locations=1-827
atgccgaaaaggcattattattttgacgccattcggcattgttcccgcttcatcaacaattacccaaatggcattttcactatcccttcaccgtgcctctcgtacaaactttgcgatttaccgaaggcaaaagtggaatgtaccgtaaccaaaagcaaatattacagaagcaccattatgccaatccaagtatacagggtaattagtggaaataattaatttattattgcgcactttttaaacattcaggttcacgttttgaagagaacgctttttgtgaagagaaaaggcggatgctttgccagaaaattgagattttgacttttatttattgggaactatattttttttacaaaattggaaatcttatgcagaattttaattgaatttgaaaaaaacttcgaattttcgtggaaaaattattgtcaatttttttttgttcatttggcattaaattaaggcaaaaacgagaaaatgttttaacaaaatgccaaaaatatgtcgatcaatttaaaagtcatttgtgctgtagtgacgctagagagtagagtagagcggtactggtactgtacaactgagtacctagtaccggttttggccggtaccggtctagtaccggttttcccagccaaaaactaccagtttttcaacccgaaaattaccggtaccggtttttttacaattactgattaccgctctaccctactagagagagagtcttggtctcgagaaaagtctcggatttttttgctctcgagtcttggtctcggatttttcagtctcgcttttcgagactctatttattgtttttggtaaaattatattta

SEQ ID NO: 62855 - DNA, 758 bp, Heterodera glycines
  misc_feature (17)..(17): n is a, c, g, or t
  Genomic contig location: Contig_ID=SeqID_32545; Location=1..758; Strand=+
  SCN-specific regions: Sequence locations=1-42,87-758
  Gene Ontology: Mol. function=protein tyrosine kinase activity; Cellular component=integral to membrane; Biological process=signal transduction
tggttgtagggaaattngagatgtcaatatggtgaattgaatttaattaatactaattagttaattgattaattaattaattaattgtgtaggggacggtgtggttggcactaattaaccactaattgccatacatttaccaaaggtgtgcctactcaacaatgtccgatgtgtggtcatacggtatcgtactgtgggaattgctgacgcgtgccgcctcgccctacagtgatgtgccaagcactgaaatacggtagttttacacttttactaaacatttaaggttgtctaatagggttaaaaaactttgagaaaacgtaagacattttttaatctgggaattaattagtgtttttgataaatcaaaaattttttggatgaggtttaccggctcaagtccctaaaaatgcataccgtatcgcgcatttaacaatttaaatgcttttcaggcattttttggagaccggcaaacgcctcgcgcagccattgcattgccctgacatactgtaaccaattgacccaaaaaataaataaaaaatttccaattaaatccacagctttgatctgatgctctcatgttggcgctcacggccctcggaaaggcccgactttgtgacaattgagcaccaattgcgcggcattttacaggcaaaatgaaaagcatggaaatgttcccgataatttgtcaggattaaaaatttgttagcaccaaaatttcccaaaaaatttcgcgaaattttcccgaaaatccacacaat

SEQ ID NO: 62856 - DNA, 828 bp, Heterodera glycines
  misc_feature (822)..(822): n is a, c, g, or t
  Genomic contig location: Contig_ID=SeqID_32546; Location=414..1241; Strand=+
  SCN-specific regions: Sequence locations=1-717,741-828
atggcatcattggggacgacgacaacggaacaaattgcaaaaagacagcccgaaactgtcgcattgcgtgccgcattcgctgaagtgagtttcttttgttctttgacagaaccaacagctcattgtcaaaacagtaggagagtttaatgagaattcggtcggaatttaaaaaaaaagaagaaatactgcgattattaatgccgtgaaaatggcatttttagtctcattggtcccctactgggatatgtgccgacgcactcaaaaaattacgccaatcggagaccaattccgatgggctgaagaaatgttggaaaccgtaatcacgagcccaaaaatgtcggaaaacggcattcagcattcagaaaacggcattttcgacaaaccctggaccctaaactcagctttttttgtcccgtgcttttgggaatagtcaaattttgtaaaaacgtaaactcccgccgcgttacagctccgccaccatgtgcccgcgcatccgtcggaccgaaaaatgagcaaattggaaatactcagaggtcgtccaaaaacggcgggaggggacaattttcaaaaaaaaacatatgcaaaatcaaatttttgtttttttttaaattttcttttgtctcattgtcagccgcgatacggtacattagcattctggagtactgtctgggcatgcgacagacgccaattggtgtcaaattgcacaaagaatagagagagaagaaaaagtgatggaagtgattgcaaaaagataaaaacttggattagagaaattccatgaaccaatcaattgtatcggattgataaagaatgatgctttanattgga

SEQ ID NO: 62857 - DNA, 454 bp, Heterodera glycines
  Genomic contig location: Contig_ID=SeqID_32548; Location=360..813; Strand=+
  SCN-specific regions: Sequence locations=69-140,208-343,379-454
gtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 62858 - DNA, 111 bp, Heterodera glycines
  Genomic contig location: Contig_ID=SeqID_32549; Location=279..389; Strand=-
  SCN-specific regions: Sequence locations=1-111
atggttaccgaaatgggctccacttctgtgggcggcatttcgccttcactgagtgccaacgcggcaaagtcatttttggaagccaccgacaaagagaagaaggaaatgcag

SEQ ID NO: 62859 - DNA, 2009 bp, Heterodera glycines
  Genomic contig location: Contig_ID=SeqID_32550; Location=51..2059; Strand=-
  SCN-specific regions: Sequence locations=1-60,86-1638,1660-1920,1963 -2009
atgtcaaccgccttggacgagtcacagcagaacgggatcacaccggatcaattgggcgctacaatctcttcagatcttctaaatcccagcatatggattcctatacgccgcatttccgacaacaccgccgactcaatcatgaaccgcttccttgaggtggcacagtcaaaatcacgggagggctctctgtggggctcgccgttcactgtgaccatcacaacgcttgatgttgcgcagctacctcagcggcaacaggtgcgtggcagtgggaaaaggacaacaaattcagtgcaacatatcgtcaaagagagtgcactcctgcgaatcaacaacagtgatgatgcctattgccttttttacgctttggaggcaagcagaaaataccacatcaaagagatgagccgaagaaatttctgttattatattaaccatcagaacgggcgacgactggaagacgtgtttggactgatgagcagcgcaaacattcgcaccgatctgagagaatatgacgcggttgtctatgtgccgattgtcgtggactattggaatcggaaatacgccacagcaaaccagcgatttaaagtgttcatttttggcgctacaggcacctatcggccaaaatttcaatacgggccggacaattacaacgtcgaaatcccgctctaccatcacaacggccatttcgacggaattcggtgcggggtgggcaaagcggtgtttgggcgtgactactactgcttttcgtgcgaatgcccctacgataatgccaatgatcattcactgcagtgtaaagcaaagtgcataaactgcggtcgcataggagcggggcgaccgtgccgagcggatgacaacaacgacaattattacagagaatgcacagcatgtggcaaggatttcatgagccaagactgcttcagtcatcatttgtcgagcaatgtgtgccgacaattcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccaaaaagtacaggctgatcgcctttgactgtgaaacaacacagaacacgcgaattgagggcgaccgcagagttcattccgtcaacttcatctcatgctatgtcgtctgcaccaagtgcataaacgaaaatttatggcgaaattctctacaagcgccatgtggcatttgcggtcggcagcgcaccgtcacattctcccaccgcgtctatgaacgcacccaaaccgatgcccaattcatcactccgtgtccaatggcggcctttgctcaatggctgctcagcgaattcgatccgcgctatcccacaatgctcttcgcccatttcggtggtcgctttgacaacattatgctgtttcgacagttcttcctcaacgggttttgtccacagatgatccgacgtggtaacaaattatacgaaatgaaaatttcgaggggcgaaaaaaacccggaaatcatcgtaagagacagctggaaccttatgccggtgccactaggcgctctgcccggagcgtttggactcaatgtgcaggataaggagttcttccctcatttggcgaatgttgaggcgaattatgggcacattctgccgtcgctaccgtcaaaagctgactacttatacggtggaatgacgcccgaccgacagcgcagattcgaccagtggtacgcggaacaccgccatcaacagttcgacctatgtgaacagctcgcagcctactgcaccaacgacacgcgcatactaattgaggcgttggtcgcttttcgcacggagttcttgacgatcagtgacccgctggagcggcatggatgcttggatgacgacaacgacgacgaagatgaagaggaggaggaacagcaggatgacgacaatgcatttgaagtgatcggcggtggcattgacataac

SEQ ID NO: 62860 - DNA, 1024 bp, Heterodera glycines
  Genomic contig location: Contig_ID=SeqID_6776; Location=230..1253; Strand=+
  SCN-specific regions: Sequence locations=1-247,285-519,555-606,630 -682,714-744,772-801,824-908,943-956,978-985,1007-1024
atggccttaaatgggacctatcttttcaacctgagcttgtactgctccaactccttgcatgaagttcgagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttaagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccatttttacttacttaactctaactccctaaatacttttccattggtattgatctcttgccagaataatggcaacatattattgataataatggcgggtattttgaatcatgattgtgttttgttgaaatttaaaaaaaaaatttttaataaaaaaaatttgggtatcaaaaattatgttccaccctaagtaaaagcaattgtattgggaaagaaattaaattaattatttttaaagaatgtggcaattgaaaattttataaaatatatgtaaaaaacgcagtttagagaaccaaacgaaaacaaaacaaaaacattaagtaaatgtgagaaagttggaagaagccattgtaatgaataaataaataaataataaatatggagtgaacatttaaacctaatatttcttttaaaattataattaagagaagcattcttaaactgaaaaggtcctgaatttccagatgtttgcattttacggccatttttcatgaagtcaattaaatcagcaacacgttttaaattaaattaattattataaataatatttggacattcgcataatgttgaaaaatgaaaaacaaatgccaattggttttatatttaaggagaaatagccgcgtctattataa

SEQ ID NO: 62861 - DNA, 767 bp, Heterodera glycines
  Genomic contig location: Contig_ID=SeqID_6776; Location=1426..2192; Strand=+
  SCN-specific regions: Sequence locations=1-687,709-767
atggtgtatatagagaggtttgaagcgaattcttacgaagagctcaacaccgttttggaaagattggcgcgcggtgatcgcattttcaacggtggcgtatttattctgttcgcgatccctcgaaggtagacgaattgccgggggtggagaaggcgagatttgcttttcgttttctcattttcgactctcatcaaaaagcttttcctcagactttaattctcttttctttttggcttttccttttcatttctttcagattctattgcaaatttgcgcttagcactgtcaacacaacaatcgacgacattaatcgtatggccaaaaccatttgccggagctcgtcattgcgtacattcactgctccgttggagtttggaaagagtgagttcgaagtgccaaaataaaccaatgccttttcaaattgtcagagtttgggccgtgccgaacagtccctacaaaattgacaagacgttggggttgcgacagttgccgacgctcatcgaatattcgcttactgatcggcgccgaattgagggacggatggtttacttggacgagcagtttctgagcgtggattacatcacccgattcttcctgaagcaaccgttgaacgtcttccagtgacgagctcaccgcactgttatttattaactgatgttgttgtacatactgtctattaacatattgttgtaaatatatgtatattgtatgcactaaatatgcccaaataatattatacatatgtacataattatgaataacaaaga

SEQ ID NO: 62862 - DNA, 564 bp, Heterodera glycines
  Genomic contig location: Contig_ID=SeqID_6776; Location=2228..2791; Strand=-
  SCN-specific regions: Sequence locations=1-407,429-564
atggtgtatatagagaggtttgaagcgaattcttacgaagagctcaacaccgttttggaaagattggcgcgcggtgatcgcattttcaacggtggcgtatttattctgttcgcgatccctcgaaggtagacgaattgccgggggtggagaaggcgagatttgcttttcgttttctcattttcgactcatcaaaaagcttttcctcagactttaattctcttttctttttggcttttccttttcatttctttcagattctattgcaaatttgcgcttagcactgtcaacacaacaatttgacgagggaggcgactttcacatggagtggcaaaggattcgaagagatttggctgtttttggactcggaaatcgaattaaaatgcccaaaatccacaaaaagctttaattttccaattaaacagtaacgtttgcctttaaaatattccaaatgttgggttcaaattttgaatttttttccaaaaaatagagtaaatgtttaatcggattttgaacaaaatatgattcctagtaacattttgttgtctcaaaaatcgacagaataaa

SEQ ID NO: 62863 - DNA, 974 bp, Heterodera glycines
  Genomic contig location: Contig_ID=SeqID_32553; Location=597..1570; Strand=-
  SCN-specific regions: Sequence locations=1-75,98-515,537-539,562 -639,663-974
attgagaacattcgacggacagaagttggagcagtgcctgaagctgatccgaaagacatccatgcctgtattttgtcctgtcccttctgcgaaggctatggtggagaatgcccgaatactcttcatttttgggtgtgcgacgattgttgccaaacattgacttttgtgaaaatcgaaaaagtaatttgctgattggctaatatcgggggcataaaagctaattacccacatacacaaattacacatttcttttgcgcttgtggaaaaacgccggtggacgcattttcttttcgctgttccgatgtggcaaaacatggaaccgatttcaagcagtttggctctaaagcatcgctggacaaggaattggatcggttgaacaacaaaggaatgctaaacattttgctgctgggtgagacgggcataggcaaatcgatgctgatcaatgcactcatcgcttacctgaaacatggtactttgcaaaaagcgcttgaggtgaccgagtttattgagtactgtatttataattggcattatttaaatccaaaacaggcaaaagaaattgactgggtgatcccggcccgattttgtacgggtcgttatgacagcaaaaagatccgtcatagaattgaagtccaactgggcgaggagagcaaagaggagcgtcttgaagctggcgaatcgcagaccaaatggccaaacgcatatgtgatcccgtcaaaaggtgggtcccaaaatggttatgaattctgaaatgtgtcggtcgtcattcgcatttcagatggacacaaagtccgaataatcgacgcgccgggaattggtgacacaaaaggcgtcaacgaagacaaaatcaactttgacaagacgctcaacttcatcagcacattgcctgaacttcacgccgtttgcattctgttgcgtcccaacaccactcgcgcaacgcccgcaatcacatattgcattaagggactgctcac

SEQ ID NO: 62864 - DNA, 54 bp, Heterodera glycines
  Genomic contig location: Contig_ID=SeqID_32557; Location=63..116; Strand=+
  SCN-specific regions: Sequence locations=1-54
gatggaaagccatccattgcctgccggttctcggcacagcaaagcaataatagg

SEQ ID NO: 62865 - DNA, 594 bp, Heterodera glycines
  Genomic contig location: Contig_ID=SeqID_32558; Location=1029..1622; Strand=-
  SCN-specific regions: Sequence locations=1-170,196-594
cgcttcgaattgcacttgggcttttggtgctcattttgctgatcggattcttcccctccaccgacgccatccagtgttattcgggcaaccaattttccatcgtcgaatgtcccagcctttactgtatcaagcagacacttgggctggatacggtaataaaaagcattttgacaaaaaacaacaacacaattccattggtttaggtgcgctattgtgatgggacgggcttttcctcaatttgctccacctatcggataatcgattcttgccaaactgtgccgagtctggtgagccattctaagcattcagcgcaatttacggtgctgctcgagagtctcggaaattttggtctcgagcagcactagcaattaccaatactgatcagtttattttgtttcgcaacttttagggctatgtttgctgctgtcctgatcagttgtgtaattcggcgcagaaagtgccaatgaatgccctttttggcatcactttgctcggcatcgctttggcttcattaaacgttgccatgcgaacaaccgaaagaatgttctgatgaatggccaagccgctcatttgagaagttccatccacttaaga

SEQ ID NO: 62866 - DNA, 538 bp, Heterodera glycines
  misc_feature (487)..(487): n is a, c, g, or t
  Genomic contig location: Contig_ID=SeqID_32560; Location=260..797; Strand=+
  SCN-specific regions: Sequence locations=1-90,132-235,262-378,407-538
atggaaaaaattctggcgaaggctccaccacgaggccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaattttatntacaagttattttaggcactcagatgctttcaatatcaaaaagggagatga

SEQ ID NO: 62867 - DNA, 460 bp, Heterodera glycines
  misc_feature (76)..(76): n is a, c, g, or t
  Genomic contig location: Contig_ID=SeqID_32560; Location=362..821; Strand=-
  SCN-specific regions: Sequence locations=1-156,185-431,454-460
attaaaaatttttagattttttattcatctccctttttgatattgaaagcatctgagtgcctaaaataacttgtanataaaatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaa

SEQ ID NO: 62868 - DNA, 779 bp, Heterodera glycines
  Genomic contig location: Contig_ID=SeqID_32561; Location=287..1065; Strand=+
  SCN-specific regions: Sequence locations=1-197,219-779
  Gene Ontology: Mol. function=RNA helicase activity; Cellular component=cytoplasm; Biological process=post-embryonic development
ggggataaatgggggacaaccaatggggaatggcacgggagcagaggagggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaggggaatggcacgggagcagagggggttaaatgggggacaagggggttaaatgggggacaaccaatggggaatggcacgggagcagaggagggttaaatgggggacaagggggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaccaatggggaatggcacgggaacagaggagggttaaatgtgggacaaggggaatggcacgggagcagaggagggttaatgggggacaacaatggggaatggcacgggagcagaggagggt

SEQ ID NO: 62869 - DNA, 1249 bp, Heterodera glycines
  Genomic contig location: Contig_ID=SeqID_6777; Location=1510..2758; Strand=+
  SCN-specific regions: Sequence locations=1-1166,1189-1249
atgccaaggtctctgactggttcgtttgcgggatttttaggaatttgaaagtcatcaataaaataatttattttttgatttttgtgtcctaaatgtaaagttaaacatttatttgatgaaaattttgaattttcgactttttgttcgagtccggggttcggaattgaccaaaacatgtgtcattttcgggatcagcatccccgaaaatttagagcttttacaacagtaaaatatattttatttggttgagcgatcaatttccttttcatggatttttcaaggatgaaatggggcatgatctgttcggttgagagtccggaattaatccctgatttcgagtaaggtttatttttgttgatttacatttgttatggtatttttaagaaagttcggtcaatggatggtggcagaattgcaaaaagctgccattgagcgcagattttggcattatttcatgccttctcctaattttctcttgtaataaatggtccttttttgaatacgtttgtcctttagatacgccagccctggatcagttgaggaagtgaccaaatgttacgaaatgataaacctttcttttccggacgtccgtttctcttttctgtccttttggcattgtccagtttaggtcagttatgtcattcatgttctgccttctaaggattccgttgagcaccaattgctcaaagaactcactcacaacggagctttgataggccaaggtcattttgaattttcatccgtattgcaattctcaacacctttcttctttcaggtgttctcgcgtacaacgcactcaatcactttgactgctacgatttgaacgaagtcatgttcagaatgaaccaatggattgcccgtcggctgacccaaattatgtccaggcccaagtgagttttcttgcaatgattggtggattttttactatttcattttaagtgacaacgtcaagccaagtcgtcgaaagaaggatattttccgaattgtcgtcgccaattccgcggaagagcctccacccgcaagtcttttcaacaaggaaattcactcgcagatgcccttaaattcgaacaaagaacgcttttcaactcagcaggatatcgactattcagttggagttgttttgcataaaagtgagaagaatatttggcaaaattgcatttattcgtttttatgtatattttcagaattttttcgcgttgaggtgatttcggtgagattgttcaagtcaagtagccaccggaggagatga

SEQ ID NO: 62870 - DNA, 449 bp, Heterodera glycines
  Genomic contig location: Contig_ID=SeqID_6777; Location=137..585; Strand=+
  SCN-specific regions: Sequence locations=1-272,296-449
ttgccgtcggcggacaacgcgtgccgttccatcggtgcggcatggaatcgcaatgtgaactgtgcctttggcgcgcttcgttccgcgacgcattcggcgcgcgaatcggtgcaaaaaatggctgccgaagcgatggcattttttgacgacgacgaggaaaacaaaagcagcagagggaggagaacggcagcagaacagcgccaatgatgagaaatgagaggaggacaaaatgaattgaatctgttttaatatcattgtgcatttgctaagggtgctctcttctctcagtctctctgattttgggccgaacgaacaaacactcagttaattattaagtgtacacaccaggaatgccatttcgaggccctgaaaattccgaaaatcgaaattcctacctcaaaaattttaatggaaatcggaattcagaccacaaaaatatcaaatcggaa

SEQ ID NO: 62871 - DNA, 3527 bp, Heterodera glycines
  Genomic contig location: Contig_ID=SeqID_6778; Location=14..3540; Strand=+
  SCN-specific regions: Sequence locations=1-194,217-507,529-535,561 -577,599-1003,1025-1207,1229-1327,1350-1471,1518-1570,1653-1870,1892 -1898,1926-2025,2062-2474,2508-2594,2616-2628,2650-2837,2859 -2911,2993-3004,3109-3308,3330-3527
atgtttgccgctgagccgatttcggaccgattgctcaagtcaagtgaccaacagacgaatgaattaactcaaaacggcggagatgggaacaaaggggaggtccaagttattgtgaaaggtgagaatttggagtgtgttcaattaaattttaattcgtcagtttggtcggaggggggatttatgacaccccaaatgaaaaatgtaaataatttttatcgagtcacatgaatttgggtaaataaatgtagatttaatgagcaaagtattaagcttgtctatgaaacgattttcttttttgttcagtgatttctgccaattctcaggtttccccacgactttcaacaaatttcaaattgcttctcttttccccgactttcgtcctttgcacgtcgaatatctctccggtggggaggctgtcgttcaatttgcgaacaaataccacgcagctcaggtggtccgcaactataacggactttcgtttgagaatgaaaattttattttggaggtaaaaatgctaattgtcagattattaatctattcttccttttttattttaggttcgctctgccgggaattatcaacgccaatttttgcaagataaactcaacaatttgtgtgttggaacgaaatgagattttttgacttttttgaaacaaaatatttattcagatgtttttttgttgccaaagtgaacggcttttatattttatggttaagcagcattttaaatttgagaaaaatcgaaagaatcgatcactttagccaagctcagtttttgcattcactttcattgtttgcttataaattacaacttttcgatattacattcttttataatgaaatgctcgtcgtttcatcgccaaaaaattgagccgtttaagtaaaacgcatttggcaaaaatggttcatgaaacgagaatcacaaaaagcttattacaattttatttgatgcaaatacatacttaaatattaaattgagttttggctttccctctccccctaattttctttgtttttgttattggtgctttcccccccccccccccctccttcaacttttctcaccattccatcttatacaatggcattttgttatttggagccaaatgcgaaagtcccaacggaaggatgggttggcataggaaaaaattgaattagccatggggaagagagatggcattcattcagtgccctccggcgagtgatggaaagtgccccttttgctgcccctcccttcgctcgtcttaactctcagcttctctctcttcgcccattcatttcgcttttgctgctgcgtcttttcattgcgcatttttttctcttccattttatgtcactgaaagaggggaggaaggaattgttttatttttaggaattgaaaattcatttagaagaaaggcccacaccagggatggaattccgaggctcaaaaatttttcggaagtcggaattccgagcccaaaaatgtcggaatttttcaaaaaatataataaacaaaattttttaaatatttaataggctaaattttaaaattcttaaccatgtaaaggtgatatcaaactgtttttagtatatttctatattaatttaattttttttaatgattttcaaaatatttttatgtaattttacatttttttgaatttttttttgggacagttacacccttttttgcggcgcgctttatccaaagaaaatttgggtaatagggggagaggtccggcggtgccgataggcgccgctggaaaaattttagtgatttttaatgcgatttgttaacagatttgtccacgaaaatggccaaatttagcgatttcgagcacattttcaagaaaattaaggatttttaggtccggcggtgccgataggcgccgccgggaaatttttaaaaatttcaatgcaatttattaacagaaaattatacaaaaattgctaattttttgaaaaaaaaaattcaaaaaaattccgactttttatcaaaaatgtcggaactcggaattccgtgccacccctacaatgaaccacaaaaaaattataaatgtttatttctaaaaaaaatttcctccgttgccattttcaaggagtacaagcgcgagaaggcgtccgccgaacggacacgccatcgccggaacagtgtgctgcattttgcgtcgtccgccggcaccgccgtcgcatcggtcgcgtgcagtagcagcaacggcactggcggtgaacacgcgcagctgcagcaacagacgacggcgataatgatgccacggcgcaaggccgttctgcaggcaaacttttcatttcttgtgctgccagaaaatgcattaataaggccatcgagaatgactcaattcccgcgaccgatattcgggactgaccgagaaattaacgcatgaatcgaacacccccccccccctaaaggaagtcgagaccgacagaggattgtttcccgatttcgtcattccccctcccgaattcaaataagataacaaaaaaccaaaatttttaaaaaggtttttatacgttttccggcgtggtggtctttgcctttgtcacttgccgaaactcggtcttgggttcgaatcccattgtgtgtgttaaatttttcaaacatttatttttaattagaaatggtaatgcatattttgttgctttttcagaccggcgcactcaattttcggccacctctcagccgttcgcgcagtgtgccacgcctttgttccattgacgaggaagaggcacgggccgaggagcaagaggtacggtaaatgcctgtttataccgtatgatatgcttctctctctaccgcttctcctatacttttaaacagtttccctctattctatgatcacataatttctttgtttttattttctctttactcattgcttattcctattctcggctccctttttattttggttctctctctttctctccctctgtctctctctccctctcttctctctttccctctctctctctctctctctctctctctctcgattgtactcacttatttctctcctcctctccctctccctttcgctttgttttttttttattatctttctatacattttttttctcaatcttcctttctctcttttggtttttttcatctctgatttgataagagatcacttcattgtaatttccaaatatataattacatcatcattatcacaggatgagtgtgacgagactgtgaaggatgaagacgaagagttgcagctttcatcgtctgatctggactcattgaacaccgcggatcattaccaaccagtgccaataccaaccgcgaccacaacgatggcaaacgcaatggcctcctttgcctgtgttgctgctgatcagcagaccatcaccgactcgtcatgtcgttcaagtgcatgtggagacgaactcgaagacgaggacgacgatgctgaggatgaggaaaggaggcatttttgggcagagcatcatcatcaatttcaccgtaatgatgatcaccatcatgccaatactgcgccgggacgtggtccgcattaaaataa

SEQ ID NO: 62872 - DNA, 302 bp, Heterodera glycines
  Genomic contig location: Contig_ID=SeqID_6778; Location=4016..4317; Strand=+
  SCN-specific regions: Sequence locations=1-50,73-260,297-302
atgcaaatttttggaaattcaaactcacttcagggttggacaatgttagtgaataaagctttaaaaataattatttccagaaattctggaaatttgcgattttttagaaaaattcagaacgccttttgaaagagcgttttcacaaattaaaatactaggaaatccgatattttttgattattatgaggtattttctcttttatttttatctcttttttttgaagaacgttttactaaacattcaaacgaatttcaaaatcaatttttattaaaatataaaaagaaattattttttagaaaaa

SEQ ID NO: 62873 - DNA, 711 bp, Heterodera glycines
  Genomic contig location: Contig_ID=SeqID_32563; Location=497..1207; Strand=-
  SCN-specific regions: Sequence locations=1-163,185-423,457-556,595 -605,627-655,677-711
atcgccctgtgcagtaatattgcgatgccattgtattcactgttcaaaaatttctactcagtccaacaaaattgtgacatcgtttgtaatccttctggggtgcttaccataaatatctttgcaaatacatattacaatgaagatccagtgtaagtataaatggtatcggataggcggaagcattttgctttaataaagcaatcaatttaattttttgtattttctaaaaaatttggttcttaaaacattttttaaaaccattcttcccggataaaattataaaatcgcttgactgaaatccctgttctttttggccaaaattactttttatctccatccgttttattatgagtgaagaaaaaaccactaaaacttcattttataaaattgaaacaaaattaccaaatttatcaatttatgaacattttttaaattaatttattttcaatattttttcaacagcgcctatcggcaggtgggtgaggctaatcctcccatcttaggactttatttaaaatattttggtgcattataagtcaaactatttgaaaaacccaaatataaaattataaataaatgaaataacatttaattgcagtgccatgggaatgggtgacacattgttgtgcaaagccatagaaccattccgccgtttaaaactgagcaccgaagaatttgtacttattcgagcaatcatttactcccatatgg

SEQ ID NO: 62874 - DNA, 1067 bp, Heterodera glycines
  Genomic contig location: Contig_ID=SeqID_32564; Location=1..1067; Strand=-
  SCN-specific regions: Sequence locations=1-309,422-588,613-724,903 -1032,1058-1067
gtgttaagcgaaggccctcacggtccgcccgtttattacgcaacggttggccaaatggtaaaacaatttaaaaaaatatgttttggtaaatcctatttaaattgtcattttcgatttatcacaaatggacttgcgaagcgaatgggcccaaccaattttgcatgactgtggtaaaaataattaaacaaatcattcatttaattatccaaaaatgagttgctctcacagcattcatgctttgccgatgatggaaatggagacaaagtgcaattaatcgacgaaaaagggtgggggaaagtggggggggggaattaaaaaaataaaataaattattttaagtttaataaacaattttgattatttttcaatggaataaataaatttaaatgtttattttaaattaaatttattttaaattaaaaaatatatgttagctgcgcccgtgacaaatatttgttacaaaatttggagtacgtctcggatttgatggtcggcaaagaagcgcacgtctacaaatatgcagacagacaaaagtatggagaataatttgttgggactaggatttttgctggcaaaaatgccaccatattttgaaaaatatttttcaataaatttgaaaattgagtgagttattcttttacactggtaaaaatgccaaatttttgatcatttggtattaaataataattatggatctggttgaagccgaaaatctctgtaacagaaattaaaaatatttttttcaaagcattttaattaactttttattattttaaaaaatatttgacatttcaaaataagaaatgaattatatatattataaaaatgagattttccatttgaattcaaatttattgaaaccaaaaaaatttaaaattatttttaatttttagtatttatttcgattgcaaaatttcgctgagcgtcaaacgagccgttctgcgaattttgccccgtgccgaactgtgcggaccctccgcgccgaaaacattacaatttcattagcagaaaacgaaagctaccaaagagacatttggaggaagaagaaaagagtgataaaaacaaaa

SEQ ID NO: 62875 - DNA, 441 bp, Heterodera glycines
  Genomic contig location: Contig_ID=SeqID_32566; Location=468..908; Strand=+
  SCN-specific regions: Sequence locations=1-441
atgtccctccaattctctctctctctctcagacgtggccgtctccaatctcaacgaattccatcgccgacatgaaaagcgtcaatttgcgccggtcggaaaggtttggcgccgcttgcaaacggaccaatgtcccattttgaaggtgatcgacggagtaaaagtgctcattttggatggacagacaatgaaacgggtgccaatcggagtcccaggcgaagtaaacggaggaaattgcaaggaaagcaaagaattgacagatttacgtcgcgggtccgactttggcaaggggttatatcaaccgccccgagctgaacagagaccgttttgtggaagtgccggccgaactgcgcaaagaagtgggcgaagagcgaatgtaccggacgggcgactggggctatttgatgccgaactcagtgctggaaatatgcggacgctgtga

SEQ ID NO: 62876 - DNA, 109 bp, Heterodera glycines
  Genomic contig location: Contig_ID=SeqID_32568; Location=1..109; Strand=-
  SCN-specific regions: Sequence locations=1-109
tcaattgagttctgttgctgtggggaaagcgcttcgcgctcagggacgcggcttcgccgcgtctctagaaagtgatgtaatttagcaattcatcgcggcctcaggacgg

SEQ ID NO: 62877 - DNA, 630 bp, Heterodera glycines
  Genomic contig location: Contig_ID=SeqID_32569; Location=698..1327; Strand=+
  SCN-specific regions: Sequence locations=1-241,265-630
atggccctcccatttaaaaaacgattttacataaattccgcggcatggataaggtgggaactttttgttcgaattccggtccggggtgaaaccctcggaaaactgatttctaagagagagggggtcagtcactgctgaacaaaattggtcacatttctaatatcccctacatttttgtccttttttgggtatcaaaataaaaaatgttgtcgtattggaaatacgaccccgaattttcattaaaattccttaatttcccccctcattttcagtcaaattgagccggtgcaggaccatgtcatgaaatcttctatgttcgttttgcgctgttttgtttcttcccattttcatgatgaattccttaattttccccctcattttcagtcaaagtgagccggaggaggacagtgtcaactattttatgttcgttttctgctattttttcttcccgttcattcaacgcacacttagcttttctcatattattcgataaccacgttagttgaaaatttcaaaaaattgaattcaattttaaaaaaagttataaaataggaaattgcaaaaaaaaaaatcgtttttcggcaataattttttgataaatttatgaattttttggaattttgcaggcta

SEQ ID NO: 62878 - DNA, 1025 bp, Heterodera glycines
  misc_feature (912)..(912): n is a, c, g, or t
  misc_feature (961)..(961): n is a, c, g, or t
  Genomic contig location: Contig_ID=SeqID_32570; Location=264..1288; Strand=+
  SCN-specific regions: Sequence locations=1-39,61-205,227-394,416 -629,651-724,759-857,889-918,940-1025
atgaatttttctgaggtaaaagctttgaatttatttaacaactatttattttggtgtaaaaccagtgttcccaactctgcttatttgtaagcattttgctgatttctaggggtcaaagatgatttttttgttagattctgatttgctgctttttgagaaaatttgctgatttttggaaaaaaatcagcaaaaatatccgtttttatgtaaaattgctaccaaaaagtaccaaattttcaaatttagggcgatatgttgatttttttgtgtgtgactttttattccctagaaattttatggcttcattgtttattaactaattattttctcgattttaagtacatttatgactgtaatgcgcaaaattttcaaaatttgctgatttatgctgatttttggaacaaatctcaaaatggctatttttaggctatcggtccaccggtccctaaaattccactgaaattttcaaaatttgactaataaattcccaattttcagtgaaaatctgtttaaaaaggttcaacatttccaattttttccacggcggcgtctatcggcaccgccggaaccacgccccatgtttccaaaaggttttttttggataaatcgcgccgcaaaaacctttttattatgttttatggaataaaatttaccaaaatgctgatttcaaagcatcaaaatttatgccttttttgtggtgaagcaattaaatcggtaaaattgctaattaaaaataattaagaaaaaaataataattaggtggaatttgttagatccatcgtcaacacaaaaagcagcacaaacacgagtcaatgagttgacaaggattaacgaaattcgacagccacaattattccaaaaaaataataaataaatgaaataaaaaatgattgcagaattattaaaaattanattcgcttgttttttacaaaatatttctaattcgtgcaatatgccttanacaaatttcatttttcatggaaaagtcttgttaatgaaattattaatcacttccccataattaa

SEQ ID NO: 62879 - DNA, 48 bp, Heterodera glycines
  Genomic contig location: Contig_ID=SeqID_6779; Location=4208..4255; Strand=+
  SCN-specific regions: Sequence locations=1-48
atgaccttatcaaaaaagtttttgccaagaccatacgtttcggcatcg

SEQ ID NO: 62880 - DNA, 137 bp, Heterodera glycines
  Genomic contig location: Contig_ID=SeqID_6779; Location=299..435; Strand=-
  SCN-specific regions: Sequence locations=1-10,34-137
atttgataggtaaatttttttttaaaattatttctcactgacgaaatcaactactgacgaaatcacttactgacgaaatcactcactgacgaaatcaatcactgacgaaatcaaccactgacgatatcaccggggac

SEQ ID NO: 62881 - DNA, 1862 bp, Heterodera glycines
  Genomic contig location: Contig_ID=SeqID_6779; Location=1795..3656; Strand=+
  SCN-specific regions: Sequence locations=1-1045,1092-1591,1613-1862
  Gene Ontology: Mol. function=protein binding
atggagcaactccaatcctcacatcaactggaatatccgcccttacttgtctcacaatatttcgacttgtgggaaaatctgatcgtgcttcattgcgaagccgttcattggcttgtctgacctatacccaggaaaaatccatttcgaacaaattaaaatcccggatccgaacccagggacggtcccaggattttggtttgggggggggggtaccaacccctcgggcgacgacctttttttgctcttcggctgcataattttttgcgctcgattttcaaaagaataaggtggtcttgccccccccccccccaatgggaccgtccctgtccgaacccttaatacaataatttgaacccacgtgtaatgagccaaaaatgggatcgtggttatgttgcgcagttacacgacccattctgtaatttgaaccatcatcaccgactaataaatttgactgcacgattgccctcccagggcaatagggaggacgccgagggcatttccagtaactccagccgtcttcagttcgggaatcggccttagaaaactattaattttttccatttaaaagatttcacttcgtaaagatactcatagtcgccatgagtgatcagctcacggccacgattggatttgcatacagaaaaacggattaaggccattgaagacaaaaaaaagatcaattaatggggagaaattcggaaacgaagtctcgaggtcaatggaaatgaccactggcgagtctcgaaaaacgaacaactaagagacaaaaccgcaaaagcgacccattatcactgataagagtgaccaataggcaatgaaagggcaaacaaataattttttctcgaaagacgaacacacaagatacaaaacggcagaggcaaccctcaaaaagaattcttttctctgataagagtgaccaatagagagtgaagaggcaaataaagtttcgtattttaatgtatgaatatattttcattatttattgcatacaaatgtattatagttcatatgaaattataattagttcatatcacttgcgtttttgaatttattttaatttttgataggtaaattttttttaaaaattatttctcactgacgaaatcacttactgacgcaatcacttctgacgaaatcacccactgacgaaatcacttctgacgaaatcacatggcaccggggggccggtaccccccccacccccaagccgaaatcctgggaccgtccctgccactccaagacgaaccctcatataattatttttttatgtttagccaaaaagtataatcttaatgcattggccaaagcgtgtttgaatgttcccatttccgagctcggcaatgtgtttctcgcttatgaccaatctcgccttctcagcgaaaaagcatgaaattttgtttccattttatcattaaattaaaatcaatcaataatttttgtcatatacaaattttaattttttctttgaagtttggtacaaaaaatcagatcaaatcgatctcttattttttttcttttttttgaggatttctcttgtcgctgcttggattacattgaccaaaatgcggaatcgctgatccaatcggatgcctttttggaaatggaacaaaatttgctgtatgaaattatcgaacgtgaccagttgaaaatcatcagcggcgaactcattatttggaatgctgtactaataatgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcgggtttagccgactatgttg

SEQ ID NO: 62882 - DNA, 389 bp, Heterodera glycines
  Genomic contig location: Contig_ID=SeqID_32572; Location=47..435; Strand=-
  SCN-specific regions: Sequence locations=1-66,91-389
atgaatttggaccgtgtttttcagagcgattttagtaatggagttgaaaatgatgagttattaggaaatgaaaatgtttttgttattgaagatgaaaatgagattttagaacaagaaattgattgtcatgttttgtctgaacataattatgctaaacgagcaagagttttgaatgttgccagccaggcatctctgaattcagatattggcgttgcaggaccgtcacgtgtgagtgatagtcaatttgaagaaatgagaagagatgagtatttgaaaagaaaaagagaacgcgaaagattgagaagagaaaatgaagcacaaagtcaaagggctttgcgtttagaacgaaatagaaatagaatgagcagtcaaagatctgaagagaatgt

SEQ ID NO: 62883 - DNA, 102 bp, Heterodera glycines
  Genomic contig location: Contig_ID=SeqID_32576; Location=170..271; Strand=-
  SCN-specific regions: Sequence locations=1-1,32-102
atgtctctatttttatttttattaaatctcttgttccggcacttccgcctcggcgtcctttctcttccatatataaattattcagaattattttctttcctg

SEQ ID NO: 62884 - DNA, 1396 bp, Heterodera glycines
  Genomic contig location: Contig_ID=SeqID_32577; Location=206..1601; Strand=-
  SCN-specific regions: Sequence locations=1-285,307-392,414-414,468 -828,850-900,922-995,1017-1136,1165-1197,1226-1396
atgacaaattttttctgtcctcctgttttgatttgtgttctttcacttctaactgctgttgtcagctcattgaaagttttgcaaatcgcgccaaactttttggacaccaattttgagctgagtgtgcgttttgccaatcttttgggcgagaacggtcatcatgttgtaagttagcgaatttgaattgattcctaataatttcattcaattattttcaaatactttttaactaacagggttgtcattcgaatcccagcctttttctcgtccctaatctcgaatcatgatcagaaaatttcgggccgccccaacctaaaaccatggctaaaaagacagttttttttgatgggataattacgactcttaaaattgaattttgcaaaatatgcccaaataaaacaattattttcccccaaaaaaaaataaatattttccattaaaaatatcaacaaaaaaaaaaaaatttagtatcaaattcatctcatttaatgaatgatttcagcattttctggtcccattgagcaagccaaacaatttgcccgctttggagcagttcaattcgaatgtgcatgtgtaaatttgtcatctgtcagaagcaactttaaaattggtggaacaaacgccagaggataaagattacataaatcctgcaccggaaagcatccaaaaaggtggttggacggcacggcactacaagcagagcccagcaatcgcatttgtggaaggatttgaagtgattgcaggtggtaaaattggtgcttaaaatggtacaaattaaagcacaagcactcctaaaaatggaaaattgggtcctcgttaattgacattaattgggaatggatgaccgcaattaattacccagattttgtagtactccacaattctcattggcatgaacattgtgtgtttgtttatatatgccaaaatccaaaaaaacgcgggcgaaaaatggggcaattattgttgcgccgccgggggggagggctggcatttttatgaaatttttggaatttttatgaaaattgttaagaagtcaaaacgcggaaaattcagcgtttccgcggcaacatagaaagaatgagctgatttttaaagtccaaaatgatggaaatcattagaaaatcagcaacactatcttttatataagtaaaaaattaattatttctaaagacgaacaaatttcgaaaaatagttaccaagatttaaaaattttaaatttgtttaaaagatattagtgaaaagcttcgccaaaaatccttggggtttacacagaaaattatcattagggatgtcaaaaatatgtacagaaattggtaaaaatatgtacataaatatgtaaaaaaaatcccgaaatatgtataaaaatccaaaatatgtacgaaaatatgtaaataaa

SEQ ID NO: 62885 - DNA, 495 bp, Heterodera glycines
  Genomic contig location: Contig_ID=SeqID_32579; Location=203..697; Strand=+
  SCN-specific regions: Sequence locations=1-91,121-291,340-495
atgaaacaacatattgcttcatcttcaaacagcgtagataaatgtgatgaagaaaatattaaaaattatatcaaggtaaatgaggaccccgaaaaaattaaaagatttttttttaatttagaaaattcatggtattatttcatcaaaagtgttgaatatttttaaacgggatttcatggaatgcccaatttgctatgaatttgtaatgtatgatcagctctgtttttgtgatcatttaatgggcgacacaatttttggtagcagttcaaacaatgcgcaaaaaggcaaagcaattaaaattaaaaattgtattttaattaataaattattaatttttaagaattgcacatattttgccatgaatgccttaagagctacacaaaagcggcactcgaaacgaaatcattcgcgcgcggttggctgggactgaaatgcatggcggagaaatgtgaaaatccaattccatggcgtaaattataactaattattttatta

SEQ ID NO: 62886 - DNA, 798 bp, Heterodera glycines
  Genomic contig location: Contig_ID=SeqID_32581; Location=233..1030; Strand=-
  SCN-specific regions: Sequence locations=1-267,289-290,313-315,351-798
atgccattggcaaagggcggactcggcctccgatgcatggccgccgattgcaacaatccgatcactcttcgtgagtcaaacagttttttaaattttttattagtattttcctccacgcaaataaataaaatttatgccgttttgaattttcaatattgtagaggaacttcaagcctttgtgccatcttcgacagttacaaaattggaagaacgttgcgctgagctcagtgtggtacaggccaacctcaaattcatggaacggtgagcgtgaaaatatatacaaaaaagtatatttttattagtttttggttacccaaaattaaatctattgtttaaaaattaattttaaacgattggtttttaggggtattccgtttaattcgataatggtaatcttttcattagaccaatatgtgaaattagttttgttatatgacattctctaattcgtttaattttcacttattttgttttcctttgtcagttgtcgtagctgtaactgtgccgttgaattgggtgcctcccccgatgttctgatggtgttcagttgtcccgattgtcgtcttaagttttgtcgtttgtgtgacgagccatggcaagacgaacacaagggcgtcagctgcgagcagttcgccaagaaacagaaccgcgaacgattgttgtgagcgaacaaaattatatttggtctttcagcaatttttgttttttcctttcagggaaaagcgtctgtctgaagctgtggtgcactgttgtgccaagtgcaaaatgtccttcgtgaagcatgacggttgtaacaaa

SEQ ID NO: 62887 - DNA, 1685 bp, Heterodera glycines
  Genomic contig location: Contig_ID=SeqID_6781; Location=375..2059; Strand=+
  SCN-specific regions: Sequence locations=1-122,144-276,298-588,610 -1040,1062-1400,1422-1685
atgaatgcaccaattttaatgaacgacaaatcaatcgatttcgttttggacagcggcacagaaataattgtcgtcaccaatcagacgtacaaagatattggacgaccaccaattcaggcgtgtcaggaagaagggaaattttttgacggaacgcgctgcaaattccttggccgcggtgttgccaacttccaattcaacggaatccgaacggagctaccatattatgtggccaaaagtggaacaattaatcttttgggcctgactgctttggaccgtcttggatttctggaagaaatgaagcggctgatcggcaccaaaaatattaatcagatttggtccactgattcaaccaaaattcgggacacaattgcaaattttgagaacaaatatgagcaaattttctctgagggccttggactctgcaccaaaatgaagggccaattgatgctcaaatccggcgcaaatcctatttttaaacgcgcccgtcctgttccttacgcaactctgccgacaataaatgccgaaatggatcgattggagaaattaaaagttatcaccccggttgatcacaccgattggtcagcacccattttggtggtcaaaaaggcaaatggaacagcaagattatgcgcagatttttccaccgggcttaaagactcgctccaattgaaccaacacccgcttccgcttccatccgacatttttgccacattaaatggaggaaaatatttctcaaaaattgatttgtcggatgcatatcttcaaattgaattagaagaaaattcgaagaagctgtgcacaattgcgacacaccgcgggcattaccaatacgaacgtcttcctttcggcatcaaatcagcccccggcatatttcagtcgataatggacaacatgttatcagatctgtcattcgcattggcatatttggatgatctgatcattgtcagcccaacattggaaaaacacaacgagcatttggatcaaattttctccaaaattcaggaatggggattcaaaatccgaattgaaaaatgttcatttttccaacccaaaattaaatatttgggagtgattatcgaccaaaacggacgacggcctgatcctagcaaaatttctgcaattgcggaaatgcgaatgccttcaaacatcagcgaattgcgttcctatttaggaatggtaaattattaccaagaattcgtaagaaattttcgcacaataagacagccgctcgatgagttgctgaagaaggattcaaaatgggactggtcgccgaaatgtcaaaatgcattctccaaaatcatcgcaatgctccaatctgatctggcatttacgcattttgacccatcattgccaatcgtcgtcgcagctgatgcgtcacaatatggcattgatggagtgatttcacacaaattcagtgatgggacaattaaggccgtttctcatttttcccgatcacttacaccggcagagcaaaataatggacaaattgaaaaagaagcccttgctcttgtgtaagcagtaaaacgttttcacaaaatgattctggtcgataatatactgttctggcggatcatcatccattatcgaaaaggtattcatcaaaaatgatgtcccaatatactccctcatccgccttgtccgatggtctttaattatgaatgcctatgacttcgacatccagtaca

SEQ ID NO: 62888 - DNA, 628 bp, Heterodera glycines
  Genomic contig location: Contig_ID=SeqID_6782; Location=764..1391; Strand=-
  SCN-specific regions: Sequence locations=1-102,124-130,152-299,339 -452,481-628
atgcaatgtctttgtaaagtgttgccgccgctcattctcggacacttgcaaggcggtaaatgagataaattaaaattttggttttactagcagggatgtaagcttattcaaataatgaaattttgcgttgtttagttaaatttttataaaaaacagcaaaatttttaacaataacaaaattctagacaaagttagattttgaaattttttatcggctatgctttctgccacgccgccctcacaccatttaccgtgagttggacataaatttagtaaataaagtatccattcattgaaacaaattaaaaattattttttactaatttaataaaaaaaaagacgtggaaaattctatgttgaaaaaattttgtaattcacaaaacttccgaattttttttaccatcggcttatatccttgtaatatataaaatgtcaaattcatattttaagcgatttttttttaaattacatttaaatttacaaattcagtaactcaaccgatcaagactacaactgaaactgagccgatcatcagcccaaccgaaaactacaccgaggaaccgaaaaccgctgtcactttgttggcaagcaaattgtttttctgttgataaatctaattttaaataaa

SEQ ID NO: 62889 - DNA, 817 bp, Heterodera glycines
  Genomic contig location: Contig_ID=SeqID_6783; Location=12..828; Strand=+
  SCN-specific regions: Sequence locations=1-131,200-425,447-817
atgaaatggggattggcaattgacgcaaaaagaaggccggcaatgtcgccacatgtgcacgggtcccatgttgtgccgatcatttcgagttctcatgctgcacgacagagcaggtcgtccccccccccgcgaaattttttttaaatttttcaaaaattataagtaaaatttttttgaaaattttttcttataaatttttgggcaaaacagattgcattaaaaattacaaaaattttccagacggggcctatcggcgctgccggactcccatgtgttgttccccaaatgttcttggaaaaggatcgccaaaagcggtaaaaaggtcgtcgccatatggctcaaaatcccaaaaactggcctttatagaaagatcccgaaaaaatatttgggattgatcgggattcggtcgggatcccgggtatctgtcccggttgcttttcaaaaatctacgggatagatcggtatcgggattcgatcgggatcccagttattatctgtccggatcgcttttcgaaattcttcgtgattatcaggaccgggattcggtcgggataccaccgattccagctgtctggtccctaggggggggggggggaatgtataagtaggatggcaaaacttgataaacctcgattttaaaaaattatagcggacccgcccccccccctaaaaaaccgaatataaggcaaatccgccgtctgactctgtccccattttttattttaatgttcaaaaaacattttttcattttaaggtcacaatcccatcacaaagtaagttcaatttgagaattagaccggagatcatatacagaaaa

SEQ ID NO: 62890 - DNA, 408 bp, Heterodera glycines
  Genomic contig location: Contig_ID=SeqID_6783; Location=1052..1459; Strand=+
  SCN-specific regions: Sequence locations=1-162,207-408
atgcaagaaatggtacaattgctgggccatgcacttcttgaaaaccaaaaattcacatacttttgtatgtacatattcactaatgtaaaaaacattcgattttgagacaattccttttgttttgccaatttttaaatgttttgtcattaattgcaatggaaaaacaggaagaagtaaaattgttttttctgtgttctctttggcaaaaatggtttagccaaagactcacaaatcaacgtcatttcaagtcgttaagaaattcgtattttgaaaatctttaaatgcttccaaatttagcattttggcaattacaaattttttgtgttttgttcgaaaattttttgttcaaaaatgtatttatttttagtgcaatttattgggcattttttaataatattggttgattga

SEQ ID NO: 62891 - DNA, 622 bp, Heterodera glycines
  Genomic contig location: Contig_ID=SeqID_32589; Location=495..1116; Strand=+
  SCN-specific regions: Sequence locations=1-137,159-182,204-515,538-622
atgctcagaagaagtgcagttttatgtctgaagagcggcacatatcttgctaaaggaaaacgagttcaaaaaggccaaatcaacaaaataaaggtcttttctgaactttttggaggtgccttgaccgctaaattttcgccagcaattcttttctttacaaaaaaaaaaaatttacaaggcccaatttttaaaattttttttttggccgattttgaaaaataaatatggttctattatacttcactttatgagtttaattgacatttatatcctatattttggtatcatttgaaagcattgacaaatcataaaattcggatggactcataatagaattataaattgcaggatccctacgccagcgctgacgaggagacgtgtgcagaattttttgccggaccaaccattgaagacagaaagagcaaattccaagcatatgtggccaaagttgaatcaaaagaccaggtgctgctgttggctgctcctttttgtgaaaaaaaaattgtattttctacaggtggatttccttttgaccaaaatcaaaggtgtaggaaaaattgcaagagccacacacaacccatacgcttgggcgttttctgatcactccagcatcgaaaaatga

SEQ ID NO: 62892 - DNA, 698 bp, Heterodera glycines
  Genomic contig location: Contig_ID=SeqID_32591; Location=39..736; Strand=+
  SCN-specific regions: Sequence locations=1-206,233-331,353-439,461 -482,525-633,657-698
atggcattgccggaattggtactcaaacggttgtcaagcttgaggaaaaaggatggaaacaaaattatgccggctagtccaagttcgaaggatggcaaaagtttagtgggaagcgcagaattgccaaaaatagcactgctacgatcattaagcaaacagcgttcaaacagtgttcgaagggagagtgaaaagtcgccatttgatagcccaaaaccccaaaaaacaaaattggcacgatctttgagcaggacaatgttaagccttatacggtagtccgcatacgtatatggtagatttttacctgacacaccgcttttatgttcaattggcaccacattcattcagctttaagagataaagtaaaatttagttctaagaactagatacaaaaatttttgacaatgttacactggctaattttataataggttttcttaagtttacaaaaacattattgaaaattagccgcaaagaaaaagttgttttaaaatttctaaattttcaaaaaaaaaaaaaaaaaatttctctcggctcataagatggtgttaatttgtaaaagaaaattttttttagttttgaatgaggtgcagaaattactggcgacctaaaattttagctttttactgttgctttatatatttgtgtttgaatttaaggtcttaaggcaattttatagtttaatgggaagaattttctta

SEQ ID NO: 62893 - DNA, 155 bp, Heterodera glycines
  Genomic contig location: Contig_ID=SeqID_32591; Location=1154..1308; Strand=-
  SCN-specific regions: Sequence locations=1-14,36-53,76-87,110-125,147- 155
aatattttccgcgaatatactttcttcattttcacaatattcctgtgcctgttcattatttttggcttaaaatatatgcctgaaacgaagaacaaaacattggcagaagttgaagaagcgattgggcaaaagaagcaaaatgaaaattaaataaa

SEQ ID NO: 62894 - DNA, 141 bp, Heterodera glycines
  Genomic contig location: Contig_ID=SeqID_6784; Location=383..523; Strand=-
  SCN-specific regions: Sequence locations=1-141
atgctttcccgttccgatgagcacattgcacatgcaaaaaaacttcgcgaaatttatctggaccgcccaattccgcccatggatgaaggcgtttttgcagttgaacatcacatttttggccaaaaacatggcaacggttgg

SEQ ID NO: 62895 - DNA, 1146 bp, Heterodera glycines
  Genomic contig location: Contig_ID=SeqID_6784; Location=1314..2459; Strand=-
  SCN-specific regions: Sequence locations=1-136,191-297,353-604,626 -840,875-988,1048-1146
  Gene Ontology: Mol. function=UDP-glycosyltransferase activity; Cellular component=microsome; Biological process=metabolism
ttgaacgatttctgatgccgaacattgcgaaatttggtgtcccaaattttaattggttcgaatttttatggcacagtgaaatgttctttttcgaaaatatcgacagaatggggatgccattggctggtaaatgaacaaaattaataaattaaaaatagaataaatatatttttaattaatttatattttagttggggcagaaatgattgccaccggagcacattgtgaaatgaaaaaaaatttacaaaaacttcctggcgaattgtctacctttatggagaagccgaactcgaagggtaattaaataaaagtcaattaaatatgtttaataataaattattaattttaatttctgaaatctaaaatttatttagcttaaaaaatagattttacagtcaaaataagaaaaccggaagcttatccatcgtaaaaatgggcttttaatagaaaaattattcatgaaattagggaaaaatttagggtaatattaatttgtttttttttttaatcttcaaataattgctcgcttggcctattggtatggtagcttgcttttttggtttttcatcacaaaatattttgctttttcgaatgttgattcaattacttatttatcaatccaaccgtattaattagccattaacaattattatttaattattgatgcttaaaaatgacaaatttttaatttaaggagtcctttatgttgcatttggaacacatgttgattggaaatatgcacctgagcatctattaaatgcattttttgatgcttttaaccaattaattgattatcaaataatttttgcttgcaaaggatgtgaggaaaaaccgaaaaagtaaattattaaatataattttttaaatttaaattgcttaaagtttgaaccaaaatgtaatgattgtcaaatgggctccgcagaatgaaatactcgcacatccgaacacaaacgcattcattacacatggcggctttaagaggtaaatgaaatattaaaaatatttttgtataataaaattttaattttttttaatatatatttaattgggtaattaattttcagtgttcgcgagggcatttgtgctgccgttcctctcattataatgcctgtccttgcagaacaggtggaaaaccggtggacataa

SEQ ID NO: 62896 - DNA, 1014 bp, Heterodera glycines
  Genomic contig location: Contig_ID=SeqID_6785; Location=251..1264; Strand=-
  SCN-specific regions: Sequence locations=1-58,172-240,263-291,313 -531,553-627,654-963
atgtcaaacaaagattttgggcttttattgtcaaatcatagtgaacaggtgggcaggcaaaaaaaaaaaagtttatttgttcaaatttactatttatattttaaaattatgtatcttgatgaaattattccaattaaattaataatatttaattaaaagatttatatattagtgctcaatttttttaaattcagaaaaaaacaaattttttttttgctataagtttttttttgaaacctgatgattttaaaaataacagcgaactcttaaatgtaatttttttctgagcaatgttttgaatttctcattgaaaaatatacaagtggcgaaatttacgaaaactaaaaatgtctactttcgagagccccacattttgattaaaaagcatggacctgggtttatgcttatcatgggccagtaaaatttttgtgtaaattccagctaaattttagttttaagaactcctggaacttggcctgagctcaaaagtccttaacccaagtccatttccaaaattactcaataaaaccagtaaaattaaaatttctaaaagtcttggaacttggcctagcctgggctcaagaaaggacccaaatccaggtccaaaattacccaataaaaacccagtaaaaaaaatttaaatttaaaaaaatccttgaattggtctagacttccttgacccatgtcaaggtctaaaataatccaatctttttacccctaaaatattcaaaattcttgcttactcttcaaaaataggttactgaaattgtgagcacggattgggatttgattgtggtcgatgacattttttggtccttcggatttgcactcacaacaatgagacagcgattgtgggaatcgagtggaggaggccagggacaacgaaaacgaccacattatttggtctatgccacgtcagggaccagtgtcactgtgcacaattcgatcagagcgacgggtgggaaaaattaaataatattttatatttaaaaaatatttaaactatataataaa

SEQ ID NO: 62897 - DNA, 1730 bp, Heterodera glycines
  Genomic contig location: Contig_ID=SeqID_6785; Location=1366..3095; Strand=-
  SCN-specific regions: Sequence locations=1-149,200-344,389-594,617 -866,889-1057,1080-1095,1128-1222,1294-1313,1335-1459,1481-1493,1516 -1620,1646-1704
atgaatcaattaaagctgttttgttcatacctacttattacaactgtgttactgcttcaaaatgttgtcaatgccgagaaaattttgtttacttttttccacgacagtggcagccattttcaatcaatgctcccaatgattgaaaagtgaatttttattttatttttgttttttattttaaaatattcataaatttattgacggttcaggttttacttatacccctcccaacaaaaaaaagattttgtatatgaatagggttcgaatttttaagggcgaaaaagttcaaaataaggcagtaaataagggcgaaaataaggtcgaaaaagttacaaatttaggggtataatttttaaattgttgtttttttaatgaaaataatttaaaactgtaaggaagaagctggctgggcggttaaaacgcggaaagcgggcgttgataagatccattgcccatttttattaaactaaagcaaacaattttattcattgattgcagttacagagatacatttcaaaattttcgggggtaaaagacatatgattattggcctaaattgatttctaaagttcagaggtgcaaaataaattttggagattgaatttttaagaaaatttttcatttcttattggtctatttttgaaaattttacggtcgattcatagggatacattttcctgaaattgtttggacgattcttggggggtgtattttcgcttttattgcatttttgttaataaattttggacaaaatgtcaaaatatgggcaaaaacttattttaagggcgaatatttaattacggattttatgggctaacatccaaaataaggatttctaatttcgaataagggcgaaaaacctaaaattttcaaacaaaaaatgtgtttttcgtgcatttctcgtcgagttaaagccggagaaaaaataagtataaacttaaaaccccggtcccaaaattatgaattaagtggctttcatatggtctctaaatcatgtaaataacatttgttttgacatcttttttcatttgcttgttattagatgaattgttcaggattttatgaatatttttgcatttataccccgtctgactcatttaatgatttattttaattttaaattttttcgaaaaatcatagagattacatacatacaacagcagatgtcaaaacaaatgtaaataatattcgtgatcaaaaagacccacattttttaggaaagaaaaattaaatataattattagattaatataaaaataaatatataaaaatattttatcatttttaatatttctccaaataaagcttctgccttatttatttaaaaattgtttcttagatttgccagccgtggacattcagttgcaattttggacacaattcttccagtggaaaaacaaaaaccgtttattcatcatattcgcgccccattaccaattgttccaagcaatgatgaggcaaaattaaataataattattacaaaactatacgatacatacagtacagtagaacagcagtcagttcttaattaggcaggaatgaaacagtttaattcatcagctaatctttgattgattggttagatggatcagaggataattacagattctaagaaaatgtttttttttattattattattatttgaacatttttttttgttgattgtttatgaaaaaaatgtttgcctttcagccaaaaaaaatttatttttcaaaaaagttgaataaa

SEQ ID NO: 62898 - DNA, 943 bp, Heterodera glycines
  Genomic contig location: Contig_ID=SeqID_32592; Location=1..943; Strand=-
  SCN-specific regions: Sequence locations=1-330,352-583,605-943
  Gene Ontology: Biological process=reproduction
tcaattttggtttcctctttgaggtattatacgtctaatttgtatcacaaccgaagttggagagaaggatttttcaagtatggaaagtttgttcgccatctccccgagggcgttaaaccgacgcacatcgttgtgggcgcaggctcagcaggctgtgttttggtgggaaggtaccaacaaatagaaagaatagtttacctaacaattaggccaatcgtcttactgagaatccggacaatcgcgttttgctcgtcgaggccggtccccaagataattggtggaattggaaggtgaattctgatttgtgagaggttagcactgacaaataaacaaaatacactcagattcatatgccagcggcactgatgtataatttatgcaacgataaatacaattggttgggagtcgctgcactttgagcttggagtttgttgattccacattccaggatgtatttcacgatgcctcaggagaacatgaacggacgagtgctttactggccgagaggacgagtttggggtggttcaagttcgctgaatgcaatggtttacatccgtgggcatccgaaagattacgaccgatgggagagagagggggcgaagggctgggcacacaagtgaacaaagtcatcccagtattggtccgagcctttaaataccttcaggaactgtcttccttattcaaaaaggctcaagcgcatgaactcgccatcggtcccgacgacccttacaggggacacgacggaccgctctttgtgacccaagggaagtgcgagcatccgctccaccaagcctttttggaaagcggcaggcagcactggatcggggttacagaagatatgaacgggtacagacaggagggactcggggagatggacatgacgattaaagacgggagacggtggagcgcatccagcgcatatctgactaatgtgcgattcttt

SEQ ID NO: 62899 - DNA, 140 bp, Heterodera glycines
  Genomic contig location: Contig_ID=SeqID_32592; Location=1071..1210; Strand=-
  SCN-specific regions: Sequence locations=1-140
tcggttcatggtgctcccacttcctatccgactggtcatcgtgtgaagaaatgattagattagatatatcgtgagattcggtttttaataggagtcacatatgcatatgtatatttctgcgcgataaaatgcttttgttc

SEQ ID NO: 62900 - DNA, 1073 bp, Heterodera glycines
  Genomic contig location: Contig_ID=SeqID_32594; Location=227..1299; Strand=-
  SCN-specific regions: Sequence locations=1-557,586-777,820-890,912 -1025,1047-1073
atggcagaagaccgaaaaggaaaacaaaaagctaacattgcaagcgctgttgtttggcctgctacaatagtgccaagaaatttgtgggtctcgagagtcttgacggaaaaaaaaattcaacttttattaggccaaaatagaacagcagcgcaacatggtgagaaaatgttaaaaaggcgtcacaaagtaatctctctctagtgattacataattaagtgtctgtgattagaagaaacaaacgcaatttggacggcctaatgagtgagtgttatccaaattgttattagcattaataccccgccggtgagggaatagagacacaagaaagggcaaatataaatttgaattgtgagctgccgaggcggggagagactttgggagacgtcgggtagaaaataattaatgatcattaactaatgagggaggcttgttaataataagcaaatgaggtgttggtataaatcatcaatcagtagcgcttgaggaggggggggggaggggcggagggccccccccagagaccgagaagaggccgagtgagtaccttcggtgcaggaaaattattaaattttaaaaattttttagttgctttttaaatatgccaaaaaatgtaggcttaacttttttagtgaaaattcgatcactcatattttttgttaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctcagttcatttaaataatttttatccaaaaaattttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacactgaataaa

SEQ ID NO: 62901 - DNA, 556 bp, Heterodera glycines
  misc_feature (493)..(493): n is a, c, g, or t
  Genomic contig location: Contig_ID=SeqID_32596; Location=1174..1729; Strand=+
  SCN-specific regions: Sequence locations=1-399,421-556
atgatagcccttctactaagaaggtatttagttgtctgtgctgagccgaacctaaaaaaatctcaataatttaaaaacttaggaaaaattcataaaacttgtaaccaagaattttttaatgtcgagaatcgactgtaacttttttagaccctacttttttttattaaaaattatggagtataatataaaaatagagaaatcttatgctattgaattagataaaaagttatggagataaattaatgtgtcattttttatggaaatacaaaaatttaatgacgtttaaatacatgaaaattgtgaccggaaaatgcgtcagtggaaaatgtgttagtatagagtagtataaaaattttatcagaacttcgttctggattccgaactccggacctcaattttaagccgtttttaaaccaaaaatgctaaattcgaaaatctggtctttcgactttttgttcgagttcgggccggccggggttcggtattagcctanatggatgccggattcgtgatcagcgaccaaactcgaaaacccaagaaacttgtttttatggca

SEQ ID NO: 62902 - DNA, 175 bp, Heterodera glycines
  Genomic contig location: Contig_ID=SeqID_32597; Location=534..708; Strand=-
  SCN-specific regions: Sequence locations=1-1,24-175
aaaatctataaaaaatttaaaaatgagaattcatgcgagattttctggaaataagcttaatagggcctagttaagctgtaaaaaaaattggggcgatttgaatgagaatagaaagagccaggttcgatgaagttttggtaagccaaaaaaaaatccaaacattttttataaaaaa

SEQ ID NO: 62903 - DNA, 525 bp, Heterodera glycines
  Genomic contig location: Contig_ID=SeqID_32597; Location=830..1354; Strand=-
  SCN-specific regions: Sequence locations=1-154,179-315,345-480,505-525
tataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaatccaaacattttttataaaaaatttaaaaatgtgaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttc

SEQ ID NO: 62904 - DNA, 527 bp, Heterodera glycines
  Genomic contig location: Contig_ID=SeqID_6786; Location=604..1130; Strand=-
  SCN-specific regions: Sequence locations=1-527
atgtcaggtaatttaaaaatttttcaattcattgtcagtgacaacaatttttggtcggatattgactaatcatttgggcagctgcccgatgtcgtgttttgaaagtaaaaaaaattcagtacccctctccaaatagcttaaaaattagggtaaaaaccttgttgtttgccgggatggcaatgtcaacaaatttcaacggcgagtccgtgttggccaccgcaatcaccggtgtgttcacgtaggacgcctcacggaccgcctggtggtccaactgtgggtcggacaccacgagcagacgcggttcctgtacaaacaaatggttgtaaaccaaggcttttatgaagtgcaaagctttgggtacttttccgtttggctgccccacatttatttaaattaaaaacgttaaaaagcgcgatgaattttcaaaaacatcgcttcagctatttgggagtcaaaaagcaacaaattggcccagagtataatcgaatggatcagcatggcggttgacgttttttaaactaaataaa

SEQ ID NO: 62905 - DNA, 1655 bp, Heterodera glycines
  Genomic contig location: Contig_ID=SeqID_6786; Location=1381..3035; Strand=+
  SCN-specific regions: Sequence locations=1-290,323-343,365-518,540 -623,657-671,769-1162,1184-1199,1226-1619,1654-1655
atgcccgacctgtacttcttccgtgacccgcaagaacaggagaaggagggcaccgagggtgaggccgaggcggacatcaccgtcaaggagggcggctggggtgccaccggaggcatggacactatgggcggcgacttccccggagtacaggttcgcgtcaaaaatttatgccaaattgcagagtcttgaaggttttagccaaaaatcactggttttaaggatttacattttttttcaatcccggatggcttaaagagttgtaagcgataatttgatcgatagcaaagtttttgaaaatataatatttcaaacaatagaattattgttcctaaaatcaaaagagcacattttcttaaatttaatgctgcttaagacctctaaaattgaaaaaatgtaactttggacccgattttagacataggcgtaaatgtccgggggcgcaaatgtctggacacggttaatgggcctggcctgggtcgtctagttcaaaaatcctttttcggtcgtcccaacttcagctttttcacaattatttaattctaaatgtttcaggccgagccgatcaagctggactttgaagtgccgcacatcaccgactgggccgccgcttcgtcggattggaacgcgccgcccgcggagcagcagccgccgcaagcgcagcaaatggttgtgccgtcgcagccagccgctcaggcgccgtccgctgtgcctccgtcggcgattgcaccgccacaggccgccgctgttgcaccgccgccgccacagccgattcagcagcaccaaccgatgccgactcaggtgaaatgcttggttaattgtagcgaaaattgctcaacatgcatttgttgatgacctccttttcgacaaaaattacggggttattcgaaatgaatgttatttgcctacgaaaaagtacaaataatccaagacaaagtaatttatgagtgtacgaatttgggttttgttatttctgttactgattgatcatttgggttttgagtgtcacaggaaaaaaaattgttgctgtttgtcagcacacggttctcgagcagtacaccaccgctcaattatacctttcaatttgtgatttttcctatgtttacactcaaattcggttgcttttttgcagaaagtgtcgaatttccatttgattcaatgacgaaaggaacttcatcgtttggcaagcgccacaacaaaacccacacgctgtgccgccgctgtggtcggtcctcataccacattcagaagcacacctgctcgtcctgtggctatccggcgaagcgaaagcgcactttccaatggtgggtttttggcaggagcctcggcatttgcggccccaacctactcatttaaaaaattaactttgttccatataattttaaatcgaatctactatgcatgatatgttctatatttaactattttcttatcagtacaagaataattccagacgttttttgttaataagcgcatacattaatgggattggcatggatttcttcgatgtatcactggccgatgcagaaattcaggattagtagaatggatagaaatttcaagctttgttggggccttgagcaagcccaattttgttgaaaaaaagttagaataatgttcatgtaaattttaaaaagaagaaaaatctggtaaatgaa

SEQ ID NO: 62906 - DNA, 1079 bp, Heterodera glycines
  Genomic contig location: Contig_ID=SeqID_32602; Location=1..1079; Strand=+
  SCN-specific regions: Sequence locations=1-183,205-1022,1045-1079
ggcactacaacaaattcgtcaatttgtcaaaaatacattgcctgaacccaaaaattttcaacaaattgaaggcctggacagtgacaaattcacacaattttatcggcgccgcgacgacatctcaatcgtcaaagactgcctgatgttcggcgaccggacaatcatcccaaaatcggtgcagaagcaaattttaaaaatgcttcatcagggccatccgggagtcaaacggatgaaatctttggcccgaatgcatgtctattggccactgatggacgctgaaatcgaggcgttcgtccaaaaatgcacttcatgcgcagctatcgccaaaaatccgatcaaaacgacactgcagtcatggccaaaatctgatggcccatggaagcgcattcacatcgattacgccggaccatttcatggaaaaatgtatttgattgtcgtcggctcattttcaaaatatccggagatatttgaaatgaattctacaaatgcatcggccacaatctccaaaatgcgctcattgatcactcactacggcatcccggaaacaattgtttccgacaacggcactcaattcaaagtcaccaattccaaaatttcgtcaaatcgaatggaattgaacacatttttactgcgccgtacatgccacaatcaaatggccaagccgagcggatggtcgacaccttctagaggacatttgcgaaaataaaaggggagggagttgacggcaatgtgctcgacacttttctactcacctatcgcaccacgccatcagaactcttgacggaaaatgcccggccgaattatttcttggccgaaagcctcgaattggcctcgaccttctccggcctccgccgtcaattccaatcataaaggacggtaaaatggaggaccaattcaacaggaaacacggcgccaaattccgatcatttgacattggacaattggtcttcacacgccggcacaatacagcggattggcgacccggcaaaatcatcgacaaaaagggtgtaatttacaccgtcgaattgccgaacagttctcgcggtcgatttcatgcaaatcagatccgcacacgtcaa

SEQ ID NO: 62907 - DNA, 280 bp, Heterodera glycines
  Genomic contig location: Contig_ID=SeqID_32604; Location=765..1044; Strand=-
  SCN-specific regions: Sequence locations=1-4,26-106,128-280
caatctaatttcttgcagattgaaagccatccattgcctgccggttctcggcacagcaaagcactaatagggtgtttgactcacttcaaaaaataattccttacccaaaagttttttacaaccacttattgccaatttaatttcttgcagatttaaagccatccattgcctgccggttctcggcacagcaaagcactaatagggtgtttgactcacttcaaaaaataattccatacccaaaagttttttacaaccacatattgccaatctaatttcttgc

SEQ ID NO: 62908 - DNA, 1624 bp, Heterodera glycines
  Genomic contig location: Contig_ID=SeqID_32607; Location=289..1912; Strand=+
  SCN-specific regions: Sequence locations=1-446,471-1519,1541-1624
  Gene Ontology: Mol. function=motor activity; Cellular component =kinesin complex; Biological process=centrosome separation
atgatcacaaattttggttcctgttcctctgttaaacacaaagttggacctacaacgaagcgtaaaaatgtgcaagtggtcgtcagaacacgtcctctcagtgaaatggaacggaacgagcggtgtaaaaatattgtttcatgtgattccgtctccaaagtcgtttcattgaaaacaaacacatgcgacaaatacagcactggtcagcgccaatttggagtgttcgataaggtcttgataaactcgaattgaatatttatcattaacttataaaaaggcagcttttaggtttatggccacgaatcaactcagatccaagtctatggtgatgtggttgctccattgatgaaagaagttttgaatggctacaactgtacagtgtttgcgtgagttatttaaataatgttacttttagagggcactttttaccaaaaaaaaattctcagatatggccagaccggaagtggcaaaacctatacaatggaaggccgccacgacgaaagtggagctttttcttgggattcggacccgacctctggcattattccgagagcactgcatcaaatattcacagagctcagcaacgaagtctgtctaatggagaaaagagtgtaatatttgcgttgcaattatttcttttttttgcaggacatcgatttcaccgtccgtgtctcttatgttgagctttacaacgagcagatttacgacctgttgagtctcagtgaaacttctcagtgtgaatcgctgcgtatttttgatgacaaaaataaagttttttttccaaattttggcggcaatttattttcccttagggggtttctattgttggcgctgaagaagtcattgtgcgcacacgcgacgaggtgtacgacttgctaagacgcggtgcagacaaaaggcgtactgctgccactctgatgaacatttcttcaaggttttgcttattttgttgcccattcacaacgatcattcgtaatgccttttagtcgctctcattcggtttttaccgtttcggtgatggtccgcgaatcggggctggtcaatggcgaagaaatgttgcgtcaaggaaaactcaacttggtcgatttggcgggctcagagaatattggacgctcgggggcaactgataaaagggcacgcgaagcgggtgagtttttgtcttcgaagtatttttatgctaacttcagtcgcttgatttgtgttgcttcaggcaacatcaacacgagtttgttggcacttggcagagtgattaatgcactcaccacaaatgcgccgcatattccttaccgcgaaagcaaattgactcgaattttgcaggattcactcggcggcaaaacgatcaccacaattattgcgacgctttctccggcatcgtcaaactttgaagtggaaataaatcggaggcaagcaattaattggcttaagctcatttcaggagtctgtcaacactcttgaatatgctcaacgtgcgaagaacatcaaaaacaacccggaagtgaatcagaaaatcacgcggcgtggacttctcaaagaatacaatgaggaaatcgaaagacttcgtcgggatttgttggctgctcgagaaaaacacggaatttttttggacaaggaaaattatgagtag

SEQ ID NO: 62909 - DNA, 872 bp, Heterodera glycines
  misc_feature (181)..(181): n is a, c, g, or t
  Genomic contig location: Contig_ID=SeqID_32609; Location=193..1064; Strand=-
  SCN-specific regions: Sequence locations=1-112,134-339,361-527,553-851
ctcccgtcggccaactcacggaatttatcgtcgatgttcttccgtccgatgagggagacgacactgcttcagcaccagtgattgaacagttaccgaaagtgcaaattacggtaatgtaaaaatatttaaattaattcaagacaattggctggtaatttatcacttgctctcaccaaattgnatcacttttaggaccctcgtggtgatctgttgcccgtcgacgttgcggcctatgaagaagagccgtcgcgttccgttgtgcgttatacaccgcaaacagtgggcaatcatcaggtaaaatgaatgaaatgtttacactttatttaatacatgattttcaatatatttaaataattaaaacgccaataattcaaatcctccgacggaatttttggcaccgctggtgccatcaaacacactcaaacaccaataattgggagaacttttttctgtgaaataacctagtctcttcgtctttgtttgctatgccaaaaataatttttgattcattttttcgttaaattctcaatttataaaattaatttttaatttgtttgttttttccttaaattctttttcacaaaaatttctcttttttgtttagatttctgtacaatttgatggtcaatctgtgcccggttcgccttttacagtgaaagcttttgatgccgaatgtgtcaaattgacacttgaccaaccagcaaaggcaattagtcattaattgtttcgtatttggatttaaattacccaatttaaggtcggtcgctcgtgcacttttaccatcgatgcggcaaaggccggggcggggaatatgtgagaaaaaaggatttctaaatcaaaaacgaaaacctaaattctattttttaaataaa

SEQ ID NO: 62910 - DNA, 398 bp, Heterodera glycines
  Genomic contig location: Contig_ID=SeqID_32611; Location=600..997; Strand=-
  SCN-specific regions: Sequence locations=1-236,258-282,311-398
attactggcgttagcatcatagctgtgcttttccttgtctttttgatgcccttgcaaaatctggtgcgcttctgatcagtttataaaaaaaagttaagcctaaaatttttcgcatatttaaaaagcaattaaaaatttttagattttttattcatctccctttttgatagagaaagcatctgagtgcctaaataacttgtatataagatttggtgcgtttcagagcagtttctgaaaaaatatttatgaattaattttgctaaaaaaataaaatagtgacgctttaaaaattaataaaaaattttaaattcagaattactggcgttagcatcatagctgtgcttttccttgtctttttgatgcccttgcaaaatctggtgcgcttctgatcagtttat

SEQ ID NO: 62911 - DNA, 848 bp, Heterodera glycines
  Genomic contig location: Contig_ID=SeqID_6787; Location=1716..2563; Strand=-
  SCN-specific regions: Sequence locations=1-205,227-733,765-814,836-848
atgttcagaatgatcattgacgcatggccagccttctcaccagcgtccatcacaatggacttcgaacaagcggcgatggacgctgcggccgcagtgtttccgggcgctcagcttcgagggtgcctttttcatttagtgcacaacatgcacaagcgcctgatttccgaaggacttcaaaatgtaagtttcagtcccaaaaaaaaagaaatagtctcccgtttagcgctatcgaagtgaccccattttcgcagaaacggctcgtatgatcaccgcgctcgcatttgtgccaattcagcatttgactggtgcaattactgcgctgaacgatgttgtgggacaagaactcgaccaaattctggggtggtaagttttgtcggaatttgccaatcatatggttattaataggttcctcatcaactacaccggtgttcctttgccaaatgggacccgcacacgtccgcgttttccggtgaattattggaatgtgcatgaacggactgtcaacgaagagcagcgaacaaacaacatcgcggaagcagcgcaccgtcgactccaaacaatcttcagctgtcgctacccgtcaatttggcgattcatcgatgtccttcgaatggatcagcgtgcgcgtgacgccgattatgtgagctgcgtgaacggtgaagaaccaccgatgaagaaaaagaagttccgaaacgcggacaagcgcattttgaatattatcgaaaattttgatgcccaaaatattgttgaatttctccggggaatttcaaataattgtgttatggacccgtaatttgattttgttcatttgagattgttaattttttatgaaaaaggattttaataaa

SEQ ID NO: 62912 - DNA, 436 bp, Heterodera glycines
  Genomic contig location: Contig_ID=SeqID_6788; Location=584..1019; Strand=-
  SCN-specific regions: Sequence locations=1-30,53-228,250-436
atgaacaacaattttgtcaaaatggtcaccgaacacacacacgaagcaaacattgccaatgtgaaagcaaaaaaaattgtcacggggatcaagaggcgtgcggcggaatgcatggaattgccttcacaactccgtgcaaatgcaatggtcaacgtttcaacaccggtgcttgctcagttaccaagtgccaatggaattaagaaggtaacgaaaagcagacacatactattattttttgctttgtttttagattgtcaaacgtgtacgccatgaaattgtagctgcaccagcggctccaaattctattcacgacctccaaattggccaagcatatcaggtgtacaagcgcagtgaaggagttgaggaggagcaatacctactatctgactctggcgttttttcacttaatgccgacaattcccaacatcggtattaa

SEQ ID NO: 62913 - DNA, 213 bp, Heterodera glycines
  Genomic contig location: Contig_ID=SeqID_32613; Location=249..461; Strand=-
  SCN-specific regions: Sequence locations=1-28,50-213
acacatcgatcagtgaacattcactcatcaaaggaacagcagcaagagcgcaggtgacagactcagcggaagcaccgcttaaccatccgttcagccgcttcacctccccccccattcggttcagacttcaacaatgacgaggtgtagtgtgttcgtgcttacccttttgggcgtcggaatggcccactctctgctgatgagcggcggttcgga

SEQ ID NO: 62914 - DNA, 143 bp, Heterodera glycines
  Genomic contig location: Contig_ID=SeqID_32613; Location=1232..1374; Strand=-
  SCN-specific regions: Sequence locations=1-143
gtggaattgaaaatggaagaattgtgagaaaaacacagtaaaacattagaaatttataaataatcaccgatatgattttggtctattaaaaattttcatttttttgtctaattattaattgtttaaagataaattaggacttc

SEQ ID NO: 62915 - DNA, 972 bp, Heterodera glycines
  Genomic contig location: Contig_ID=SeqID_32614; Location=142..1113; Strand=-
  SCN-specific regions: Sequence locations=1-115,137-318,340-580,602 -853,875-972
atgggactcgcgaagcaactgaaacaagagcttaaatattatcataatttggccttgatccgaaattggaacttttggagttcctctgccacaattactttgggtgaaaagcaaaaataataataataataataatttgatttttatttttaatatgtttttttcaggtgtcaccccgaccaaaatcaattctgtccgcgccgaaaagggcttcaataataaaataaacccagtagatatagcgaatgcacaaattttccatgtccacatgctcctgtgagttatgcgataaattcatgaagaatctgttagcgatttttagaaaaaataaattgattttttcaatctgagtaatcaatagagcccgggttttactgcagcatttgctgaattttttgctaactttgggcatgaaaataagcatgaaaaacgcatttctagcagggtttgaggcttcctaagtcatcagaagggcgaaaaccacttctctgacgaatattcagataaaagtgtctagagtaagtaaaaaaatgtatgataacagaaaaaaataaatatatgaataaaataagagtcaaatgggtagtagtgaaagaagacattgatattaggattggagaagaaggcagaaaacttgaaaagtccgatctctatcaaggaaattttggtattaaaaaatacacccttaagaatcgaccaaacaaaaaattttcgcataagtcatgtacattttttcatgcatattttgccattttttgttcatattttcagattttttgcatattttgccatttttcgtcaaatattttccgatttgaatatcccttaagaaaaattttgattatgccaaaaattaaatccaaatctgaatgaatgggcgagtgagtcaagagtgaacttcactgccgaaaaacttgaaaaatttttgatttgaaattacaaaaacaatcgataaaatttatgaggaataaa

SEQ ID NO: 62916 - DNA, 1133 bp, Heterodera glycines
  Genomic contig location: Contig_ID=SeqID_862; Location=446..1578; Strand=-
  SCN-specific regions: Sequence locations=1-30,52-553,575-590,612 -833,863-977,1000-1106,1130-1133
atgattgaagacttagcacttgaagtacgcgaaatgaaaggtaataggaatttttcttaggaaatcatcagtaaaataaattcttttaaaattttgagggttcatttaaaggttgaggtaattgtgttgtttttttaaccctaatctccctattccatttcagattgctggcgacactgagcgaatgaacggaattggtgggactcgagtggttctattacagaaaacaggcctaacacccctcttcccattttcaggactgccggccgaccattggaaggcaagcgactggcgacggaggacattggaccggcaccacgacgcgatgaaaattggcgaagcacaagctggagacaattcacggggacgacattcacacgcggcggacgaggaggaagcgctacaaagtgctacaattgtggacgaacgggacacgtggcatgtcatgccaagaaagacggcgagatgaccggagttgattgagaggaataagagatagtggaaaagggggctttggcaaggaaaatgagtgtgttttgatttgggggtctaggttttaaattaaaataatttcgctaatttacataggtaattaaaaatgtcaaaatttcatgcttcataggcaaaatttgggaattgttttttcatgtgcttcggcagtaaaaatgaaaaaagtcctgatcagttctcgcagacaaaggttgatggctgggcactttgccagtgatgcctgagtcttgaactggatcagggacgatccaatgtacggttgggagtgagtgacacgaagcataaaattttgatttaaaattggaaaaagggcatgaaaattagcaaaattatttttgaaataattttctttgcttaggcaaattttgaagcgaaaatcttggtaagagaccagggacggtctttggtaaggttggaggtgtaaggtagatccgggttttcttgtttgccggccgaagccctatgaatttcacattctcacatttatttcatttcgcatttaatttcccttttgcttattgtcgcccctttcccgacgataattgatcgatcacatttcatttttcacgtgtatttaatgttcgccatttcaagcgaagtatcttcagtctctccggaataaa

SEQ ID NO: 62917 - DNA, 259 bp, Heterodera glycines
  Genomic contig location: Contig_ID=SeqID_862; Location=276..534; Strand=+
  SCN-specific regions: Sequence locations=1-87,110-174,198-259
agtagcgcggccgtgcgcggtggacgtgctggcgttgggactgggcaatttgggagggcagatggggaacattgggaaggaactcataaactcccgaaggaagggccccatgggatgatcaagcccagggatcccatcccgcctttgatggacacactgggataagtggctttattccggagagactgaagatacttcgcttgaaatggcgaacattaaatacacgtgaaaaatgaaatgtgatcgatcaattatcgtc

SEQ ID NO: 62918 - DNA, 54 bp, Heterodera glycines
  Genomic contig location: Contig_ID=SeqID_864; Location=4918..4971; Strand=-
  SCN-specific regions: Sequence locations=1-54
aagcactcgtgttgtgctcttcaagattctccaataaagcactcgtgttgtgct

SEQ ID NO: 62919 - DNA, 597 bp, Heterodera glycines
  Genomic contig location: Contig_ID=SeqID_865; Location=229..825; Strand=+
  SCN-specific regions: Sequence locations=1-571
cggtgttattcgccctgcttaaattccctacacctccgttttgctgttgctgtaatgccgccgcatctcgagctcgttgtctggtgaatggtggagagcggttaatcatctttacaacacgagttttattggagaatcttgaagagcacaacacgagtgctttattggagaatcttgaagagcacaacacgagtgctttattggagaatcttgaagagcacaacacgagtgctttattggagaatcttgaagagcacaacacgagtgctttattggagaatcttgaagagcacaacacgagtgctttataattcggtgggatgcatgaagattccaacacgaggacagaaaaatgataatgtcgatatatgataatgtcgataaaatccaaaatccaacacgaggattatcgcaacttatatggccgacgtaaaagttttccgtttagtcgtcactaagcaagccaaccttttgttgcaggagcgccaagttgaaaaaaaaaattgttttgcgtccacttttcccaattcaaatgtcaaaacggtgattgtcaacagttctctgcgatctgtctttacaaaacaaaacaaaacacaa

SEQ ID NO: 62920 - DNA, 960 bp, Heterodera glycines
  Genomic contig location: Contig_ID=SeqID_866; Location=2487..3446; Strand=-
  SCN-specific regions: Sequence locations=1-318,340-960
atgtgcaactcaatccgaagtgagacggccattcccgaattggccgaactgaacaaccgcccgggacattcgttctgcatgcgcagcaccagcttctggcagaacgcctgcggactcccaaccgcctcttgcctcttttacaggtgggcggcggtaccgacaacgacgacggtgttcgaggagttcacttgcctcgaatgggacatgcagatcagcgcatgggttgagctggaaacaaacagtggccaagtcgacacacatcggctgactctacacccgggagtctccgagcagtggggaaatatgaccatcgcggtcgtccccacctccctcccgccaatgccggcactttcggcacatttcattacggacggacgcgctgtggcaatggggaaatcactcccctcggatttgcattgcttggatgaagagatggcacgaagcttcgataagtgccagctttcgatcggcgcatgccaaaaatgtgcgccggatcacgacaacggcaccatccattgtcattgccgcgacttggacgtgggccgagtcatgaacaacccagagcaacgactcccgctcgacgtcgcccgtttgcatctccataacaacggcccgaacgtccgaggcgaatttcagtactcacctgtgcaggtgcatgtccagctcaacggcctcgaattgatcagcgagtacagcaacaccaagtgttgggtgacttcacccaaactcagcggatgctatcgatgcgtttcgggcgcaactttcaacgcaacatgccgaaccgactacggcaccgccttggccaagatcaaatgcgcggacggcacgctttttgcctttcactgcggcggaaacgaatctacgacgaccgaggcaattccgttcgaccgggccgaggtgttcgccgagtgcaaaagtgaagtgccccggcggggcacagacacacatatccgaacgtaa

SEQ ID NO: 62921 - DNA, 1414 bp, Heterodera glycines
  Genomic contig location: Contig_ID=SeqID_6790; Location=627..2040; Strand=+
  SCN-specific regions: Sequence locations=1-481,503-708,735-766,788 -868,932-940,962-971,1003-1414
atgaccattgtgcgtccgatggtcggcgttgacactggtgaatactcttgcgttgcgcagaacgaatttggccgtgaccgatgcgcctgcaaaagcatttgcggaggtacaaataaccgaaattccaccgagattttatccccaggcccaaaaaacccagaaattgtattccattttcagatgcccctgaacgcccttcaaggcccgacgttgagctttcctcagacaccgaagtgtacgtctgttgggaagcgcccgaacgcctgccggtgaccctcgaaggcgtcatgtacaggtcggtgtagatggcatacgaatttgggaattaaaagaattttctattttttctagtttaaaccttttagactcgaatgccgcccggcgggggaaaaggatgccttttcggcatggactgtggtcagcaattgcgtggaggacgaagcagccgttgtaaagcatttgataccgtaagagaaacaaacttaaaattataggaaaaatttgtatgaaggaaaacatcattatattttatctgggagctaattaggcctaattccaaaatgttctatccacattatcaacattctctcattttcagaatgggcgtctaccaattccgcgtgacggcacacaatgaattcggctggggcaccccttcgatcacttcgcgcattattcgcacccatccgaggggtaattaaaggaaacaattaaattaatttaaaataattaaaggtatcccgaaactgaatttggatgtgctcaggcgggaaggacgacaatttacagtggtgacaatgccacagaaaacggggcgcaggggagccggcctaacgcaaatagcggaaggttgccccaggggaaagggtttaattagtaaatttacttatttatttatattttaacatttaatttgtatttaaatttaattgactcccaaaattaaaacagattttatggaggaacaacgtgaggaagagggaagggaagaagaggaagaaaatgatgagcaaatgggggatgaaagggcggaagagaaaaatgggaacgaaaacaacggaaatggcaaacaacgaacggtgccattgaacaccacggaggacccgctgaagcgctttcaggtcaacaaaagccactaattgaacttaattaatgttaattaacaccctttcaaattcgactcccccccccccccaaatttcagttggaatcggaattgttccgcggtcagttcagcgtcatccgttacgcggttgactccaaaacgggcgcccattgcaccgtcaaaatccgagcggcgcccagccacgggtcgctgatgttcgcggcgccagcggaacgcatgcgagccgcgcgcgctgagtacgaaacgctggcggaatgccaaagtgcgaatgtggcacgccttatagcg

SEQ ID NO: 62922 - DNA, 1347 bp, Heterodera glycines
  misc_feature (4)..(4): n is a, c, g, or t
  Genomic contig location: Contig_ID=SeqID_6791; Location=1..1347; Strand=+
  SCN-specific regions: Sequence locations=1-43,122-378,401-551,574 -599,622-1347
ttantcgagcaaaccaaaggcacattagtagctcttatatctttaaaaaaagaaacaaacaaataaaattgatcaaattaaaactacaaaaataccgaaatataaatgaaaataaaataaatcaaatgttgaattcacaggtgattataaattgtaaatgtggcacagaaatttcctactcagaactcattgcttttagtaaatccctgaattcctttgccttattaatttgcaccgctaaaactggaaggttattccagtttcttactatcctatggaaaaaattattttgagttttggccgtgtggcgctttactcgtaaaagtaaaggcctcctgggcctttctgagaaaaaaaaattttgctcagcatcgaggctggtgaaccctttgattattttaaaagctgttgttaaatcattgatttttcttctttcttccaatttgtgtaaatcagtgattttaagtctttccatatattttttgtacacaaatccacattttcgaaaagcttttcttgtgaaaaatttttgtacccgttcaatttaatcgtattaatataattaattaatttgtttcgttaattggcttcggctgccactttctttcccttccctttttcggttgacttcggccgcgcccgtcgcttgggctcccgggaaggcgccgccggcgatggccaactgatcgccgaatggacggcgcccgaattgcttttggcacgtcaaaacaatggcacaaaagcaaagatcactgatgagggtgagctctaaaaaagggtgagaataattggctcagtttatggcgctttttaggcccaaacggcgcgggcaattggccaaacgcacagacggacatgtggggcctgggactgtgcacattttgcctgtaacgaattggccattcatcaaaaatttatgacccaaaaaatgcgcacaattcacagattggccggctttcatcccttcgcggacgacgacgacacggagcaggacatccgccgccaggtgcttgagcaccgctgtgacccgaatctgatccctgtgcaagcgtcggaagaagcacttcgcttcgtcacgtgggcactgaaaaaggacccgcggtaaaaacggatgagaggcaaaaaaacagattttgacgggtgtgccagagatttaaaaaaaggtttgtttagtaggcgaatgcgccctgacgaagcgttggaccaccgtttcctcgcctccgacgcggcgatggttcgtcgtcgggagaacattcgctacgcgtcccatcggctcatgcggacggtccaacggcgagttcggcagcaaacgcaattcgcgaggaacggaggagcggcacgggacgg

SEQ ID NO: 62923 - DNA, 1659 bp, Heterodera glycines
  Genomic contig location: Contig_ID=SeqID_6792; Location=149..1807; Strand=+
  SCN-specific regions: Sequence locations=1-161,187-536,558-1022,1045 -1059,1093-1408,1430-1637
atggacattccaactttcgctgccaacacaacagcagaaccagcagaaccgaacgaaatgagtacggtagttgaaggtggagcagagaaaacggtaattaaaggcggaacatcccccccccccttcccgcgccccattcccgcgccccacgccttaagaaatgcaaaatctaaaaatttccaaaaaatcgggttttatgaatttttacgtaaattaaaattccatatgttttaagcaaatgttctctaattatgatttataaatgatcattatccaaattcaaccttccctcccccaattatcagttgttcctcccctgttggtccgtgcttttgtgtgccgttgtgattgcttcagttgccgccgtcagcattttcctcaacacttttctagttttcgtcaccgtccaaactaagtgtgtctttggtatatcttttgtgccaaatttccccaatcaaaaggcaattgcatggctctgccaacgcacttttggcactcaattcgttgtttgaagtgttccatgcgttcggccacttcgtctttctttgcgtcgccctctccgatcggtgctctcccctctcctaccgtaactcctaccgttcgttgaccctttcgcttttcggccttttcgccgcttctttttctatgcttttctccggcttcgatcgcctcttttgcgtgtttttcccattaaagtcaatatttttcatctgttttattgctttatacctttttttagttactttcgcttctcccatttttggcgctgttttgccattgctttttccctttgtgccattccgagcgttgcgctgaccgtcgcattttggcgccggggcgaagaagtgccaacgatggaagtgaccggaagcattggcgacttgatcatcaatgttctgttaaattatattgagttttaaaatggttttgtgttcatttttaagggtggctttgccttcgctttgtacagcttcgcaaagttcgcctgcacaagtggaactgtccttttgtacgctttcctcgccatttggctgtggcacaaacgcagtgcgccgttactttatttttttactaaattaatttattaaatttgacttttttgaagatgaccaaattcagtcgatggcacattgtgccaaccgtcgcattttcgtctctctgttcgtcatcgttctgttcaatgtcggcggttattttctgatcgccattttctaccttttttggcctccttcggcccatccctcggcacagttttggctcgttcgaatggttctgtcaattccggccaatttgagcggtgcgtccaacgtgccgattcttttcatgacgaggcgagaaagagacaaaatgccatccctattcttactaaattttctataaatttcacagctcggactaccgaaaggcattcaaaaagcaatgccaaaatattttgcttttactcggccaaaatcgaaacagtgccattcatccgacgaccgtttttgtgttgccacagaggcaaaaccgacaaagacagcgacagaatgtgtttgccagcagaagatgatcaacggaggaaaagaagcagtggccaaaactgatcagagaatggatcagcagctgagggcaaaaagtgatcaaaaatttatcgaatcgatttgggataaataaaaaata

SEQ ID NO: 62924 - DNA, 964 bp, Heterodera glycines
  Genomic contig location: Contig_ID=SeqID_6792; Location=1966..2929; Strand=-
  SCN-specific regions: Sequence locations=1-260,313-317,341-362,393 -476,499-964
atggactttgtggcgcttcgattgtcgcgactttccgaatcattgcacagtgaaaacatgtgcattttgtgtaggaaatggaaaaacaattaattaattgcaattttctaattgaggccgaagtgaacaaattacggccgaccgccaaaaacattgtcaacgaaacgcacgcccgctgggattcgtatttgaagcgcgagaacaccgatacatttctgcccagcaaattgacgaaaagtgtttgtgagtaaaagttgggcaattaaataaataaattaattaattaattttaaataattaaaaaaatatatataattacaattggcattttaaaaaataacattctcacgtttaaaattgtcaatttttagtattttttaaaatttatttttcagttttcaatcataaattgggcgtcgcaattttccgcgacgaaattccgccaaaattcgaaagtgtcgaaaatctctccggcggcattttccaattgtattttcacggcacttcgggtcgtcaaagtgcggtgaccgtgcaaaaactcgacgctctgttcatccaaactgtccgctcgctgttcggaatgccctctccaattgcgtgccatgtccacggattgttctaccgatgcgaaattaacccgggcaatcgccgtgatccgatatcctatggcaacttgttggacttgccattcatggccaaatttgaggtgccattatgtgcgaggaactttctgatcagacagaattggcaaaaatcctttaaactttgataatcagagtgatcatttaagatttggattgatgacgtcgtgaacagacgactgatagagcagtcgttcatcgctgaattcaagaatcagatcaaagcggaggaaattcccatccgattgcccttccgattcaatccgaacaatttgcgggcgaagaaaattgtcaaaagtgtggaatcactcagcaaaaaatga

SEQ ID NO: 62925 - DNA, 429 bp, Heterodera glycines
  Genomic contig location: Contig_ID=SeqID_32623; Location=563..991; Strand=-
  SCN-specific regions: Sequence locations=1-34,57-111,149-429
atgtatattcaaaaaacatttgaagcgtcaaacctaaatgagttggaaaagcgtaacaatgcgatagtaatatcaagaatgaaaaaaattaaaaaatgcacaaacgcagtgaaaattattttataatttaaaagaatacaatataatagggtgttattacagaagagtgaattttaaaaaatttgcgtataactaaatttatagcaagacacgcacgtcgatctgaaccgtgcaattggccaaccgctcgcttcagttcttcgaagtttggcacaaattgcttattcaaaaatgcaaaaaaatatagtcgataaattaaataaacaaataaaactttaaaactaaaatttgaaaaacaatcatttctaaaattgaactgattatagattactagataaataagtctagagcataagacaaatcaataaa

SEQ ID NO: 62926 - DNA, 661 bp, Heterodera glycines
  Genomic contig location: Contig_ID=SeqID_32624; Location=409..1069; Strand=+
  SCN-specific regions: Sequence locations=1-661
aaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacggagaattaaagtacaggctatagggaagctattcccgaaggattcggtctccccataaatctgggcgcatcggttcggggggactgccccgaaaac

SEQ ID NO: 62927 - DNA, 923 bp, Heterodera glycines
  Genomic contig location: Contig_ID=SeqID_32627; Location=155..1077; Strand=+
  SCN-specific regions: Sequence locations=1-53,88-161,311-321,344 -521,547-923
  Gene Ontology: Mol. function=structural constituent of cytoskeleton; Cellular component=neurofilament; Biological process=eye photoreceptor cell development
cggattcggactcgggaaggccgagaacagaattggaaagtgaaccaattgttggacaagatgaggaggaagaaggggaggaagaaaatcatctttttgttgaggatgacgagaaagaagaggaggattatccggaagaaccggaagaactgcgagcattgagaagagaagcggaagaggaagaagaagaacgagagcaagagagagaagaggaagaagcgagagcggaagagggaggagaaagtagtcaaaagaaggaggaaggaaaagatgaagaggaagagagaaaaagaggaaaaggagaggaggagcaaaacggtgaagcaacggaagaagagaaaggcgaccaaaacgaaatggaaggccgaactgaactcgatgaagctgctgctgatcaggacgggacaaacatggaaattgatgccaaaaaagaagccttagttgaacatgaacaacatggcaaagaaaagaaaactgaacgggtcgcagatgaacatggcaaacttgggcatgaaaaatcggcacaccagcagcaacagcagaaacccttcatgttgggcgtgtattcggacgaattggaacagattctttacggcgaggcagctgtcaaaattcagagtgcatggcgagggtatgccgttttggattttcggcatgactaatgactagggcatccaattatgcatatttttttcctggactgtgggaggcctgaaacgcacgaaaaacatgtttttagcttggtttgaagcttctaggatgactttccatatgcatatttgtgcatatttcgcgatttatgtgcatatttggacagtttttcaacaaaacctctattaaaacggtcccctctattaaagccgccattttggcctctaatgaccgaaaaattttcaaaaatgtcattttttgggtattttcta

SEQ ID NO: 62928 - DNA, 1685 bp, Heterodera glycines
  Genomic contig location: Contig_ID=SeqID_32628; Location=103..1787; Strand=+
  SCN-specific regions: Sequence locations=1-59,209-215,237-379,418 -589,622-725,747-756,790-1024,1055-1333,1363-1685
atgacacaaatggttgcaaacattgtgactgtgatcttggcggctctgaagtcagtgcctttaattgaaaattaaaaaaaattattattaattaatcattaaaaatgaaaaagtttattattattattataaaaataaattccgaattttttttttattaataacttaaaaattcaccgcattttttattttatttattaaatattttgtcaatccctttttgaagagtacccattgcactgctgaagaaggcaaatgcaagtgcaaaccgaactttgaaggacgccgctgcaatataaccaccagtggttattattgcccaaccatcgacgaattcactttcgaggcaaaaaaaagcaaaacacaaaaacaaatttccaattttatttaattaaattgatatttaaatatattttagggttgcttcccgaccgaccctccgggagagaaaaaaagtcgggaaacggggagggaaattctcacaaaaatttgtcggggatggctgtaagaacttaaaaaaagatatcggagaacgacagcaacagtgttggggaataatttcataaaaagttgaaaaaaagagaaccagaaataatttatttaataaatttctaatattatgtatgattaaagctttggtaacaacctaccgtgatcttgagtcgagagtttcggtcttgactcgaaaaaagtctcgaattttcagtctcgattcccgagacttttccaaaccacaatatttggctgttttcagccaattaaataatttaaaaaaaacaaattatttttccaattttttatttgttttcatcttcttcaaaaaaaaacatttgcaggcagaatccatcctgtcaataccaaacaatgccgaaagtgtggtgcgcgaatcttcgccggatcggcctcggacatggacgggcgaaggttttgttcgagtgcgcgagaacacccacctaacatttgtggtaaaaaatgaaatttaacaacaaacaaataaaaataactgatttaaaacaaactttgcaaaatatttaagtattttttaaatttaatacaaattagcacaattcccaattaaaaggtggacggtctgacgaaaagtggccactacaatttggttgtgcgctatgagattgcgccagacggtgttttttctaattttttacttatccaaattataattcaaatccgattcatgttttcagacccaatcggatgggaggacctcaaaatcaccattgtccggcccggagaaccgagccctgacagtatttgtgccaatgccttgccatcggacgatttcatatcggctaggtgtatacaaaaaatacacattttaattttaaaaaattctttttttaagactgcctcctcggtcccgcttttacgaaattcaccctgccatttgtctggaatccgacactcgctacgaaatacggctttactttggcgagaaacggcgcaacgcaccggacattcgtgcgcatgtaaattttataacctcgactatttatccaccaacttgtccagggtcaataatttttatccaaaaattcttttggattcgtatattaattacagactgcgaagaattgttcgatatatttttcgaccattcctccacttttagacattggatagtcccaaaaagatttttggccacttcattcctctggatcggataa

SEQ ID NO: 62929 - DNA, 832 bp, Heterodera glycines
  Genomic contig location: Contig_ID=SeqID_32631; Location=1..832; Strand=-
  SCN-specific regions: Sequence locations=1-130,152-215,237-388,410 -565,605-832
aattgaagttgttggggaagtttcaagtgtgacgttctgttcagaggagtcacaatgcggcttgaactttcagtggcagacaccgaagcgccgagcatcatgggattggattggatcatccctttcgagcgtgccacccaacagccagtttcaaggcttccttcccgaaggtgtttcaacctggcttcggacattgtgtgaagacgaacgccacgctgcattttaagcaaaaggtgaagccagtgttctgcctgtcgctgcggatgacagccaaagtggaatcggagccacgatcagccatgtgtttccaaacggagtggagtgcgtcatcgagcacgccagccgaacgctcacccccgcggaacgaaattacgcccaaattgaacgagaagcgttgtctttgatcttcgctgttcaaaaattcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaattttaaatctgcaaattttggacatgccgacgttttgtctcgactgatttctgagcaccggacagactaagaagtcattgttgcccacacatcggacaacgacgtggacagcactgaagaagtcgaatatgctcttcttgtcaacttggagcggctgccggtcgatgcaaaagaagtgagcgaattgacgatttcggacgatttgttgcaggagatggcacaattcgtacgttccgggtggccaaacaaatgccca

SEQ ID NO: 62930 - DNA, 997 bp, Heterodera glycines
  Genomic contig location: Contig_ID=SeqID_6793; Location=710..1706; Strand=+
  SCN-specific regions: Sequence locations=1-37,59-196,220-267,303 -649,671-877,910-929,959-997
atgcttttaagtcccaccgtgaggcgggacagttccaaaatttgtaccacattttactgtggaaagtccaagtaccttaattggacaattacttgtcaacgaacacagtcgcctttggcctcttatggaacagaaaagggtggatatcagatggggtgcgtcccttcctaaaaatttctcttttcgtctaaccatcccccctttttgtgcactatttcattttcaaaattgggaacattttttgtttgtttttttgaaactaaaatgtaaaaaatttaataattatttttgatttaaataatgcttctgtttcgaatcttttcgctttaagtaattaaattgtaaaaatcaaaactaaaaattttcctctgaagttttgaacttggctttaccctgcttttaagtcccgccgtgaggcaggacagttccaaaatttgtacaacacattttactgtggaaagtccaagtaccttaaggactacagaagagccaatgccgcagtcacctttggacagttattaaaaagaaataaggaaatattcgatggggtgcgatcagggctggccgtgatcacggatcacggctcacggatcacggaaatcacggggtttttggggtgccgtgatctcggatcacgggtcacggattttttcaaattttccgtgattttaatccgtgattggcatctaatcaaaattttcagaaaattttcccaaccctctaagaattttttctaaaattttcccgactttcagtatcttttggggtgttcagatcgtcatgaaggactgagcatgttggtccaaaagattttttccgcatcaaaagttagcttacaaattagaggaaatttctctacataaatagatttttggttaaatttaagaaaaatttgaaaaatttggaaaaggtcgccgcaaaaaaagcggtttatatgttttggtttctttaaaacattttttgggaatttttcccgcgattaaattccgttttttaa

SEQ ID NO: 62931 - DNA, 757 bp, Heterodera glycines
  Genomic contig location: Contig_ID=SeqID_32636; Location=203..959; Strand=-
  SCN-specific regions: Sequence locations=1-757
attaattgaaaatattgatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattgatttgtattccggttattcttccgtaaaaaatgacgccaccttagccattaggcctagaaaaaagagctctttcgaatggtaccttcaaatcaaaaaacgactgtcaggaagctgagctacagaaaaaaattccaagccaaggccaagccactatagcagtatagtgacaaaaattaattgaaaatattgatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgacaaaaattaattgaaaatattgatttgtattccggttattcttccgtaaaaaatgacgccaccttagccattaggcctagaaaaaagagctctttcgaatggtaccttcaaatcaaaaaacgactgtcaggaagctgagctacagaaaaaaattccaagccaaggccaagccactatagcagtatagtgaca

SEQ ID NO: 62932 - DNA, 630 bp, Heterodera glycines
  misc_feature (119)..(119): n is a, c, g, or t
  Genomic contig location: Contig_ID=SeqID_32638; Location=645..1274; Strand=-
  SCN-specific regions: Sequence locations=1-125,148-335,359-585,610-630
atggcaaatgtgaaaaaatggttggtgagataaataagaaggaataaaaggagaatagtaaaatattgaaaatattattcgaagaaaatctctgaattttgtttatttttttggggggnggggggaaattatttattattattattagggcttccttttttaggcacaaaaatcgcgaaataggcacctaaaaaggcataaaagaatcgaaaattaggcattaaataggcacaaaattttttttattaacgctttttaggtagcaaatcacgcaaaaacttaataaaaaaaaaacttaattttgcttatatttcaattgttttagttttgtcgaataaggcattttttaaattaattgaattttggggatcaatttttgtgaatatttttttcaattcttaggatgtatttggctctactgcattttacgcgtccaatcgacttttacgcgtccaatcacagtttgcgcgtccaatcgacttttacgcgtccaatcaaaagtttacgcgtccaatcgacttttacgcgtccaatcaaaattttcctaaatcgaacatccttttgacataaggtaccaaccattgcaaaaaataatttaaatattaaaaacgtaacaccaagagaaataaa

SEQ ID NO: 62933 - DNA, 481 bp, Heterodera glycines
  Genomic contig location: Contig_ID=SeqID_32639; Location=143..623; Strand=-
  SCN-specific regions: Sequence locations=1-17,40-58,80-104,276 -443,480-481
atgattagttagtacaaatagttaaaactagataaaagtttttctcgaatgataacccaaaaagaattaaaaatcaaaactcatgaattaaattacagaaaatggaagaggaacagaaagtggaagagaaagtagaagagtaacagaaagtggaaaaggaacagaaaatggaagaggaacagaaaatggaatagaaagtggaagaggaacagaaagtggaataggaaaagaaaatggaagaggaacagaaaatggaagagaaagtggaagaagaacagaaggcgtcgttttggtgtgaattttgttgatcactggtcactaagataatccgatcagcgactaaataacgagatatttaaaatttaatcaatagccctcatggagatcaatattttaaaatggattataccaactttgtcattaatatgttagataaaactatgctttttgaaagtgatgaaatatttggtataaaaataaa

SEQ ID NO: 62934 - DNA, 58 bp, Heterodera glycines
  Genomic contig location: Contig_ID=SeqID_32640; Location=972..1029; Strand=-
  SCN-specific regions: Sequence locations=36-58
tgccctaccgggaccgggacctgagcttttcaaaatccgggaccgggaaccgggaccg

SEQ ID NO: 62935 - DNA, 986 bp, Heterodera glycines
  Genomic contig location: Contig_ID=SeqID_32641; Location=35..1020; Strand=+
  SCN-specific regions: Sequence locations=1-76,101-169,191-342,366 -390,412-487,509-598,620-840,875-941,963-986
atggacttgactcggccggcgactgttctcggaactatcgcaacgatgagaatgttcttcaggtagtgtaaattaattgtcgtttgcttctgttctgctccgtccgttcattgccgcttaaggactcttctcgtgtcatctcatggaccagaaaaagtgccactgttgttgctgctgctaataatgatgacaatcaaaacaacatttctacctcctctccgccggtcgactgacctcgtaaaacgaccaaaaaaaaccacaatattttccttaacataggaaaatttttaattttccgtactactcaattgttttaaaaaaggtactttgcctagtttacaggacagatttcatatacatttttagattcatatatgtgttttagaaattaatgaaaataagtttttaaggggttttcgaggtcgctgctgatcacgaatatagcacccatttttgtcaatttcgaacccctgacccaaactcgaacaaaaattaaattaaaaaatttgtatggatgatatcctcattggcatctcacccatgagggtaaccttggtacaggaagcataaaattcgaaaattgtatggatggtatcctcatgggcatcttgcctatgagggtattattgctacaggaagcctatcaattctttgtccctgtacagctcatgtactgatctgagcccggatttctgatcagcgaccccaaaaacctcataaaacttattttcattaatttatataatacatttatagaatcttttcaagtgtacaaatggtccagtggttaatcttcctgcttgttttctacttctttcccttggttcaatccctcttctgtaattaaatatattttattttatctttttatatacttatgggtttcatatagacaaaatatgattcttcatatacttttttaagtgccgataggcgccgccgggaaaattttttgaaattttggctatatgtttaacagattttca

SEQ ID NO: 62936 - DNA, 1711 bp, Heterodera glycines
  Genomic contig location: Contig_ID=SeqID_6795; Location=590..2300; Strand=-
  SCN-specific regions: Sequence locations=1-395,417-553,578-593,617 -726,748-754,777-1080,1160-1256,1290-1290,1312-1606,1629-1674,1697 -1711
atgccccgcggggatgcggcgactttcgccgaacggcgcgcacaattggcccatgtcaaggacaaacgaaccgacagggaaaattgctggaaaagggtggggggacagcagcataaactgatgacaacaacaatttggcaatatgtagtatcaacaaaaacaatgatgggacagaagaagaagcaaaggatgacaacaacaaatgtccttaaaactaatgactgatgagtagggctatacattgtatggattaacatattttttctgtgcatatgctatgaagaaaggggctcaaaaatagcatttctatgttaaaattttttgatttggtgaaggtttttggtgcatataaagcatattttgggggttttcgaaatgcatatttggccatttttgggcttttagagcatattttggtcatttttggcaaatttcataagaaaaatgcgaaaaagcgaaaatacaccccctaaggatcgactttttttttgcgaaataaaaaaaatacacccttaaaaatcgaaaaatttttaacttttgtaagaacttttggaaaaaaatttatttatataaaaatgtacctttgttttagcatataataaaaattttaaaatttggaaattcaatatttttgcaattgtctaaaaaatgctccttagcccttgttttttttgttttcaaagtcaattcttaatttatacatacacaattgttggcatttttttcagagttaaaagccatctttggcagttttaaggcatattttgcatatttgggcattttcagggtttttagggcatatttgggggatttttagttgcatgttttatgcgcatgttttgtatttttagtgcatacaacttcgaaccctaatccagtggggttaatcccgatttcggattgggatcgtgcaaaatcccgtgccgggctctagttttccaatcacatttaatttgcttctgtacacaattttcaataaattaattaccccctcaagaacatatgaagagcgtgtgcagctaagagcatacaagtgagttttgcttgcatgcaattttctggcgataatttggaaatggcaaattataaattttttttttcattttttaaataaaattaataaatattttaaatatgatgaatattaaacattaaaattgtatgtaattctaacaaatccctggggtaatcggcacggcactgctggcgggaatgccatacttttaaaaaaatatattgacgatctttgcatgcacttaatattataataataaattcaaaaattttttgtttacaaaattcaaagattttcaaaaaattgcgataatttttttttctgacacagaaaagctttccattttttttgttgttgaaaaaattgtcaattttctaggttatcattatcgtttttttcaaatttgttaggcgtgcatggtacgccctgtgggcatttgtgttcgccatcgccctgctcatttggctgctcattgtgtgcgcggtgtgccattggagtcggcggcacaacggccgatcagcgtacgacaacattgttgttaatcgctgatctgagattaaattgatattattttgagcactaattattactatttggattaaatatttttcctccaactttatgtgtatttacgtaaatatttcggcattttttttatagcaatttttgtaaatatttttgccggatttaaataaa

SEQ ID NO: 62937 - DNA, 2302 bp, Heterodera glycines
  Genomic contig location: Contig_ID=SeqID_6796; Location=37..2338; Strand=-
  SCN-specific regions: Sequence locations=1-648,671-871,895-987,1018 -1421,1448-1515,1552-1754,1780-2023,2046-2059,2081-2108,2132-2302
atggcattttcggattttgctctcgagacttggccaatttgccaaacagagttcattcccgtcgctcaacaacagcgaacgcgctttcaggtggacgcgtatgtggccagcggcgtgccagcctttgtgtactccttcgactttgtgccacggggcgacgtggtggaagaggaccggcgcttctacccaatgtttggcgagcgtccagtgggcgtgcggcgccgggaccggaagcgaaaaggtgagccggccacaaaaatgcttttgtaagcaattcaactataattagtggcaaatcgaacagtttaccggttacagcagagtttacttaccgtaaccgggttgggtttttaacgaaaaaaggggaaatgacgaattttcgttttttaccatccacctcaaggccatgaacaggacgcgttccacggattggaccatgcgttcatcttcaccgaaggctactcctccaacttccatctcgagccgtacacacgacgggacaaggcaatgtcgcgactgtaagtgtactatatattatttgtctacttacagtaagaaagcgtccaattcaaatcaatcatattaataatattggcaatcgattgatcagggtaaaaaaatattaacaatcagcagtaaaaattttagaacatttttataagaaaatttcaagaaaaattttttttagattttttctgcgattttttttcaaaattttatggaacctttcgatttttgggcctacttttgaattaaaaaaataacaacaaaggacacgtagaattgcattaaataagcatattaatgtcacaatttaagcaaaaaacttttttttttttgaaactttcttttaaaaaaattctaagatttgaaattttaatttgggtttaattacaaaaaccctcaccattaatcaaattttttgtttttctaaaatttacgaaattggaaaacattttttcaagttgtatttctttctaatgaatgaaatataattaattaattaatttttattttctatttcaaaatttgtgaatatttttgcctttttttttggttttagccaatttaatgaatttgaaagtttgtccatccttttaggttttttgagtaatatttcaatgccaatatattccactgatcaattgatggacatattttttgtgatagttcagatcaacactgacctaatcatcaaaatctgtcttcagtttgactcggatgatcacaaattttgtggccaccggagatccgtcgacgaggaatttcagttggccaccatgcggcaacggcacaatgcaacacgcttcactgaacatgccgccaaagtgtgtgttgtgccaaaaattgtgaacaacaaaatccgagaccacctccaaaaaaaaaccccgatcatttatcattagggaagggatttaatatgttttcccctatattttccatgctctaaatattcgcagttttttttggcacatatttgcggttctgctaaatattttgagttttttgagaaagataaaaatttattataaaaaaatttaaaaaaaaaaacctaaataagcgaatttttttaaatatataagaaattgttgtactttacatatttttcaaggttctcaaataatttttgttccataatttgtatctctcgttttttgtacagttacgatatagcaaattacagaatggtctggatgttgatccttaaaaaaatttttcaaaaaaaacattaagaaattgcccctaaaaatcgggtttttaaaaatacttttaaaaagagctgttttgtttcatagttttgctctttttttttaccatatcccctttttttgtacggttactgtattatagccagcaaattacagaatgaaccggggaccgatccatttcccgacgccgaccttttggaatgacgaggtgcgaatgctgtccaagtatcagatggctgacccaagcggacgtgccaacgagcaggcggtcaacgaattgtaagcagcggttgttgtgtgatattagcgacattaattaaccaattaattaattggctatgagatagtccctgcctcgaaatttttccaaaattttaagccttccaggggtaaattcgcagaaaaattgttgaaattttatcatttgttgttatacgtagggttcgaaattgtgtgactttgcatattttttctgcgcatatgcaatgaagaaaggggctcaaaaatagagcatttctacgttaaaatttttttgatttggtgaaggtttttagtgcatataaaagcatattttgggggttttcgagaataaa

SEQ ID NO: 62938 - DNA, 955 bp, Heterodera glycines
  Genomic contig location: Contig_ID=SeqID_32645; Location=189..1143; Strand=+
  SCN-specific regions: Sequence locations=1-280,302-846,869-955
  Gene Ontology: Biological process=DNA replication
atgcgccaattgctggcaaacattttgatttttggagcaacagagaattgtcttatcgacggcgcactgctttgggataaatttctccatcatatgtgtgatttgcgttgtaccgatgccgaacgtcctgcgagaattgaccgtgcattggtccttttagaaaaacttttagtaagactaggaaaacagtgtaaagattatggactcccaacccctactatttcaattatgaataatccccagctcgggcttgatgaatttttctttccacaacacgctaatgatgatgatgcagatgatattgacacaagctcctatgagcgtggaaaattgaatattgagcagcaaaaattttttgatttggtaaagactgcatttattgactcacgatgttcaagattgttttatttgtatggtgacggtggaaccggaaaaacatatttgcttaattatatcctatatcacttgcgaagaattggcgctaaaattattcccaccgcttccactggtatggcggccacccgtttttatgctggtggcaccactgttcattctgcctttaagtttggaataaatgtcgaacctggaaagttaccttccattccatttgatagtttctttggtcgaagaataattgagtgtgatataataattattgacgaaatgacaatgttagagaggaccgttttggaaaatattgatgctctttgtcgtcttatgtgtttgcaaaaacagcacttaccctttggtggaaaatgcgtgattatttccggtgattggaagcagtcactccccgttgtaaccgattcttatggaagccctgcacaagtatccgcatgtatccaatcctctccactttattctctttttacgaaatttaaattgactcagagcatgagagttaacccaaaagagattgaatttctaaagtggcttgatgatgttggaaagagga

SEQ ID NO: 62939 - DNA, 618 bp, Heterodera glycines
  Genomic contig location: Contig_ID=SeqID_32647; Location=333..950; Strand=-
  SCN-specific regions: Sequence locations=1-3,27-86,109-128,151 -372,403-513,536-618
atgcttattttgtcattttttattctttttgccttctttggcttcgctgatggttagtcaaatttagggtcattactagggatgcgacttttagtgacgaaaaattccaaaataattaactaaaatagtgagtaaaaatgccaaaatattgaagaaatagtgacgaagtagccaaaatagtgatttctagtgaccgatagtgacatcagaatcgaaaatttttaacgcagaaatgcgttttttgagctcctttcttcaaatcaagtgagcaaaaaatttagttaaaacctaaaaatcgcatccctagtcattacatataattaattggttttttagttgtcggaacaccgatacaagaacaaggtgattaagttaaataaaaaaaatttaaaataataatatctaggtaataattctttttgtaccgacaattttgaatcaaattgtttagaatttgcaaaattggtggcaaagcgtgccgatgggtttgatgagtgcttgttggcagcagggtaattcaaattataagcattttgatcattttatttcagtgctacaaattgtgctggtcgtttagcttgttgtgaaaagtatggacaacaaagttgcatttgttga

SEQ ID NO: 62940 - DNA, 490 bp, Heterodera glycines
  misc_feature (320)..(322): n is a, c, g, or t
  misc_feature (327)..(327): n is a, c, g, or t
  Genomic contig location: Contig_ID=SeqID_32650; Location=6..495; Strand=-
  SCN-specific regions: Sequence locations=1-44,78-211,245-378,412-490
tttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgccccgnnnttttnccagaattttttgcctggaggaacacagttcttcacacttaccacaccagcattatttttttttaattatttttttcattttatcacccaacgttctagactgatcagaagctcaccaaaatttgcagggaaactgctgagaacccttcaaatgcttataaat

SEQ ID NO: 62941 - DNA, 604 bp, Heterodera glycines
  Genomic contig location: Contig_ID=SeqID_32650; Location=629..1232; Strand=-
  SCN-specific regions: Sequence locations=1-309,346-473,499-604
cagtgtccgtttggggtactcaaacaattatggggagcaaaaatccaaggtaaaaataaagtagaggtatatcgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcatggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaat

SEQ ID NO: 62942 - DNA, 516 bp, Heterodera glycines
  Genomic contig location: Contig_ID=SeqID_6798; Location=998..1513; Strand=-
  SCN-specific regions: Sequence locations=1-75,97-268,291-370,392-516
atgaaaaaggaattaataacggttgcggaaaacaaggacatttttgacaaaatcaaatttaggactaaatttgaggttcgtttcatcagtgaatgtctaataaatttcattgcctctgttattttttaggtttctcacgcagtttggaacccgaaaatcagtcttattgcgcttgggtcacttgacggagaagtggtggttaagcgttacttgtggaagaccgggtggaaggtgctgcttttgaattcgattagtttaaacttttccctttttaattttagagaaatttttctcgtgatgattctgccaaacactttgattttcttggcgatgtttcgtccgttccgtcgtcctccaagtcgaaggatcagttgttgtttctgtgttggtcccccgatggccaagtgcttctcactgttttccaaagtggcttactctattatttggacactcaaactggcaacactcttttcgttaaaaaattgtcatattcgcctttttgcgttgaatggctaa

SEQ ID NO: 62943 - DNA, 1333 bp, Heterodera glycines
  Genomic contig location: Contig_ID=SeqID_6799; Location=1..1333; Strand=-
  SCN-specific regions: Sequence locations=1-549,571-1333
  Gene Ontology: Cellular component=integral to membrane; Biological process=skeletal development
atttgaagtgatcttcaataatacatagtcattgcatttaatcccaattatacaaatttagaaaatcatcgaaagatggcattgagagctgttcaatgtcaaattgtttcaatttcagcaaatgtttagcgccaaaatcgatgaaaatttacgtgtacagtgatggatcgccggtgagacggagtccgttgttcacaaaaatgttgaaagtgatcaaagaaagtcatttttacacggagagggcggaggaggcgtgtttatttgtgttgagtgcggatacaacggacagagaccgaataaggcaagcaaacggcgaatgacaacgcgaaaagccattttaagtgagtattaccagcaaattgggacggagcacaccaaaacggagttatgggacgacggacggaatcatttggtgtttaatttatactttggcactttccccgactacgctaacaccgacttgggcttcgactttggcaaggcaatggtcgcgtgggcgagttcgaatttgcaggtccaattgataaatgggtttatggatgtaattattgttggtttataacaggattatacgaataattttgaaaatttagaattttcgaccaaatttcgacctttcgttcccattatttaacaatgagcacccgtttaaggacgacaaaccatgggtaattttctttatttatttttgtttctttgtaatttgccattgcttttcctttcgccataaattctttcatttttagcatttccaaccgcattttcccaaccatgacaaatacttggccagttttaaaggaaaacgatatgtgtacggagttgggtcgaagacgcgcaacattttgcaccatttgaacgataaccgatccattgttattgccaccacttgcaagcacaacacggactggaagaagttcgaggacgaacgttgtgaagttgacaatgcgaattatggcaggtgaaaaggacggaacggggaaaggaaatcgaattccaacgccaaattgaaggtgggactatgagcagttgatggcgaattccaccttctgtttgattccacggggtcgtcggctcggctcttttcggtttgtgcttttgctttgtcctacaaacaaatgactgtcccaattgaatgacagaaaatccaaactcgtccatccattcagtttcctcgaggcacttcgttctgtttgtattccggtgattctttccgatgaatgggtgttgccattttcggaagtgattaattggtccgaagctgtcatttttcgggaaagaaacgtaccgccctaattgtaagtcgcttattaaagccattaaaagcggattttgc

SEQ ID NO: 62944 - DNA, 248 bp, Heterodera glycines; identical to SEQ ID NO: 62670
  Genomic contig location: Contig_ID=SeqID_6799; Location=1613..1860; Strand=-
  SCN-specific regions: Sequence locations=1-124,148-167,194-248

SEQ ID NO: 62945 - DNA, 875 bp, Heterodera glycines
  Genomic contig location: Contig_ID=SeqID_6799; Location=2735..3609; Strand=-
  SCN-specific regions: Sequence locations=1-25,47-875
atggacgtcggcccaatgattgaagaattggagaaattggcctatttttgtcgatcgcaagaaaagtgggcattcggaaatggtttagggtggaaaaagagcaaaattcagagactctgtgatgaaccatttgcgggaaatgcccgttggccatttcgcgctgcgactgtccggcacgaggcgaaggtcaacggcattcgatcattgccatttaaaaagtgaattatcgaaatttccttttgcagatttttggcactgagtatccgagtggaaagggatgagaagaatcagaaagggattgcccactatttggtgcttcgcaatgagcatgggtttcgcatcaaagtgagcagtcattgtttgcttcctttgtgccacttttcccttggcaatttgatcattcattcctcagggttccaagcgttacttccaatcgcttcccatgctgatcacccaccactcagtgatcactgaccaattgccgtgccgtcttttgctgtccgattggcgttggacacggtgaatagatgaactgctctttgatggcccataattaaccaattatttgttcctttaggggagacgcaaatcaacgacgacgtcaaagcagcgggggaagcactttggcagtgctaagggcaaccgaagagaacaaagcggggaatccgagcggaggaggggggcaaaggcaaaacgcagcggacggaacgacggtgaaacggcaaattgaagaaaaagcgatttaaacacacattcagatccgctggcggaaggatgcgctttattcgatggcacggcgacaaaacggcggacatcgccgaacaaactcatccactctcatctcttcccaatcctctacatttttatcagcttaa

SEQ ID NO: 62946 - DNA, 462 bp, Heterodera glycines
  Genomic contig location: Contig_ID=SeqID_6800; Location=287..748; Strand=-
  SCN-specific regions: Sequence locations=1-24,46-462
atgcaaatttcgctgggaaagtgtttttcgcatttgcaggcgcctccgccgctgctcagccattctctgcgcaaggtttgctgcgccgtgtgccgcgtccgcaccgcgcagttggcgtacatcactcgcgagcagcactcgcaccacgggcaccatgtgccgggccgcaagttgtgccacgtgttccgcgtcagcacaccgctcaatgcacagcacatccaaacggcacttgcggacgcattccgacagcaaaaacagtgggaagaagccgcgggggaggcggacgaaatggccaactgtcacatggagaacgggaaaaatgatgacgggaccacgacgatgctaatggcatggcatcccccggacaatgccatggcaatttgccggggaaaagccaatttcgggtcggatggagggacagcagcagcgggagagcacctgctgaacactccgactaagcgg

SEQ ID NO: 62947 - DNA, 99 bp, Heterodera glycines
  misc_feature (23)..(24): n is a, c, g, or t
  misc_feature (66)..(66): n is a, c, g, or t
  Genomic contig location: Contig_ID=SeqID_6800; Location=1..99; Strand=-
  SCN-specific regions: Sequence locations=1-99
gtcgctatttcaacgaattttcnngcggcggttcctcaacgccaaagaagcaatttgctgatgcgngaacgtcatgcagtccagcaaagaaatgatgac

SEQ ID NO: 62948 - DNA, 78 bp, Heterodera glycines
  Genomic contig location: Contig_ID=SeqID_32654; Location=252..329; Strand=-
  SCN-specific regions: Sequence locations=1-78
tggcaacatggaaaatcctactcagaactcattgcttttagtaaacccctgaattcctttgccttattaatttgcacc

SEQ ID NO: 62949 - DNA, 716 bp, Heterodera glycines
  Genomic contig location: Contig_ID=SeqID_32657; Location=202..917; Strand=-
  SCN-specific regions: Sequence locations=1-508,531-658,688-716
atgccacgaatttctgccttcaattcatggagatccgaacggatgtccttttcaagattgcggacatccgaacagagatcttggttggctctcagtaagaaaccaccaaaagtaagcatagtgccaacaacagtgaccgtcatagtaacagtaacgtagacaatgttcgctaaaagcaaaaatttaagatcataaaattttaagtggaaagtcaaaataaaaattcgattttcggccagaattcaaaatccgcttttctaaattggggtcaatggcgccaaacggccctattcaataaaaggacataaatttgttagtaaagaagttacagaaaactttacagcggctgtccattcaaacaaaggtttcgcaaattccaaagccaaagcccgaatttgaataagaagtcaaaactcaattttcgtattttatattttggcttagtttgagtttttgattttgtttgaattcgggtaaagggtttggaattggtcgaaatgtatgctatgttcatgttcagtgatcccggaaacccttcaaaaaatgtttttttcatttaaaaaaattgaaaaatgtgggagttcgggttcaaggcccgaattagccaaaaaggaggcctgcttcttactcggcaccccaaaacactcataaaaaggtgtttttggcatttacagaaaagtttcaaaacagatgattgtccaaccaaaaacaataaa

SEQ ID NO: 62950 - DNA, 3673 bp, Heterodera glycines
  Genomic contig location: Contig_ID=SeqID_6802; Location=720..4392; Strand=+
  SCN-specific regions: Sequence locations=1-3673
atgtacgtagacaacctcctcatcgagtgcgagacggaagaggaggccatcgacaagtcgtccaacgccaaacaaatcctcaaagacgccgacatgaacctccgggagttcctcagccactccccaaacgtcatgggacgactccccgaggacgaccgactcgacaaaacgccggccaaagttctgggactgacctgggacaccccccgcgactgcatcacctttagtctcccaaaggacacagacatcactgctacacggcgttcagtattgagcatcatcgccagcacgttcgaccctcttggactagtcgggccatgtcttctgcccgccaaacggctcttccaacgcctgtggggagaaggaaccgcctgggacacacccctccccgagaccgaggcggaaacttggattcaaaccctgtccctatggcaaaaccaaacgattgtggtcccgcggcattccattctcggcaagcaaagccgcctgcaactccacgtgttttgcgacgcttccgaacacacctttgccgctgccgtctacatccgaagcgagactgctgacaactcccaagcgaacctgattttcgccaaaaaccgcctccggccacgaacagcaaaccagcgcttcaccatccctcggctcgaactcctcgcaatcctcgtcggcatccgcgccatgcgtttcgccgagaaagagctccgccgtccgatcgaagagcgacatttatggtccgactcccaaattgccctctcatgggtgaagtccgaggagcccaaagctcaattcgaacagcgacgactcgtcgagattcggcaaggaccaaccaccaccttccatttcgtcagaaccgaccaaaatcccgctgacatagcgacgagaggctgtactccggccgagctctgcactcgtcaaatgtggtggaaagggccggagtggctcacgaacctggaaaccgaatggccggacgagctaacgttcgcaacaccagccagccatccctctcccgattttccgtgtgaagactcggaacccaagactctcttggtcaagcaaagccaggtgccccctcccctcgttgacccagcacgcttcagcacaatgctcaccctcctcggaacgaccattctcatcctccaattcatcgggcgctgtcgtccaaaatggctcacgattggcgcctccaccatcccaaagagcggccccccgactggagatgccttccgagccgctcggaccttcctcatccgacaagaccaacaccgcttactcaacggctacgataagcaccctaccgttgtcaacgaggacggcctgttgtgcctcaaaacccgactcatatacgcaaccggcccgcccactctcgcctcgccagtcctcctcgatcggcattcccccctgacccggctaatagtgcaggaagtgcatgccgatctcaagcacgccggcgtcgattggaccctcaccgagtttttgggccgttactggatgccacaagcccggcgaaccattcgcggaatcctccaaggctgcccgtcctgtaggagaatcacggcacccccctttgcgaggccaaccatgccccccctgccccccatgcgcgtcaaaccggctaatccttttgagttcgtcggtctcgactttgccgggcccacctcctctcgactaagcgacggatcgctcaccaagacctacttggtcatcatcacctgtttcgttacccgagcagtgtatctagaggccaccaccgatctgtcagccccaagcttcatcaatgttttacgacgattcatcagccgtcgcggccgaccaaagcgaattctgagtgacaacgccccgacattcgtccaaacgagcaaggccctcgacatcctgaccggcccttcggccaaaaccgaccccgtcacatttgccgcgcgccgaggcatccagtgggacttcattcccgcctacagtccatggatgggagcttgctatgagcgcctgatcggcctcgtcaaatcgtgtatcaaaagaacaatcggccggcggattcttgactacgacgatctgagtgccttccttgccgaaattgaagctagcgtcaacagccgcccgatcacatgggtatcagatcaaccggattcatcgaaagcccttactccgaaagacctcgtccaacccggcctcctcaacgacctggacatcgccgactctgatcttgactacgacgggggcatctccggtcccgagcgtctcgctgcactgtggaaggcttaccgggaagccgccgatcacttttggctcaaatggagtcacgagtacctcatcgccatcagagaacgcgccggatggacccacaaaggcccccgcctacgggcccccaccgcaccccgcgtaggccaagtagtcattatcgaagaggacttccgccctcggaacttatggcccatgggggtcgtcgccgccctaaatggttcccctccgaatgtgcgaagcgttcaacttcgactgccgaacggacaaaccatcactcgaccaatcagccgtctttgccccttagagacagaaaatgaggctccggaaccagccctggacgcgaccaaatcgacccccaccaatcaaagaagcagagacttcaaaaccgccgaagtgtcggtacccgaaatgccgactgttccggcaccttccggagaaccgatggtccatccccaccatcacggcatgcttacgcggcgaaaagcgcggctcctcggaattgctcccaacaccacaatggccttcgccttcctcgtcaccttcctctgggcccaagtttccccgacccaaggcctctggccattcccggaccaccctaagccgtcccccggatctgattgtgtcgggaatcacctcaactgcaccctaagaggggtcaaaatctcgtcgaactccgccgtccagaaggtgaccatctgctgcttcgactcatgcttcgaccgattggcggccgctacgattgattatgagctgtcctctgaccttcttgtcaatgaatatagttgctccaccacctacagtctctcgtcaactcgcaactgtatcgacgagatcacttgcccggccctagatgagtgtgaactcatcgattgtgcactttgcgtcgaacaactcgtcaattggcggtgtaacccccggctcgccctcgctctgtttctgctcaccggatcgttgataagctgtctgatcggctgggtcgtctgcttctgctcctcggttcggctcgggatcaaactcggctatcggatcatcgcactactcctctcgtggccgctacgggtagcattcttcatcgccggccatccgtggacgcgagaagatcgagaacgcgtggcggaacggctcgagactggagtccaaagggttcggcgacagacccgacagagaattcagaacgcacgtcaacacggcaagcgggctcagcgagctgccattcgcctcatcggcatccttctcgccactcctgccctcctttgtaacacggagaccatctcagtcatcactcagactgagtcgtgcctcaagggaccctccgggctcacctgccgaatcaacaccgccaccaccctgactttgcttccggccgggcaaacgagtgcgctactcctccgaaactccagggaaacaccctcgggaccgtcaaactacgcctaca

SEQ ID NO: 62951 - DNA, 515 bp, Heterodera glycines
  Genomic contig location: Contig_ID=SeqID_32665; Location=290..804; Strand=-
  SCN-specific regions: Sequence locations=1-144,206-261,292-340,398 -415,437-515
ccaaatgtaaaactgttcaatgcaacggcggtggaagatttgattataaaacggcaacaacaatcagaaacaggcgaaggccctggcaaaagcgtacaacaacagcaacacgttgtcggcgtggtcaccaattggttgacaaacaatttaattaattaaatataaaaattttaaaaattaaaatttatatttatttatattttttgttttatgatcacactaatttgattatggagcactatttatatggaaatacaatagaaaataaataaaattttttgatttttttatgtattttgcacaggatttttgagagtttataaaagattaaattcttcacaatattataaattaataaataatatttacacataattttgaaattaattaaaaaaatgttttgtgaaaaatcccgttaaaaataaataaaataattgaccaaatattaaaggactctggtggcactgaatcatcacagtcaaagttgtatggacccaagcacagtgatggccaaa

SEQ ID NO: 62952 - DNA, 329 bp, Heterodera glycines
  Genomic contig location: Contig_ID=SeqID_32666; Location=194..522; Strand=+
  SCN-specific regions: Sequence locations=1-261,284-329
ccaggactcaaatgtcccgctgaggccaaaaattttttctatttcttgaaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgggcttttaaactctacaataagtctgctggccaccctgcgctcaggtcaaaccctaatgagttattcggctggtactgaagtgggaaaaaa

SEQ ID NO: 62953 - DNA, 162 bp, Heterodera glycines
  Genomic contig location: Contig_ID=SeqID_32669; Location=198..359; Strand=+
  SCN-specific regions: Sequence locations=1-49,71-91,113-162
atggattcatttgatcataaaacggcactcccaacgaatggaccttctgctgctgatcagcagcaccagcctccggcagaggaggtgaagccatcggcagaagaagcagcagcgaatgcttctcccccgtcgccctcttcctccgcggacagtgccaaaggc

SEQ ID NO: 62954 - DNA, 224 bp, Heterodera glycines
  Genomic contig location: Contig_ID=SeqID_32671; Location=77..300; Strand=+
  SCN-specific regions: Sequence locations=1-224
atgcctgccaacgatggtgttctggcggagagcaatgtaacaaaaacggatgatgattgtggagggagcgacgaggacattcaaattgtggagacggatgaacagcggaaaactcacgacgaattaagacaaaaggctgccgaagcactgatccgtgaggcgaaaaggtcggcgaaaggagaaaaatcgaatattagaaaaaattcggcgctagttaaaagaag

SEQ ID NO: 62955 - DNA, 2021 bp, Heterodera glycines
  Genomic contig location: Contig_ID=SeqID_6804; Location=390..2410; Strand=+
  SCN-specific regions: Sequence locations=1-175,198-341,363-1125,1147 -1871,1897-2021
atgtgcgggtttagcgctgctgtgccggataagggcgaccagcgactgttcatttcgggaccaggagtttggtattggcaggtgagcattttccaaacatcgccgacaaaggcattcgaatttcgagagtcgccttttcagtctcgacttgtgaagagtttggaaactcggcaatgagttgatattctcttttaattgtcgatcgttttcatttccattctttcccatttcgaatgatcagttaacttatcaaagtttgggtttttcattgttttctcttttaggggtctgtcttctcccaaaacattcaaaatttgactgatcggccgggcaccgccgatggacccgcgcacaccgaccaccaccaattgggtaaattaagcaagacccaaatgaattagacttggtcgcactttcgttaggctattcaaccgccaccggcgattttgacggggacggaaaggacgacattgtggtgggagtgccaaggggaaacgaactgatcggaatggtggggagaggaaagtggggaaagtgatcgggaaatggaaatggttgaggtgtccatttacacacgagagctgaagccaattgtgaacataaccgaacgggacggacagaggtgggcatggggcagaagaaattgttaaacggatgagccgagagtgggcgagaccaacttggcattacctcttcaggggccaatacttcggcggttcggtggccgttttggatttgaacaacgacggactgcacgatttggtggtcggctcgccgctgttcatcgattggatgagcaacgactcgaaaacgcaggagcgaaagccgcgttacgacgtcggacggatcagcgtttacctgcaaacggaaggggtcagttgggttggaaaattgagagctgatcagagcaagagcaaagaaacgaatgatgacaattccatcgttttgcgattgagttgaccgcttagccaaattcaaattcaaattgcagcacggcttccgtgacccggtgcacatcctcggccacgaccaatggggccgttttggccacgccgttgccgctgccggggacctaaacggagatggatttcagggtaaaaaatcactgtcatttacaacacaaacttttatttcactttttggatctgttggtgggtgcaccatttgacggcgaagatgggcgcggcactgtctttgttttccatggctccgaaaatggcatccgggaacggcacgctcagcgcattttggcacgggacattggcagggacatgctcaccttcgggtgggcattggccgggggcagagacgtggacggcaacggatacccgggtcagtggggctgaacacttatttggatggacgggttcgaattcagacattgccatcggcgcccctcacagtaaccaagtcgcccttttgcgcgcccgacccgtcgcccaagtgcagggatcgatcagaacgacgaggaaagtgagcaacagaaaaggtcaaaggaaacatacccaatccccccctactattaagagcatcaatttggacgacaaacagtgcgtgacggagttcggtcggatggcatggtccgtcaagggccattagcacttggcaattgcttttccctccagtgaacgtctccgcgtttgtctgaaactgttggtcggcaaattggcacaaaacgccgtcgaaatgcacgtgcaaatccaattggactcgcgcacaaagggcgattcgccccgggcctttttctcccgcaaggatttggacaaaaagcgcggcgtccgcgtcgacccctcgggcagccgcgagcagccgtcgggtgttgagcaaattgtcacactgagcaaagggcgcgaggtgccgaaagcattgggcattatttaaaaacattttttggatggaatgcttctcaatttgaaatttggggggggggggggggtgacagtttggattaatcaattgaatttgatttattcattttgccaggtctgcgagacttacgacgtttacgtgccggtccgtga

SEQ ID NO: 62956 - DNA, 869 bp, Heterodera glycines
  Genomic contig location: Contig_ID=SeqID_6807; Location=464..1332; Strand=+
  SCN-specific regions: Sequence locations=1-138,161-292,316-791,813-869
  Gene Ontology: Mol. function=SH3/SH2 adaptor protein activity
gcatccgcaaagtgtgccagggaagactgtggcaaaacggtgtaccctttggaggaattgaaatgcctggacaaggtgaacagctctttttctatgaacgtatttttgttttttcaaatcctttttattttttgacaatttaggtatggcacaagacctgctttaaatgcacaggttaattactaataatctaaaaaaataatgtgaattgtgtcaattttaatttctaaaatcattttggggttttcagactgcggcatgattttgtccatgaaaagctacaaaggctacgacaaaaagccatactgccaagctcattaccccaaaacggttccgtcggccgtggccgcaacgccggagatggaacaagcgaagcgaaacacggcctatcagagtcaggtggaggagggaaaggaaaatggcggagaagggaagagacggagcgaattttaggtgaaataccacgaggcgtatgagaagcaaatgaaaggcacgaagatggaagtggtgagaaagttatgaagaaacgaaccatcaataaagttcaaaaacatccgtcaccaaaagacaaagtttcgaatttaaattgcaaaattcgaaaagtaatccattaaagctttatgataatatttggtctgtgccttaggacatacgaaatataaaaaatacgaaaacgataaccatttactaattgtaatgcttacgttaggccgatgacccggaaacgatgcgacacaaagccaacatggtaaaccaatccttggcccattaccacggcgaactgcagaagaaagagaaacaggactcacagagggacaccactgcaggttcagccccgtctggtcagtcaatcctttgcagtcctaaca

SEQ ID NO: 62957 - DNA, 267 bp, Heterodera glycines
  Genomic contig location: Contig_ID=SeqID_32678; Location=143..409; Strand=-
  SCN-specific regions: Sequence locations=1-229,260-267
atgattaatgatgaaaatgccaataacaacgccaataacagcgctgagcaaagcggtgagaacgccgccgcttccgagctgagaagacgaagaaatgcgacgcggtcagaagagtcggctgaggagcaaagggagacagcgaacaccgcaagagatgcagcaaatggggcacgagacggccatggagaagtggcagacgcagaccaactgagcgaacctgaacaggaggaggaacatcaacaacaacaacaaagtatgaacaagtga

SEQ ID NO: 62958 - DNA, 208 bp, Heterodera glycines
  Genomic contig location: Contig_ID=SeqID_32680; Location=109..316; Strand=-
  SCN-specific regions: Sequence locations=1-63,108-208
atggtgggggctgagcatgaaaattcggcaccaccaattgatgatgaacagcacaaattggttgaggaggaggaggaggaagataacaatgatgaggatgaggatgacaataatcagcaaccaaatggtagtgatcaggcgctgaatcggccatcgccgactgatcgtcgccacccgaccgcccaatcgccccaaaaagatagcgcaa

SEQ ID NO: 62959 - DNA, 277 bp, Heterodera glycines
  Genomic contig location: Contig_ID=SeqID_32681; Location=1..277; Strand=+
  SCN-specific regions: Sequence locations=1-79,101-169,191-277
attttcatttgctcctttttcaggtcccatttattttgccacccaaaataacttcaaagtgccgtttttcttttgcttttccatttgccatttcccttctctctcctcagattcaactcacttcgctttgcatggcaatcgcattgagcggaacggtggcattggcctgttttttctgtccaaaagtttacatttgtctgttccaaccatacaaaaatgtgcgaacgcggagttcagcagtgggaaaattggtcaatcagcaaatgcgatttataag

SEQ ID NO: 62960 - DNA, 1005 bp, Heterodera glycines
  Genomic contig location: Contig_ID=SeqID_6808; Location=767..1771; Strand=-
  SCN-specific regions: Sequence locations=1-89,111-291,314-338,360-1005
  Gene Ontology: Mol. function=small conductance calcium-activated potassium channel activity; Cellular component=integral to membrane; Biological process=potassium ion transport
cttaggctacggcgacgtcgtcccgacgagttattgcggccgtttcctgtcaattaccacgggcattgtggtcattattgccccctattcccctatgatttgttaattgccttcctccaatgtttccttctttttagggtgccggcgtttcctccgcattaattgcagtaatttcgcgcaaattggagctgtctcgggcggaaaagcatgtgaacaactttatgtaacagcaaacgaaactctttttcgaagaaaatgaaatcgaaactttcagggccgactcaaaactgacaaatgcgtgcaaaaatgccgctgcttcagtccttcaacacacttggcaagaaaagaggaaaaaagagcgaatgggggggggggaaagccaaaggaattggaaaagcattgattgttggcactgattgactgatcactaactgatcacaggttcatccacaaataccagcagagaaatggacaaaagggagacgaactcagactgagacagcaccagagaaagtgaggaacagagaaagcacaatcggagaataaattactaattaatccgatcaaaaaggtttctgaatgccatcaacgaattccgacgaataaaatgggaccaaaggaagttgcaggacaaaggcaatttgttgttggacgtgggaaaggttacgaaggaaacggagagaatttggaggaaaatgcaattttaccattcatttagttgcacgcggaaatgcacgaaacattatgggaaatgcaccgaactcaagagaccttcgctggaatgatcggtgagtgccaaaaaaggcatggcattgccaattcggcacttattttgaaatgggcattcaaaaaaaattgcttatttttctgaaattgtttaaagggtggcatatgccccccccccatggaaatgtgcctgacaaagagtccaattgtccatttccaaatggcattctcttcttagaagtgctcaccaaacgcattgttgaacttcaaaacatcgtc

SEQ ID NO: 62961 - DNA, 1285 bp, Heterodera glycines
  Genomic contig location: Contig_ID=SeqID_6809; Location=70..1354; Strand=-
  SCN-specific regions: Sequence locations=1-234,256-866,888-1068,1091 -1115,1137-1285
atgccatttgtcagcttcatcgaaatcgccgtctgtgccgtgtgtccgttccccggtcagtcagtcggcatttgtccgtttgtctgtcccccccccccctcccaatttgtttcttttttttacccgccgctctcaggcagtggaaacatttcatggccttatatccatgaacgaagaattgccaccaaaactgtgcctttggacgtccttttgtccgtgccaatgtttctccgggcttatttgctttgtcgcttcatggtcctccattcccgacaatttcaggtagttttttggcttactttgaactgatctgataaacccacaggacgcggcaactcggtcaattgcaggtcgcttaattaccccccccccctggcaaattgtccaccctttcgcagcactcaatcggatttcaatggacttccgattcgtcataaaaacgatgatggccgaccatccaatgacagtgctcgtaagtttgcatctaaaaacatacatccgccgaccatttgccattcattcgattgtcccgtcattttcgatcattttcaccgcttcctattgggtttgcatgtcttggatgttcactcaatgcgaacggtacaacgaaggctatacgggcagcacggagatggtctactccaactcattttggttcattatggtaagtaattatggtaattgccattctttttgttttgtccctttaggtcaccttcatgtccatcggtacccttccaatccgtcccaatcattcgattagcaattcccccgccacttaggctacggcgacgtcgtcccgacgagttattgcggccgtttcctgtcaattaccacgggcattgtggtcattattgccccctattcccctatgatttgttaattgccttcctccaatgtttccttctttttagggtgccggcgtttcctccgcattaattgcagtaatttcgcgcaaattggagctgtctcgggcggaaaagcatgtgaacaactttatgtaacagcaaacaaaactcttttttgaagaaaatgaaatcgaaactttcagggccgactcaaaactgacaaatgcgtgcaaaaatgccgctgcttcagtccttcaacacacttggcaagaaaagaggaaaaaagagcgaatgggggggaagccaaaggaattggaaaagcattgattgttggcactgattgactgatcactaactgatcacaggttcatccacaaataccagcagagaaatggacaaaagggagacgaactcagactgagacagcaccagagaaa

SEQ ID NO: 62962 - DNA, 246 bp, Heterodera glycines
  Genomic contig location: Contig_ID=SeqID_32682; Location=201..446; Strand=-
  SCN-specific regions: Sequence locations=1-70
  Gene Ontology: Mol. function=protein binding; Cellular component =axoneme; Biological process=N-linked glycosylation
atggaagaaaaaaaaattgaaggttgtagtataaaaagaaaatggaatgaggtgaaaaagataacggaagagaaagaggagaaaaggaaaaaggaggaagagaaaaagaaaacagaagatgagaaaaagaaagcggaagagaaagaggagaaaaggaaaaaggaggaagagaaaaagaaggaggaaccgaaaaagaaaaagaaagcggaagaagaaaaaaagaaaacggaagaagaaaaaaagaag

SEQ ID NO: 62963 - DNA, 235 bp, Heterodera glycines
  Genomic contig location: Contig_ID=SeqID_32687; Location=212..446; Strand=+
  SCN-specific regions: Sequence locations=1-235
atgttgcatcggcgctcatcagactcgcggcttaacgcctttctgcgaggggaattagcgtaagtttggtatttccaacagtaactatttgatactgtaaaaataatatccctttatttttaatccaggcccagcattgtgcccgacttttgtgacacttcagtgtttaagacaattgttgagcgggcgagaaaggtgtgcgaaatttacctgtcataaggctattagcaaaata

SEQ ID NO: 62964 - DNA, 135 bp, Heterodera glycines
  Genomic contig location: Contig_ID=SeqID_32687; Location=655..789; Strand=+
  SCN-specific regions: Sequence locations=1-135
atgatttataaagcatgtgctatgtttaaggcgccaaagaagccgcacaatgacaggttcagcaatttgagaacactacaacaactcaagggaatcatgtccaaaaagaagcagctttctaataagccaagttcg

SEQ ID NO: 62965 - DNA, 664 bp, Heterodera glycines
  Genomic contig location: Contig_ID=SeqID_6811; Location=84..747; Strand=-
  SCN-specific regions: Sequence locations=1-67,119-162,189-210,232 -321,358-456,478-664
atgcgtaccattctcttcatggccatggtttgcttggtgatggctgtcctaatggaaatgggtgggcaaaaatattttattaaaattataaaaaatatatttttatttatttattttagcaaattcaaaggctgtcaaaaaagacaataaaaaggtaaaaacaattttaaaaatttattaaaatattactttaaagcagcagtggcggcatctccagcaaaaggaaaagcatcgccaaaaggatttgaaacagcaaaaaaagcaaagccagctaagaaagtcaaagcggcaaaagcaataaagggagagccgaaaacaggcaattaattaattgaataattaattaattatttaatttagtcaaaagtcgcaattgccaaaacagcgcaagtgaaagacaaaaagtcacagggtaaaaacatttaaattttatcacatcaatttctgcacaaattaatccctttaaaatgtctatttagccaagccaatggttgtaaaagcagtgccgcaccatcaaacggatatgatgaatgagaaaggtatgctgaaagtgtcaatcgattcatatcttaatttccccaaaattatgggaaatttaggttgcaaaaatataattcgaaaaagaaatttagaaattgaattttatttccaatttttaattaaa

SEQ ID NO: 62966 - DNA, 380 bp, Heterodera glycines
  Genomic contig location: Contig_ID=SeqID_6812; Location=255..634; Strand=+
  SCN-specific regions: Sequence locations=1-163,186-380
atggcaaacgcatatatctggatgattttctgcgtcatctacggcattacgtcttcatctttaccatcccgatcattttcaccggggtgtacggcatggtttttcaacccacactttggctacatcaatgacccaaaaagagaaattgtacgaaataaattgcaaaaaataaataaattttaattgcaataatttacttttacagtatcgcaacaaattgcttactatctacgattataccatggctactgtactcacttcatatatctgtcctttttgcttgttctcctcatcaaaattggctttaaatacagcaaagttggcttatcgaatccaaccaatggcttacaaacggcgaaaatggtaattaagaaatttaa

SEQ ID NO: 62967 - DNA, 350 bp, Heterodera glycines
  Genomic contig location: Contig_ID=SeqID_6812; Location=1380..1729; Strand=-
  SCN-specific regions: Sequence locations=1-142,178-350
atgcaaagaaatgaaaatccaatccaacaattaattaaatgtatggtgtgtcgccgaaccctcgggtaagaaattctagtggaacgcctgggaggacaggtcggtaaaattgttcggttcggggaccctattggggaatggcaataatttaaacaaaaattttttaaattaattaatgacttaagtttgggcagtggcgggccttaaatataattttatagggaccagcaaaattggttactcagatttatgaacatatttggggatcccgacctttagggacccaacaaccgggcagtagatggtaatatcttcagcatttttgagttttgcttaattttaaaaataaa

SEQ ID NO: 62968 - DNA, 875 bp, Heterodera glycines
  Genomic contig location: Contig_ID=SeqID_6813; Location=1300..2174; Strand=+
  SCN-specific regions: Sequence locations=1-120,142-259,281-439,482 -661,699-875
atggtctattgtgagcctggtgatatggttcaaggcgaagtatttttggttgcttctcttatcgtggttatttttactttgcctacaattgtcatttatattataatggggattatgttaaaggtaattaaaattaaatgacttacggtggttgttaaaaaaatgcattttgatttcccagtgatcagaagtgatcagaacaacagcaacaattcgtcccagtcccaaattgaaatcactcgtcgcattttcaaatcattggctgtgatcatggcagtgatcttttgcttttggttcaccagttgtctggtggttaacattgtggggcgcggactgatcacaagtgatccgtcatctcaatttctgatcacacgattagtggtacaaatggtcacaattgcaggggcgatcaatgcaccaatcctatatatttgcaggcaaatttagaattaatattaaaaaaacttttttaataaataaaggttttttagcaaagaatatcgtgatatcttgaagagtgagttcggttgggtcattaaattgtggtcaatttgaaatcgaatttcatttgctcatccgaaacccaatcaaaatgcttccgctgttatggttgtgtcaagaactttgaaaaattcaaacgacaatcgagtgcatgtcagatgaaagaaaagaaaaatgttttaatagcaaaaaattgagcgttatttttacaaaattagattaatttatgcctttttagaattgatcatagaatcaaataattattgataaaaaatcttgtacgtcatttgtcacttgtgattcacacgggccaagtaccgtaagccatccagctttttcagagtgtacagaaactgcgagtcccttcgaatata

SEQ ID NO: 62969 - DNA, 507 bp, Heterodera glycines
  Genomic contig location: Contig_ID=SeqID_32694; Location=319..825; Strand=-
  SCN-specific regions: Sequence locations=1-105,127-149,171-179,201-507
  Gene Ontology: Mol. function=ATP dependent RNA helicase activity; Cellular component=spliceosome complex; Biological process=RNA splicing
atggcatttgcgcaggggtcgcatacgatgagcaacaaaaagtgtgtgctgcccgacggttcccaaagaacgcagaagaaaagctacgagagcatttatgttccgccattaaaaccaaaaccttttggcgaaaatgaggttcaattgaattatcgatgtttatgataaagcatatttctttttcagaaactcatcgaaattgaagaccttccgaaatgggctcgtccggcctttcagggctaccgaaccctcaaccgaattcaatcagtgatcagtcaaaaggcgcttcacaccgatggaaatttgcttatttgtgcacccactggcgctgggaaaaccaatgttgcactgatgtgcattcttcgggagatgtctaagcatatgaatgaggacggaactgtccgaaaggacgagtttaaatgcatttatgtcgcaccaatgcgttcattggttcaagaaatggttggcagtttcaagcaacggctggaagaggcgtacggaataact

SEQ ID NO: 62970 - DNA, 687 bp, Heterodera glycines
  misc_feature (489)..(489): n is a, c, g, or t
  Genomic contig location: Contig_ID=SeqID_32696; Location=10..696; Strand=+
  SCN-specific regions: Sequence locations=1-145,171-687
atgcgctaccgaatgatgaccgacaaatccctggaaccgatctcttcagagtttcctgacgccgcactttggaacaacgaaattgaccaattgaacaaagtgagagaggagggggaaaattgcatttttatgattaaaaagggacggaaagaaacgcaaagcaaagccaacgaaagcgacggaagtgccaattggtacggatcgccgtggatgttcgtcgagtgttacatgtacaggcgaattcggcagttctttcagcagagtcagtttctccgcgagttcgacccgttcaacgaagacaaagagaaaagttacaaagacaggtgaaaagcaattttacttaatcgtccagtcaaagaccataacacttggtcaatgcttacaattattttcgtatcaatcgaaagcttaaagtctataggctttttgtaaaactaaatctgcttaggctaatggttctagtcggttttatgcgtcccaatgaccatnacccagtttcttaggccataacttttttcttacttggtcaatacccatattcttggtaccaagcgaaagacaaaagtctcgagattttttaaatgcaagaaaagagcaaatactggcattaaaaaagaaattacaatgaaaaaaacgaaattcaacttttccgagcataatttttttgtctattgcatttagatataa

SEQ ID NO: 62971 - DNA, 152 bp, Heterodera glycines
  Genomic contig location: Contig_ID=SeqID_32697; Location=464..615; Strand=-
  SCN-specific regions: Sequence locations=1-152
atggctaataaggttgctgccgacggcattgagatgaagcgtacgccgcccgacctttcgccgcagtcgctacgagtactatcagcggcacgtggaacacgaccagggcaagccgggactacgcgtgacggaaagcatttggcacgaagggg

SEQ ID NO: 62972 - DNA, 344 bp, Heterodera glycines
  Genomic contig location: Contig_ID=SeqID_32699; Location=579..922; Strand=+
  SCN-specific regions: Sequence locations=1-83,107-146,170-344
atggctctggacccaggaaaaaacccaggcctggatccaggtctaggtcgatctctaattttaatgttattgtttgtatttataaaccaaaacaaaaagaattaattatgggtagaaaaacgaattttccttacttcttattaattaattaaaaccacaaataattaaacaataattttttttccaattttagggagtgccaacaatttcgacgtgttcaaaaatttgtgcctatattttggctttcatttgcatgttcacctgttccatttgggcatttcgccaagtgttgcaaattgaaatggacaaaatgtccatgccaattccattggatcgtatgttga

SEQ ID NO: 62973 - DNA, 466 bp, Heterodera glycines
  Genomic contig location: Contig_ID=SeqID_6814; Location=2059..2524; Strand=-
  SCN-specific regions: Sequence locations=1-274,298-369,404-466
atgactgtttttgaccatgtgtgagtccacggggtacgaagtgttggcccaattcggccggcgcatcaaaatcagcgtgaaattgaaggcgatcatatttgagcaaattgtggtcaggcacagtacagtgatcagcaaaattgcgtagcgaaagccgccattactgcagcaacagcaggtggtacggttaccgtaagacggcgcatcgacgcgcgatggtcgtggcgcaacggtagtggaacaacgctttttgccattcattcggtccattcaaattattaaaaagaaataattaaattccttaaagaaaatttaattgattctacatcgattgaaaattaattttatgttagtactaattattaaggattattttaaaacaatttttcagaccaattctctgctcccttttttgctcatttagcactttaggaataataattatgcatttaatgcattaaataaa

SEQ ID NO: 62974 - DNA, 1095 bp, Heterodera glycines
  Genomic contig location: Contig_ID=SeqID_6814; Location=2593..3687; Strand=+
  SCN-specific regions: Sequence locations=1-3,50-54,97-131,157-678,712- 871,893-942,966-1041,1063-1095
atgaaatttaaaattatttttatttttatgtttaataaaaaatttaattctgagtttgcttctctaaaattatttttggctttgaatgtgacacagaatttggttgggtgaaccatgctgaaaataagcacttggaaaaaattttaaattttcccatataagttttcaacgactatttccagaatatttcttcccccgctgatttcaccgtgctcaacgagtcatttgtgatcccgcacaccgtaccgtactccagtgtggagaagtcgcgcctactttacgcggtcggattggccagcatggtcagcacatttccgttcagcgcactgtatacgcggtacggtgcgcgctacgtgttttttgctgccggcgtcatcagcacattagccaccgcactgttgccgctggccgccgcccatggcatggccgcgttcatggtcatccgtgtgttccagggtcagcaaacaaaccattgcattaccaagatgggacatgggccatcgaattgagagccgaccaatctcgcactgggcaatctgttgctttataatgacgaggcttaaaaattataagaaaatcccaattttcataaaaaatatctttttaccaggttttagggttcaagtctatttcatatttgtccatactttgacagattttcaacagtataatgttttctatttttttttattctaaaaataatttttattacgtatttagccatttctaaattttagccttcataacgaattgaagagttttgagaaatttgcgatcaatttgtgtgtccatatattgtaatttttatgtaaattgaattagccgtcataataaaattgctaacatttgagggcttgcttatggtgccaactttgctgccattggctttgtgtgccatcgatgggccacccttagacaacatggctttttcctgtaatttagttaattaattattaaagataattatgcgtatcttttcaaaaaaaatttaagtgcttgcatgactaattttacttcaattgcggtcacattgacaaatccgatggcagcatttgtaagtgctaattagtatttgttattattctcataacaaaa

SEQ ID NO: 62975 - DNA, 704 bp, Heterodera glycines
  Genomic contig location: Contig_ID=SeqID_6815; Location=667..1370; Strand=+
  SCN-specific regions: Sequence locations=1-99,121-138,268-292,322 -322,344-669,691-704
atgagtgttgttctgctcgtagtaagtcaattagtaataattacattatttaagccgaaaataaattaataaatcacaattagccagagttatggctaaataacttattttatttattgtacaatggtaattcttttcataaaaattaaagtttaattaaatgaagttatttactttaattaaaaataaattatttatttgtgttatctagtttaaagtaaatttttataattatttgtgtaattcaatttaaaataaattttatatctttttgtttttctcttgcaatcggaaattaataattttttaaaaataattaatggtattgaattgaacaaatttttgccaattcttaaaatacaaaactaagacaatgttagttagcactaaatttaaaaatactgccaattcaataaaatgaaaacattttttaaatttaggctaacattttcttttggttttttgcggatgatcagccagcaaaattcaccaaagaaaagatgaagattcgaaagcaaaaccaccaaaacaatttggaagcaccggccaaattggcatccgcagaaaaagcgaaggacggaggagaaccaatcgggagaaaacgaattgcacaacattggatttaggaccaacaaaatcaattgatcagacaaattagccccaataatattaattgttaattaccaaaaatggaaaaataggaa

SEQ ID NO: 62976 - DNA, 513 bp, Heterodera glycines
  Genomic contig location: Contig_ID=SeqID_6815; Location=2046..2558; Strand=+
  SCN-specific regions: Sequence locations=1-297,319-400,423-454,476-513
atgttagttagcactaaatttaaaaatactgccaatttcaataaaatgaaaacctttttttaaatttaggctaacattttcttttggttttttgcggatgatcagccagcaaaattcaccaaagaaaagatgaagattcgaaagcaaaaccaccacaacaatttggaagcaccgccaaaattggcatcggcagaaaaagcgaaggacggaggagaacaaatgggagaaaacgaattgcacaacattggatttaggaccaacaaaatcaattgatcagacaaattagccccaataatattaattgttaattaccaaaaatggaaaaataggacataaaaagtcacaagggagacgggctaatccacaggcaatcttcagaggaataggatttaatccgttcattaaatttaaaacattttcatcctaagacaattatttggggatccgtttttcgttggtttcttttcaaaatctgggaagttggttcattttttcacaccctagaatatatta

SEQ ID NO: 62977 - DNA, 330 bp, Heterodera glycines
  misc_feature (239)..(239): n is a, c, g, or t
  misc_feature (242)..(242): n is a, c, g, or t
  Genomic contig location: Contig_ID=SeqID_32704; Location=345..674; Strand=+
  SCN-specific regions: Sequence locations=1-330
atgttccgttttgatgaacaaaatgaaacccgtccaccggctaaaaaggtcgcaaaaattgcaaattctgatactgatgcgactccaagaggtccgattttaattgaattcttcaaaattttcacaaattacttagaattcccaaaatgtataaaatttttacatattttcatgcctaaagtaccattcagaattatttacatacaaaaaaaaaattttatagtgaataataaattatntanggttactttccggtgtttggctaccccccataaaaatgtcatgatcccgataaaggaaaactctttcttgggtagttttaggcgctga

SEQ ID NO: 62978 - DNA, 865 bp, Heterodera glycines
  Genomic contig location: Contig_ID=SeqID_32708; Location=1..865; Strand=+
  SCN-specific regions: Sequence locations=1-260,283-314,336-738,760-865
  Gene Ontology: Mol. function=peptide YY receptor activity; Cellular component=integral to membrane
attgtcgagattaaagacatagacaagttttgaagaggtggaaagtgaatgggaaattgagagagaggcatgagagagagagagttgatgggatggcgcaggccttgttaaattaattaattcaaattcactccagctgcagatgccaccaacaatggcattttctccgtaggaaaaatgccatggcgcagacattccgttctattaaaatctggcaaaatcatgcgcaaacaaacacatacagcgcgacaaggaagcactttttaattttaatttaaatttctgtgccaatgattcttaaacaaccctaagggcatttgtaccgtatattttttgaatgataatacagtagacgtggctaattaaatgctttaaaaacaattaaggaaatgtgagaaggatgaacagcagaataatgacgaacagaaaaatcacgatgatttataacaactgttattaaaatccttcttctatgatgataatgtccaacaacaaatttgtgccattactaccgtatgcaccaaacgacagtagtgccacggaccacaacaacaacaattacagtatccatttcacggcggcgccttcttcaccaattgttgccctcccggaacagttgcctttcccaattgtgctcatcctctccgtgccggccatgctgatcattttgctcaccatttttggcaatttgctcgtcctgtttttcaaggcgcgcgtcgggcgcacaaacaccacactgttggtgtggaatttggggctcaccgacttcatggtgggcatcctggtgttgccgatgggcgcctattatttgctcaaccgacgctggatttttgggccaatgctgtgccggatttgggtgagagca

SEQ ID NO: 62979 - DNA, 796 bp, Heterodera glycines
  misc_feature (10)..(10): n is a, c, g, or t
  Genomic contig location: Contig_ID=SeqID_32709; Location=54..849; Strand=-
  SCN-specific regions: Sequence locations=1-229,251-486,510-641,671 -707,782-796
tctgatctcncactacggcatttcgtcaacgccggtgattgccctgtggcaggacggcttcccgcgctaccgtctctacgacgactacgcccggctggacacactgttgcgcgtgctccgcacacacaccgatctgacgccagcagcagcagtgggcgacagtaacagcagcagcccatcgccttaccatggaactgtaggacaacaacaaagtatgttcaaattttagagatcatgacaagcaactttaattagtttggctttgtgtctggacaacagctcgtccccccccccccccgaaataaaaaaaaatcaaaacggttttctaaagtttttcaaaacttttctgtggaatatttgtatgttttcaaaatttgttccaaaaatcatttgttcaattctttgtggagttcggagtttcgtgtcgttctcacgtgtcgtgtcgcttgccgagcccaataacgcgaaatcgctggcatttgaaaatttgtctaaattaaggaaaaatgctgccccgggaacaccagcaacagcaaataaatgaaaaggaggctgaggaaaaaagtgccgtcatcgtcgacggcagtggcggcgacgacagtgttcaaaatgagccaccgcaacagcaacaaaatgatgggggaggagaagacggaggaggaggagcaacgacgacggcgccgtcggaggaggccaaaggagcggggagcagcagcaacgggcaacagcaaccgccaccacagcagcagaagcaacaacagaaacatcagtggcagcagcactcgccgctgccgtg

SEQ ID NO: 62980 - DNA, 119 bp, Heterodera glycines
  Genomic contig location: Contig_ID=SeqID_32710; Location=695..813; Strand=+
  SCN-specific regions: Sequence locations=1-119
tgtgcgtgtggggtactctaacaattatggggagcgaaaatccaccgcagaattacagtacaggctatatggaagatattcccgaaggattctgtctccccaagatctgggcgcatctg

SEQ ID NO: 62981 - DNA, 597 bp, Heterodera glycines
  Genomic contig location: Contig_ID=SeqID_6816; Location=2644..3240; Strand=+
  SCN-specific regions: Sequence locations=1-7,29-353,375-517,575-597
atgcatccaatcaaaaaatttttatttttgtaccttatactttaccaaagtgtcaaagtcgaacaaaaaccagtacatcgtcgtgctatcctcactgttttagcaattggaggtattgcagctctcgttttgataccaattgtggtcggatcggcggtggttggatatttgatatcctatagcatacatggcgttaatggaaaatgttagtcagtttacctacctactcaaaaggcttatatcataagaatttaaattcccctgttaaacagatgtccaacgactgaaagttttttttccccttaaaatgagaattgacgaacacacaatcacgatggatgttgagacttttaataatgagtttttattttccaaaatcgaacaaatttggcgcactccaaatttagaggagatttgttttaccggttagaaaaaatgactatttatctaaataaaatttttagaccatgaaggaaaccgacaacgccacgcccgctcagcccaaattgagatgtttttatattttgctgtgaaaaaagataatttaaaaatttcaatgtgttgatttttagtgcttgttagtccttaagcaagaca

SEQ ID NO: 62982 - DNA, 1257 bp, Heterodera glycines
  Genomic contig location: Contig_ID=SeqID_6816; Location=4548..5804; Strand=+
  SCN-specific regions: Sequence locations=1-182,206-317,352-394,457 -551,723-814,895-1041,1186-1221,1250-1257
atgaatattatgaaagcattattttttattaggcaatttgtgaaaatttgttgccgtttggccactgtcggtgctttagacagcgccaggggcgcagcggcacgccctgggaaaagtaagtgttattttttatttctttaatttcctttttttcatattaatcgaaaatattagtttcttcctttaaattttattaatattttaagtcatcattagggctaatattattaggctctaaatacacacaaaaggcacaaaaaaggttataaaattacaaaaacatgttttttgtgcgtttttggccactgggtgcacagaaaaaataaataaaaattaaattaataaaaatttgcaaattaacgtatagataaaaaagcacccacaaaatcattgcattaaaaaattaataacagttaaagaaaaaatattttaacataaataaaaatatataataaagactaatcgagaaaacaaagagctaccgaaatataaagattttaaaatttattcattttcacgaagttatgataatttcctatcaaaatttttcgtaataattatagaaaattttcaaatttttaaattgaaaaactgctaaatataaattgttttaaattttaacttaatttttctttttgtgttagaagaaaacatttttgttaaatttattttttttatatttcatttttttttaaataaatgaataaataatttaatttattcttatccgttactgatattttgattccaattgattcaagtttatatgccctatcgaaatcatgctgatatgaattacaaaatccaaatgatcaaattaaaattaaaataattaatttaaaaattaaaagcgaacatatattttaattaataataaataatattgaaatatttgctatgttgacaaggtcttcggtcaactctcgatttttgctaaataattataatgaatgaaaaggtttacagtttatacttttgcaaaaaagtgcatcattaaatatactataaaatgaattattaatagccatcaagtaaacaaacaaatttattaataatactttatttcaatttaaaaaactaaatttcatttattaaataaaaatattatctcataatttaatatattcagtaatatattatatatatattttttataaacaaacacataattaatataaattaaatcgtaagaaatatttcttccaagtataccacataaacattaaatattaaatttattatttaatatgtatgata

SEQ ID NO: 62983 - DNA, 93 bp, Heterodera glycines
  Genomic contig location: Contig_ID=SeqID_32713; Location=1..93; Strand=-
  SCN-specific regions: Sequence locations=1-93
acattgacgagaatgccgacactttgatcgaatcgaagggatttttgcaaattgaccaaaaaatgttgtgcgaaattttggaacgcgacaaat

SEQ ID NO: 62984 - DNA, 93 bp, Heterodera glycines; identical to SEQ ID NO: 53399
  Genomic contig location: Contig_ID=SeqID_32713; Location=506..598; Strand=-
  SCN-specific regions: Sequence locations=1-93

SEQ ID NO: 62985 - DNA, 726 bp, Heterodera glycines
  Genomic contig location: Contig_ID=SeqID_32714; Location=173..898; Strand=-
  SCN-specific regions: Sequence locations=1-152,174-454,476-726
atgcattattttgatattgcttgtctacttggctatataatggataaaatccacacatggctggtcaacagaagattggacccgacttcgttggccaaaaatgcctggtccaaattcaaacagtacaagggtatcaaaatggaataaaatcgatttaattattatttaaaattgaattcattgaatgtttcaaaattgattatttatttacccaataagtttttatttattttttcagttacaaaagcaatcagcagaattacagagcatacagttgaaaatgatgatgatggcggttgcgcaatatgcctaggagcttatgaaatcggggataaggttcgcacattgccgtgtgaggtatgcgatttggaattttttagctgaataaataagaaactgtaaattatttaggttctaaaatctcaaatagatgttaaaagtggaaaaatagttgcaaaaaactttgatttaggggtgtaaaatgatcaaatctattcaaaaaaatcaatcaatcatttataaagaaaattaagccaaatccgcattgagatacaatattttcttctagtaatagttttaaatatctttgtttagccaaaaatatcacatggaatgcataaaccttaatttatttagcaccaattccactcggaatgcgttgatgaatggtaacgaaacttggtaaaatattttctttaatattttgcctgttttcacaggattaaa

SEQ ID NO: 62986 - DNA, 558 bp, Heterodera glycines
  Genomic contig location: Contig_ID=SeqID_32715; Location=182..739; Strand=+
  SCN-specific regions: Sequence locations=1-558
atggtggttggtcagcaaaatttattattattttgcatatattatgccgtttttctgatcaccaaaaaaaggtgtgttgatcatttgggatcggatgtttggcacatttgaggccgagcgcaaggatgatccgccggtgtacgggctgatccggccggaacggagcttcaaccagttgtggcttcaggtcgtccaactaatgggttttcaaatcgagaaattaggcatttaggtacttaaattccagtacaacagagtgggcattattttgtcagagtacttatattcaagtacaaaagggttcagtgcaaaggctagccatttgttcttagattccagtagctaatgatggccatttgccaatgtatacacttaggttccaatacaaaaggatggccaatttttcaagttacaagaacagaatgatgaacattttgctgccaatgcacttagttttttcagtacaacagagtggatattttgccaaattttgattcaaactgaaacctatttttgcctattttggcgttttgtccaaaatttgttaacaaaaatgca

SEQ ID NO: 62987 - DNA, 1416 bp, Heterodera glycines
  Genomic contig location: Contig_ID=SeqID_867; Location=2548..3963; Strand=+
  SCN-specific regions: Sequence locations=1-302,355-700,722-779,801 -1142,1164-1188,1211-1287,1322-1346,1368-1416
atgcaccccgggattcagtttccggagccgttgcaaaacttctcgcccgagccgttggacctgatgtacgggttggtgatgctaaaggacctgagcttggagcagttgctgttgtacgtgcagccaggatcctatttctacccggattcaccgaccgacgaaagttcgttttgacaaaaaaaaggaggtgggaggcagatgcccaaaatgggttcaaacttaagtttttcaatccctgatagcctaaaaagcattatataagttatagaaaggagagcagcttatttcctccacctcccgagaaataataaaaaaatttactaacttagaaatttttcataaaaaaatttttatggtgaattacaaagatttatgaaaaagtagagccaaaggagaggcagtttttcggacttacaaataatagacgcggggtttaattggcattgaaaatgaaaatttgaataaatggcctaaaaatctatgccttttcgtgataaagtctcggattataagcatgccctttttcagtaaatgagatggtccagcagtccaagtgggaggagaaggaaggacggcgctacaattggactgattccaattccatgccattcgccgattgggaagtcggggcgaaagtgcccaaaacgacaaagacgccgcctccggcacaaccgccgccgctgccaatttttgccgagtcacagaaagacaaattgtaagcagtcaaagtcacactactgcaaatttatgcaactttccattcaaaaacatttagtgtgaaaaaacaagtggaaaaggaaaagccgacggtcgaaaatgaccgaaaaacgacggtgccggagggggcgccggaccttccgtccggtttcggtggcattttgcgtcagaaagcagcggtgaagcccaagaagaacgtacgctggtcgacgctgatgatgatgagtgacggcaacaaagtgcagctggtggccagcggcttccaaatggttgacaatgaaagtgttcggatggcgatggacgctccattggacgacgacggatgggaggacctttgaaagtggcgaaacaatggagaaatcgatagggagtgccaatgcgacaattgtgccggagtttcaacattttttgtccgttttatttctcattatggtttttcaattaaaaatggaaatttcgccccgttttaatgatttttcattgttataaattgtgtacttaattctaagatttgtactggttttgccataaaattataggattaattaaaaaacttaccccccccccgcgaaattaaaaaaatttataaattaattaaaattttctaggcgccacctgatgccatcgccggttcctcattttaccatttctaaattcgaccccaaatacaaaatggcattcaattataaaaattggtaa

SEQ ID NO: 62988 - DNA, 860 bp, Heterodera glycines
  Genomic contig location: Contig_ID=SeqID_867; Location=461..1320; Strand=-
  SCN-specific regions: Sequence locations=1-404,430-860
  Gene Ontology: Mol. function=neurotransmitter:sodium symporter activity; Cellular component=integral to plasma membrane; Biological process=cell organization and biogenesis
atggccgtgctcatcgaaacaacccttggtgacttggtcatcgacctttttgtcgacgaacggccaaatgcgtgcaagaatttcctgaaactttgcaaaaccaaatattacaatctctgccaattcttcaccatcgaggttggctttgcttattatcagggcacggatttatatgtggtcaaacttaagtttttactatgttggttttaggcatttttccttttcgttgtccccgagaaaatttcaattttattgcttttttgttcaaattttacgattttttataacctaaaaattaaaaaaccttgaaattttcaaggagctaggctttatgtcaatgtttttccagcaaaattcaactgttctgataacccgcaacatatttataaaaattctacggcgatttgtgtaattttaatacatacaaaatgcgattcaattgtttttttcctagtcgttaattttactgtatttcattttttagccaaattacatcgcccaaactggggacccaacgaactcgggaagaggtggcgaatcaatttatgggtcggtttctcccttaaacaatttctatattatagtactttctctttcagcactctttttggggagcaagcacggttcattgaaatggaaaatgtgcccaaattgcggcacagtcagcgcggcattgtgtcgatggtgaacaacggcgatgggatggtcggctcgcagtttttcgtcactttgggcgacgaattggattatttggacggcaaacattgcatttttggccaagtgggcgaaggcatggacacagtgaccaaactgaacgaggaattagtggaccgaaacaaccgaccctaccgggacattcg

SEQ ID NO: 62989 - DNA, 708 bp, Heterodera glycines
  Genomic contig location: Contig_ID=SeqID_868; Location=2325..3032; Strand=+
  SCN-specific regions: Sequence locations=1-685
atgccttgccaattgcctaatgaaattgcgacggtcactgacgacgtgttttcgtatatgtgcaatttggcaatggaaaagtgttcgaaaaaggccgataaaaagaaggcctcgtgtggtggggcagcaatgcggaagaggtgagaggcaaaaggggacgggggaaggcaaatcgggtgactaagcaatgtaattccatcatttggctctaaatttactatttttgaattccagtcaattcaattgcttgtactaatttcgtatttaatttgctctctttttttagacttttgatcaaaaacttcgtggcacaaatgctcgcgcaggatcgccactcgcgagagctgtcttcaccaacttctgactgttcctcccacttgaatcaggtgagctaatgagtgtaattagtcaaaaaaggcggtcagcccatttattatttcacgtaaatgattttttgtgttataaataagcgacagcaacaaattaaatttttagaccttcgacgagtcgttcgactttccgtcgtgtcaaagcggtgcgaatgcagtggaccaatttggagacgacatggaaatggacgccatcggagaggaagttagtgaacgattcttgtaaaaatatagcaaatacaacttttggtgtttcataaaaaaccggcagaaatctgccaaaaattttcacttcaccgccccgcccccccccccccca

SEQ ID NO: 62990 - DNA, 525 bp, Heterodera glycines
  Genomic contig location: Contig_ID=SeqID_869; Location=104..628; Strand=+
  SCN-specific regions: Sequence locations=1-316,338-525
gttccatccaatgcgacaaacgatgcctttctgtgcctagaccagccgtcgtcattgttgaccgacttggacgacgtttcgtgcgaccctcagcagcagtgccattcatcgcgcaatcggaagcggccctggtcgttggtgttctccgccgatgccaccgccactgctgactctatgccgatgccgtcgctgtgttcgatgggtgtcgtcgtcgaccagtacaaccaccaccacctgagcaacaccaacaacagtgttgtcgacatgttcacggctgcaacttctgctcagcaccaccacttcatcaactccaccgcaaacaacatcaacaacaacggcgttctccactcgtcggctcctccgctgttgtcgccgctgtgctgcggcatgctgcagatgagtccgttcgggtcggccactgctgctggcgaggccatgctgttcaatggtgctggtggcggtgccggtggtgttggcacgggcggacgtgtggagcagccgatgctcaagcgggtcaagctttaa

SEQ ID NO: 62991 - DNA, 995 bp, Heterodera glycines
  Genomic contig location: Contig_ID=SeqID_871; Location=545..1539; Strand=+
  SCN-specific regions: Sequence locations=1-141,168-421,443-463,485-995
atgccacaattcaccaaaagaccatttcgggtgccgagtgcgcattcggtggacaaatttgtggacgaattcctcaaatcggacggggtaaaactattggaattgagcagagaatgccatttaaataacatggaaggagtgcatttttccaaaaattccaaaaatatatgaaaatttttcatactttgtcatggatcgtaattgtatgatacggtggtattacagtaggattgtccagttttttctacaatttttgctcaacacccttacaaattcagctgttcattctccgattggtggccacaaatgcgggcgaattggtcgtcgttgacattgtcaagtgcctttggaggttcgaaattcggagaatttgggtcaaattattattagcgatcggaatttgtgcccagccggcgccggatttattatttatgtttatgatttgccaaaaccggacggtttcggctacaaatacccggtggtgcctgatatcgcatttctgttcctttttaaaaatggcattcattgaaattcgcgcttttcagagagttttcttcccgtcagtttcatattcgtccgttggtctatgaaaacgaactgagcgaagaacggaggcgcgaggatgaagacagtcaccacagccttctgctgaatgtgtacagcagcagagggaacggaccgacccatcaacagcagcagaggaagcaaagccaacaacttcggttggtggtccaaaatatttggaaaacgaaattcgaacttttgtcagatattccactaatggcaacagcctcggccttccactcccgacaatgtctcggccgccttctgtggtcgcattggacgattctgtcggcacaccgtcgcccgtctgatgaggaggagaaagaagcaaatggccgaagacattctcaacgaatggatgcgatgccatcagattaagaacaacattattattttaatgcgaccttttcacattttgtacataaatgtaa

SEQ ID NO: 62992 - DNA, 1098 bp, Heterodera glycines
  Genomic contig location: Contig_ID=SeqID_871; Location=1809..2906; Strand=-
  SCN-specific regions: Sequence locations=1-140,171-585,607-643,665 -813,835-1098
atgaaaaaaggaattgccctgcccccagaaaatttgtctgaagtggtcaattcacttcgttttgacatctgttgggcgaaaactcgggtttcctttgactttgactattttgtattggaaaggcaacgaatttggattcgaaaacaaaaatgggtggaaaaatagattattaatattaaagacgaaattattttcttttagaaagcacgggtcgacttggccaaggcgaaggaacttttgggaaatttggcggcacacatgcttccagtccacctcggacaattgcgcaattgtaagttcatttgtctatcttaaattaacgcttaccgactaaattccctttagtgatcgcttcattttttgaggtggcatacaactatggatttcctcaccacgaagacagtcaagctccaaatgcaggacatttcgagattcagtttggaagaattctcaacctgctagaaaacgcaaatgccacccaaattaacaagacttcgcagtgttagtcgtaaacactgtctattaattatactaataatttgaatcttcattaagttctgttcgcactctatgaaacctttgctacctttaatcagttggcgattgataggaccgacagtcagaaccaaaacgtcgccgttcggggtgagaatgccggccttcgggcgctgaatgtcggtcttcgtgatgagaatgtcagtcttttggcggagcatgtcagtctgcgggcggagaatgtcagtctgcgggcggagaatgtcagtcttttggcggagaatgccggccttcgtgatgagaagataagccttcgtgatcaaaacgtcgccgttcgggctgagaatgccggccttcgtgatgagaatgtaagccttagggctgagagtgacgttcttagggctaagattgaaactcttcagtcaatgatttgaaagactctgacgttaaatgttttttgttgactattgttaaagaaaccatttgcacattttttggataaaggtcattaaatcagtgaaaagcttagtcagtgggacaaacacagggttgtgagagaaaattttccaatgtttttttgaaaaggcgcactgcaaaaataaa

SEQ ID NO: 62993 - DNA, 907 bp, Heterodera glycines
  misc_feature (799)..(799): n is a, c, g, or t
  Genomic contig location: Contig_ID=SeqID_6817; Location=14..920; Strand=+
  SCN-specific regions: Sequence locations=1-471,551-623,837-907
atggcaaaaaaaggaatagatagggcttgtaggaaagtcgcctttaaaacgatcggcatattcaaaaatgattttgactccggtaggtggttttcttctgccagtcccttcgaaattttattttattggagagaaatttgttaacaaatatttcaatgcacaaaaaataccaggattaagccgaagtaaaatagtccaaataagagatttaacataaataatttgtacaattaaaaaaaattgaaaatgaaatatcgaagagaaaaacacagaaacattggtgggggagggaaaagcgtttggcaattggcaaaatgccggggctggcattatgttccgaagatatcgccaaaatgggcttttgcttactatgcaaaatacggcacacaatgtcataacacaagccaattgatcagtggtcacgtcaataattttaaaattgaattagaatcgatgactgctcagcatgcgttattaaaatatttaaaataataaattaaaacctttaaatattttacgaaaagtttttaaatattattttgtattaaaacaatctttttccatttcatgttgatttcccgtaatattcaatccgtaatttttttgcataatttatgtgtaagaatttatttattttttaatttgtttctttcgtacattagcgaagagatattttaaattttcaattattttttattataaaattaaaaataattttttagtttaaatcaattattttgtaattttctgatatttttaaatattttacctaattagttctataaattttcctttttanatttataaaatataatattttttataacttaaaaataccttttaaataactttctcttaatagataaaaagacaaaattgtttaatccatattgctgatttataaaaa

SEQ ID NO: 62994 - DNA, 469 bp, Heterodera glycines
  Genomic contig location: Contig_ID=SeqID_32728; Location=323..791; Strand=+
  SCN-specific regions: Sequence locations=1-17,40-156,178-246,268-469
aaacaatcagtcgtggaggaaagacgggagaagaaattgaaaaagcacttgttgaaatgtggaagcgattggaatcagatattccacgtgcggacaggcaatgttctaattctgtgattgattgagatttttgcatgaatattctcggttctttgtttgaagaaaactcattttccaacaagcatttgctttcatctttttttatggtttgatttttgtgcattttttgaccaaattcggcttctaaatattcttattcttaaattggcctctctttagttaactttgacccaaaccccgaaaacatcgggaatttttttatttgacccatctttcaaaaaatatcaattggttgttttttactggcacagatgcatcttaaatgctgttgtggacggcgaggaatggaaacgcgatgaagtctttggcactgtggaatttttcaagaatcaacttttgataatggtaa

SEQ ID NO: 62995 - DNA, 1968 bp, Heterodera glycines
  misc_feature (1690)..(1690): n is a, c, g, or t
  Genomic contig location: Contig_ID=SeqID_6820; Location=307..2274; Strand=-
  SCN-specific regions: Sequence locations=1-174,196-245,281-1099,1121 -1187,1213-1714,1743-1968
atgggaaaaagatggcgaaaaaacttcaatcataaacaccaaaataatgggaatgatcgcagtggacctgcagccacttgttggagttctaaagatgcagcgcactctcttctttcagttacctgtcacttcatttacgagggccaactaaaattcgttgtcttggctgctaagccaattaaaggttaacaaatgtcatcatattctattaaattattaaattttaggacggcataacgctactgtcttaaaggatttattaatgaaagtttttgttgaattttcattagaaaagtcaaaaaattttgtcgttttacgggatgctgcagaggtgatggtcaaagtttgtaccgaccttggcttaaaatcaatcgattgctttgcgcacaaatgcaatttggttaaatatagtttatgcattatgtaaccttaaattatgtattcaggccatttgggacggtgttcgaaagttgaatgatgacgaatcgacaaaaagccttcttgaacggattaaaaaatttgtcagaaagcttaaaaaatcgcctgtacagaaagaacaatttgagaatttacaaaaacttctggaattgccgaaattatcattaactaaggacactgaagtgctgaatgaattatatatatcaaaaattgtatttttcaggttcgatggtcatcaacctttcaaatgatcgatcgttttttggttaatcgacaggcaacaaatttgttatgtgcccaagacactgatttgccacggttttcgtccaacgaatggacggttatttcggcattgagaaaagtagcaaatacctagtttaatttgataaaattgttcttacagattctttctcaaattcattcggcaactaatgacttacaaaaacgtggaacgccaatttctgcaatgattcctttgttcagagtgatttgctttgcacttgaagaagaaggcgatttgaaacatgtaaaaaaggcaattaccgatgggcttaagcatcgaatggatgcaaaaattgatgccagtggaaacgttaaaagattttcgtgggatgaaagcagagagcttgttctgtcgacaattttggaccctcgtttcaaactttcttttttgaatgcagaaaagcatgatcgatataaaatttggcttacaaatgaagcagaaatgtccaaaacattaaggtgctttgtataaaaattttttatattttaatagttttcaggatttaattataactgaagtgtgcgagactgatcaaattcaatcacaaggctcaagtgaattccatgatcttttctcccgatgtgaacaaaatattgccacagaatgcggattagacattactgcgcaaccgttacctagtccagaaacactgaacaaccgccaaaaagcggaagtcataattattaaattttcaaaatctatttgtttttaattaaaggttgaagtcaatgattatttgcatgacaaaaaaattcccaatcgactctgacccatacgggtactgaacgggggacaatgctgtaaaatggccccttcttacatgtcttgcgcatcgttttctttccgcgccggcgacatctgcagaaagtgagcgcctatttagcgctgcaggattaataattaatgatctgagaaaaagattgactccggaaaatgcagagattttgttgtttttgcatcacaactcanaaatgtatgattttgactattcgtaaaattttttgaaaaaaatttggcttttcgcatttcgctttttttttcatttcgcatattttggcttttcgcatttcgcttttttttcatttcgcatttttcagtttcgcaaatttcgcttttcgcatttcgctttttatttttcaatttggcccatccctgtttcacaccctgcgatgaaatacgtacaataactactattgaccttatcttggataagaataagcgattatttaataatgaaaaaaaataaa

SEQ ID NO: 62996 - DNA, 680 bp, Heterodera glycines
  Genomic contig location: Contig_ID=SeqID_32733; Location=47..726; Strand=+
  SCN-specific regions: Sequence locations=1-212,235-281,303-680
atgctttttttgctgctccttttttcctccgccccttttgcccttttgtttttgccgttggatatttttttcacccaaattgtgcccgcaaaagggggaaacggcggtgggaaggggggctgttatgtgagttaaaaaattaatttcattatttaaatgtgattattataagaaacgttgcccttttttgttgaataaatttaaggaatttgatttatttattttttataaattgattaatctctctaatttataagggatattgtgaaaagtttaatgcgttggaagatgacttggagaaaatgaagcaaataaaggcaaacgctgaatgttttgttgacgacatgggaaaagtcatcaaagggtttgagaagaaactgaacaaattgaggaccagcgtaacgaaattggaggaagaaaatgagagtttaaccggggattagcagggattaattaactaattgaagcgtttaactgggattaattaagcataaccttggctaattaaattaatcaaagggtatccttctgaaaagagacgcacaaacgatttatcatttcggaaaatattttttgattttcaatttaattttgtaagaattttttaaccaaaacttgtttttggtgttcctttaagggttcttttacggttgactttgctcttttaaaatacttcaaaa

SEQ ID NO: 62997 - DNA, 192 bp, Heterodera glycines
  Genomic contig location: Contig_ID=SeqID_32734; Location=674..865; Strand=-
  SCN-specific regions: Sequence locations=1-192
atggaattgtgccatcttttgcgcagtttcgccaatgttcgccccgacggactacggccgactgatcgaatgcacgacgccattcagtgcccaaggggacaaccaactgagtttggcgatcggggagagagtgttgctggtgaagagcggaacgaggggatgggtgttgggacggagcacggacggagtgag

SEQ ID NO: 62998 - DNA, 958 bp, Heterodera glycines
  Genomic contig location: Contig_ID=SeqID_6821; Location=863..1820; Strand=-
  SCN-specific regions: Sequence locations=1-42,64-106,185-213,235 -311,357-505,556-749,771-910,941-958
atggaacccattagtggaaaatcggcgtttcaagccaatggaagggcatttggaggtgtggagggaaattgcaattttaatattgcttacatttttctgaaattgcaaaaataattatttattttttgcttagtttcaaaaataaatgaaatttttaaataaaaataaaacttttttaaattttccattgcaaattctcagttattcaatgagcacgtgaacggaacagatgagacatggaaaagactttactttcgcacaaaggatggccgttttcaatggttcgcggtggggcaatttaatcataattacctaaataattgaattcctcaaaaataaaatgctcaaaattgttttcggtactaataatagatcaataattggacatatagattaatggattaaaaaaagaagtttccagctcgatccaaattcaaatgactgtttgtttttccaagtttttttcttcgtctttttcttctttacagaatagtcattgcccttcataaatttaaaattaacagaaataaaatatgatttatttaaaattttttagagtcattgtgccgatgagcatccaatttcggaccttttgttgaccggcacccatcagtgccaacaaagaggcattgaccatgcaaatacgaggcggcaaagaggatgctaatattgttgtccgtgtgccttcaaatgtattcgagaaatggcatcaggggggaagagaattagtaattactgaatgattagttaaagagactacaacaaaataataattaaacaaggaatacaatttttaaccaaaacagagagaatttaattaaagattaatttgaaatcaggctttgtttagccatgccagctcctcaaatattattttttgagctaagcgtaaaagcatagaaaacaaaacatattaaaaaaaattatgaattttaatttacaattttcggaaaataaa

SEQ ID NO: 62999 - DNA, 1202 bp, Heterodera glycines
  Genomic contig location: Contig_ID=SeqID_6823; Location=490..1691; Strand=-
  SCN-specific regions: Sequence locations=1-56,106-193,215-404,428 -444,468-567,589-713,737-911,933-1202
atgttcgttattcaaataatttttattgcaacgattttcactttatgggtaaaaagtatttaaaaatatataattaatatcaatttccaattatttatattttaacagtcaaccatttttgcctgtcaatcatcacaattggtaccaccaatttcaacttttccattgccagcagatgtgccaatacagcgaggaaaattattgtaattattttctgatttaaaataaaagtcatattgaatagtttcgatccattgaaataattgatttaaaaaaatgctcccagattaagctaacccttcaaaaattttcgatttttcggtttccaagggtcgctaatcacgatttaacatttcacctcatgtcatctgatgatcatcaattcgccggaatacggacgaatttaatgagattttgccaacgtgatcagcaacatgaaaccactaattaaattttataaaatttttgacagacggtagtggacattataagccgcaaataccaaaaaaaaaaccacccttccaattctcaacataaatttgcgttatccccgttccagtaaattaatttatttgaaacaaaaatttagcgcatcggctcgaaaagaaagtgaacaacaccactttgacaaagatgagcaacatttatttaacgaaacaatggtaaaaacaaaaattttggccaaaatcgaattatttaaaaaatcgttcaacatttcttttaaaataaaagggatgccaagtgttcaggtttttcagatttgtcctgcatttgagataggcaatctaagaaactgcaaataaatgccctaaacttttaagatttgtctaaatcttgatgttcaaaattttacatacaaaaaatctcgttaaaaattcctattttttcctagcgacgcctattggcatcgcaaatattttaaaattatttttcaaatactatagaatttacaaaaattctaagtaataaggaacttgttgcgatgaactccgcttcaaataccacaacattggcaccatcactaattgtttcaacaaaaatgggttgcacgagcgcttctgttactgccgtgactaaccaaccgtacaacgagcatactgtacaagctgattacatctcattggtgacaaaggtgacaacaaaataattgatgtcgttttttggcactactaaaaagaaggcgccttttgaattttattaaa

SEQ ID NO: 63000 - DNA, 1524 bp, Heterodera glycines
  Genomic contig location: Contig_ID=SeqID_6824; Location=1255..2778; Strand=-
  SCN-specific regions: Sequence locations=1-165,206-621,708-1040,1063 -1274,1303-1419,1459-1524
  Gene Ontology: Mol. function=focal adhesion kinase activity; Cellular component=focal adhesion; Biological process=integrin-mediated signaling pathway
gaatatctgagccaaaagggatttgttcatcgggatgtggctgctcgtaacattcttgtccaggacaaaacttatgctaaaattggcgattttggtctgtgccgtttcatttatgcggacagctccaattataagagccgaggagggcgtttgccaattaaatggtaattttcataaattatttaaattatattataaattatttgtcatattttcaggatggcacccgaggcaatacggcattacgagtttaccaccagttctgacgtgtaagcatttgaagagagaatgcccggtgctgggactttagtcaaaaccatcaaatgaaaaatttttgacaaaaaacaaaaaccaagtttttttgagcatttttggtcataacattcttcaaatttaacgaatctttttgaaattttgcaggctaattgaaaaagataggctatcgaatgatctaaaattaaaaatttggttacttttgaaagaagttatgaaaaaaaaattccctttgatggtttttgactaacgccataactgactaatgaatgttcgagcacggcgaagcaattcactctcacttaaaaaattctataatttttcacaattttttttttgctaaaagagaaaattaatttatttttaaatatttttgaaataattatcatttttagggttttctaaattaaaaattaatttttttaaataattttcgaaaagacactttaagatttttaaatgcttcttcaatatctcgtcaattgcaagaaggaattaattctttttttcaatgtttgtttaccatttcagctggtcttttggcgttctgatgttcgaaatcattacattgggcggcacaccgtaccccgggatgcaacctgatgaaatgctactgtatttggagtctggaaaacggatgatacagccagacaattgtcccgatgactagtataattttcaaaaaaaagaatattgaaaatgttcaaggtggtctgttcccaacccccccccccctaccgtagttctttaaaaaaaattcaaacatagaaattttcaagagaaaaatcttcgaaaattttttaaaaaactcaagaaaacaaaattttttgaaaattgctgagttttataaattttttttaagaattcatgatcaatgaatgggtttcaagaaaaattcctgatccgggtgcatttttgaaatatatccggatcaggttcatctgtaaaagtcttggtaaaacccgcccacggtcctattcatgtctctaaaaagtttgtgaatatatatatatatatatatatatatatttaagttatcgtgtgatgtgctcatgttggactggtgacccacgaatgcgacaagattttgcacaaattcggcaacaacttgcgcttcagttggaaaatgtcagcgatgagtaagtgaaaatttagaaaattttaagaaattatttttttaattttgtcgttttttcagatatgcatatctgaagcttgatgccaaaaaagattattacaatgtcagctacg

SEQ ID NO: 63001 - DNA, 256 bp, Heterodera glycines
  Genomic contig location: Contig_ID=SeqID_32746; Location=226..481; Strand=-
  SCN-specific regions: Sequence locations=1-256
atgtcggaagtcggaactcggaattccgtgccatccctgatcggtatgttaaatttggtgtggatttaacgtgcaggaaaaaagttaaagtcacgaagtaaatgttgctctttacagcttttttttcttttttaccgtccatgatgcagggactttccccaatcaaagacgcttccaattaacgatcatcctcagtttaccataattttccatattaagtcgaacatacgttcttggcataaaccaaaagattaaa

SEQ ID NO: 63002 - DNA, 963 bp, Heterodera glycines
  Genomic contig location: Contig_ID=SeqID_32747; Location=1..963; Strand=-
  SCN-specific regions: Sequence locations=22-375,397-401,424-443,465 -963
  Gene Ontology: Mol. function=glycine-inhibited chloride channel activity; Cellular component=integral to membrane; Biological process=cell surface receptor linked signal transduction
ttttacaaatcattgaattaattttgcgaaattggcttttcctttagcatcactcttagcgttgcgtgcaatttggagctgtctctgtacccaatggacagtcagaagtgccgaatcgaaatgctaagctgtaacattggcaaacgcctcttgaaagcactgcgaaatttcagatgcctatgtggaaagacagttgctcatccgttggtttgaccacgtcgacccgacccggcacaatccgagtttataaatgagaacaataaattaattaggcttaataaattaggctaggcactttcagacattcagttgcccgaattccgcatctccaacataaccagcggatattgcagcggaaattaccaatacgcaattatggaacacacgtacagaagaggcatcatcataattattatcattaatgaaatgaactttccatttagacaatttcagctgtttggtggcaataatccatctgaacaggcaaattgggtaccacgtggtgcaaacgtatttgcccacgggactaattgtgatgatctcatgggtatccgtccaattagcactcattagcgattcatttattgtccaggtttccttttggattgaccgaaggtttgtggcgcatttgccaattaagcgtccgtcgtcttttaattagggctgtgcccgcgcgagtgaccctttccttcacgacaatgctttccctttccactttggtaaggctgaagcaaagatcaaaatgtcattttaatttatgtgtgattacataattggtttatcaaagggcaatggccttcgcttcggactgccccaagtcgcttatgccaaagcgattgacttttggtttggcggtaattaacgtttaattaccctcgtaataagttcaattaatttttcccttttcccctttttattagcttgtatgtttttcgtatttttgagccttttggaattcgccgc

SEQ ID NO: 63003 - DNA, 52 bp, Heterodera glycines
  Genomic contig location: Contig_ID=SeqID_32750; Location=157..208; Strand=+
  SCN-specific regions: Sequence locations=1-52
atggcattaagtggcttttggactgaactgtccactaaaaacgctgatactg

SEQ ID NO: 63004 - DNA, 271 bp, Heterodera glycines
  Genomic contig location: Contig_ID=SeqID_32751; Location=117..387; Strand=+
  SCN-specific regions: Sequence locations=1-237,259-271
  Gene Ontology: Mol. function=saccharolysin activity; Cellular component=mitochondrial intermembrane space; Biological process =proteolysis and peptidolysis
atgcgtaaagctgatggttctttgcaaaaaccggtcgcgtatttgacttgtaacttcaaccgcccggtaaatggtaaaccggcgctgttcactcacgacgaagtgatcaccctcttccacgagttcggtcacggcctgcaccatatgctgacccgcatcgaaaccgctggtgtttccggtatcagcggtgtgccgtgggatgcggtcgaactgccgagtcagtttatggaaaactggtgctgggagccggaggcgctggcgtttatctctg

SEQ ID NO: 63005 - DNA, 326 bp, Heterodera glycines
  Genomic contig location: Contig_ID=SeqID_32754; Location=34..359; Strand=-
  SCN-specific regions: Sequence locations=1-27,49-230,252-281,316-326
atgcctcaagacgaattcactgtcaagttaccaaattttaccgctacattaacggactggtacaaattgtatctacggataagaaaaaacgcgtattttcatctatttctatcaggaagaggaagtaaaatatcgagccccttcttcttatcaggggtgggttatgaggactgaaatagactttgacgagattattacgacttatttggttaaaggtagattgtcttcatttgctcaaataatcatagaatcatttgtttgtctctttgaaaggtattttcttttttattttttaaaattatctttattattttacagagaaatga

SEQ ID NO: 63006 - DNA, 687 bp, Heterodera glycines
  Genomic contig location: Contig_ID=SeqID_32756; Location=77..763; Strand=-
  SCN-specific regions: Sequence locations=1-338,372-515,537-664,686-687
caaaacccattggaaatctcgaagaacaatgtgcccagctcagcacagatctgtaccgtctggtccataaataccaggcacttcgttctgctgttcgtgaacttgctcgtgcatatcaacacacccgattttacccattagttccacgctataatttggtaattaattaattaattaccatttaattttaaatcaaaagatttgtgttgtaaattttaaatatctatatagaatttttaagttaaaagcaatgatcaagaggttattgagaacgccggcagtggtggaattggattcaaattttgagtgatttactacgaacacatatcaattgcacaaatttgtattcattttatttaaagaaaatttttgaaaatggtgaattgcaacaaaatgaataagcatgtctcaaaattttgcattaattttcttcaacctttttttttgttgaaatttgatttttttacagtaatatgaaaattgatttacccaattaaatataacatgatttccggaaaaaattcactttaaaaatcaattgaaaagttttttttagttaattgctttataaatttgctcattaatattaaattcattggaaatttttttttatatgtatatatgtaccacttgtgacccattttttttctcaattggccggcataaatttcaaaaaattaaaataaa

SEQ ID NO: 63007 - DNA, 239 bp, Heterodera glycines
  Genomic contig location: Contig_ID=SeqID_32760; Location=30..268; Strand=-
  SCN-specific regions: Sequence locations=1-56,78-239
atgtacaattcgttgaaattaatgtggttcacaatgtaaatttacagatggcaaacagacgacataacagcagcagccataattatagtcaagcagcttgtcatggcttggtacagttttgttgatgcgatggcacttttaaatcatttaaatttagcaaaaccggcacattgggcgtaatatcagaagtcggacacgaaaaatgccgaggaaccgctcggaaatcaatttttgtgtga

SEQ ID NO: 63008 - DNA, 2107 bp, Heterodera glycines
  Genomic contig location: Contig_ID=SeqID_6827; Location=67..2173; Strand=-
  SCN-specific regions: Sequence locations=1-115,138-173,195-358,380 -661,683-841,863-971,1008-1138,1166-1332,1375-1599,1621-2107
atgcaatgtacggtcaaacgtgggaacgagaacacgacaattgaaaagtcggtctgcaaaagctcaaagaaatgtgtggactgtggcgtattataccgtgtggcggtaattcgtgtttttaaaaattaaaaaataaagaattcacaggaccaagacaagaaaaatggtcatatttgtggccaaaaattctgcaaggtctgccttggatttcacgcaccgcgcgactgctacatcccctatcggcccaaagtcaagaaggtgaagcgttttgtgttttttgactttgagtgtacaacgaacttcaagccggacccgcaactgatgcgattcaagcatcaggtaattttttgagtgggtaattaaatatgaaaaattaaaaggtcaacttctgcttcgcccacgtgacttgcaccaggtgcattgaaaagggcatatgggaccaggaattggagatggcctgcgcgctttgtggccgattccgaacttatgcctggtccccgttcgaattctggcacacggacgtggaatgccgcaaggtcgtcgaagacccactggcagccttcaccaagtggttgctgaacttcgaaacggaagtcctcggcatggagcccggagcgaagaagcgcagaaagaggaagaatgccgaaaacaccgacggcgaggctatggaatgcgaagaagaagaggatgccgtagatgaggacgccgagaacaactggatgctggggtacgaagaagccggggagaagccggagtcggtgacaacatacgcgtacgcccacgccggtaattattttaaaaaaaacttggaataaataaaatttaaaggttcccgctacgatcatgtgctgatttatggtgaaatgctgcgcatgggtgtccgccctgaactcatccgccaggggaaccatctcctggaaatgaaggcccgcaaaacaggagtctacacaaccaccgttttccgggacaggtaaatattttgaatattaaatatttttaaaatttttgatcacttcagctacaaactgatcccaatcaaactggccaactttgtcaagacgtttggtctggaaattgagggcgtggaaaacaagaaatattttccacacaaattcaataaggtaagggtggtttattgaaaaattaataaaaattaataaaattacaggctgaaaattacggcactgtattggacactcttccgccgatggaggactattacccaggtggactctttccggcagagcgcgcaaagtttgaacaatggtacgacgagaaccgggaaactgggtttgagctgagcgaggtcattgcggactactgcaagacgggtaaaaaattataaaaagaagaaaaatttttaataataattttgaagatgttcaaatcctggcgcatggtatggtaaagatgcggcagctgttcttgtccgagactcggcatgacatcacggattcggtcaccatcccgtccggctgcatgaagtattgggtgcagttggctcaccacgacaaagagcgcgtcgccatcatcccacacttgggatacgagaagcgcggcaaacagagctccatcgccaggaaatatttgaaggtgtatccaaattattttaattttacattttgtcgactctcagtggcgtgccgaagaagaattgcgggagaatggccgagtcctgcgccatgtcgaaagccctggaggggagttcaaattcggcaactacagcttggacgggatgatggagcgccctgatgaagacaaaaacttggccatcgaggtcaatgggtaaggaaagaattcgaaaaatgtgccaatttacccattcaaaaggtgctattggcatggatgcccaagctgctttcccgacgatgcggcaattgtgggcggaggagaaacggccggagccctcagggcccgtgatgccaagcgaacccgggacattgcgcgggagttcgaggtggaaatcatctgggagtgccacctgaacgcaatgctggaggacaacccagccatgaaggcgtacttcgacaactgcccggactccggaccaattgacttccacgacgccttctttggcggtatttttgggtttaaatttgcaaaataa

SEQ ID NO: 63009 - DNA, 855 bp, Heterodera glycines
  Genomic contig location: Contig_ID=SeqID_6828; Location=35..889; Strand=-
  SCN-specific regions: Sequence locations=1-175,197-349,405-855
atgagccaatattccgacaattccctcccccctaccctcgacggaccgtattcccctgttggggatgacggcaccgaattgatggacgaagcaccgccattggatgaggttatgaaacgccttccgatctcggttagtttttacgaaatgtttttctaaaattcttttctaattttgggagacattttcaggttgtgccatcggacaacaatgagcgcaaggcccagaaggagccgtcaattacccgcgaattggaggcggaattgttcaacggcgatggctttacatgtctctctgccgaacaggcggaagcgggacgttttaaaggtgtggttgtaaataatacatcatataaaattattatttaatttatctatgaaaattatatttaaaaaaatttttttgttgtgctttgattgattgaggtatttttttttttaaatggtgtttagcgttccgttttattgggcaatttttgatgagcctaacgtttggtgctgtttttccggaggacattctgcgcaatttattcaccatgtgcctttcttatgcctccgagggggccaaatcaatgaaaatatccgcggaccacttcattttccttctgacgtcaaaacaccttgactacgaagtggctgtacactttaaaaagctggacaactcggcaacagaaaaaatcctgacgcgttttgaaatggtcgaccaaagcaacaaagcgaaggaaaggccatcactccttgaagaaccatttataattgacatcacggcaatcgagagcaagtgcgccaaaccgaaaatggctggaaaagggcgtaacgacttcaacatcgactaccgtattgccgatggtgcaac

SEQ ID NO: 63010 - DNA, 504 bp, Heterodera glycines
  Genomic contig location: Contig_ID=SeqID_6828; Location=3433..3936; Strand=+
  SCN-specific regions: Sequence locations=1-139,175-200,257-422,455-504
atggctggcgctcagttggcccgcgctcacttggcggcgctcaaatggctggcgctcagttggccatgcacccctcccacgcctatggggggctaccgtaatccggtgaaatctacaagggtaactactaagattaatgaatattttaatactcattttaaattaaattaaattctcttaaaggactttcaatggaaagcataaaaaatgttaaataataaaattaaaaaataacataattaaaaatttaaaaaaagtggtgaatcaatagaatacacagattttttagattacccgcatataaacgatataaaataatccgaaattagttacaataataacattaaaatcaagttatcaagttccaaatagcaatcattgggctaaaactaaatattttaatgaatagtgaatttaaacacattaataaaaaaattaaaaattaagttattaacagcatcattaaatgtggacaaaatattttaattaaaccaaaagcataaa

SEQ ID NO: 63011 - DNA, 223 bp, Heterodera glycines
  Genomic contig location: Contig_ID=SeqID_32765; Location=363..585; Strand=+
  SCN-specific regions: Sequence locations=1-86,109-223
atgtccacggaatgttcggaagggaaagagaacgaaaatcggaggaaaagcgcacaaacagcagaagcagtagcagagaaaatcggtgggtgagcagagagcatggggaggggagagaagtgccgaaaaacctttccagtgagccagacaatggcatcctttccatcgaagttgtgccgagtttggctggaaaccctttacacggctatcgcttcgtcgatcg

SEQ ID NO: 63012 - DNA, 310 bp, Heterodera glycines
  Genomic contig location: Contig_ID=SeqID_32766; Location=308..617; Strand=-
  SCN-specific regions: Sequence locations=1-310
atggaaagtgattttgtaagaaaatttttagatttttttgtcatgacaccaattccgaaggttacaccgactccctcccgccgaacttcggcattccttcaccttcaacgacgtcgacagtgtcgtcggcttggtgtgcaaatggacagtacggacttctacagagcgcctgagtatcgtaggggcaccgagttgacgagaacgggcttggctcagatggcgaacgaaacatttgaaaatgcaaaacaaagctaaaaaatgaaaatgcgcaaatttatgtaaaacagtaaaaattcatttttttaataaa

SEQ ID NO: 63013 - DNA, 71 bp, Heterodera glycines
  Genomic contig location: Contig_ID=SeqID_32767; Location=197..267; Strand=+
  SCN-specific regions: Sequence locations=1-71
tgtccgtttggggtactcaaacatttatggaggagcaaaaatccaacgcagaattaaagtacaggctatag

SEQ ID NO: 63014 - DNA, 49 bp, Heterodera glycines; identical to SEQ ID NO: 51181
  Genomic contig location: Contig_ID=SeqID_32768; Location=319..367; Strand=-
  SCN-specific regions: Sequence locations=1-49

SEQ ID NO: 63015 - DNA, 98 bp, Heterodera glycines
  Genomic contig location: Contig_ID=SeqID_32769; Location=205..302; Strand=+
  SCN-specific regions: Sequence locations=1-98
tggagccaatttcggaggacaaaattgtggacaccaatggggcgggcgatgcattttgtggaggtattgtaaaagtgaatgcattaagttgtggataa

SEQ ID NO: 63016 - DNA, 169 bp, Heterodera glycines
  Genomic contig location: Contig_ID=SeqID_6830; Location=270..438; Strand=-
  SCN-specific regions: Sequence locations=1-123,145-145,167-169
atgaaaaagagtttttatgagcagaaaaaggtcaaattcattgaacgatttggtgaatttaaagaattatatggccaaggcaaacagaaagaatttgtgaaagaattgggcatttgtaaagaaacatttataaaatggaaaaaagaattactgccaaattatcataaaa

SEQ ID NO: 63017 - DNA, 331 bp, Heterodera glycines
  Genomic contig location: Contig_ID=SeqID_6830; Location=1691..2021; Strand=-
  SCN-specific regions: Sequence locations=1-93,121-331
ccttctaagaatttcgcccagaatttccgccaaattttttcaggaatttcataaaccaaaatagaattagtatatattactaagtttaatggttttatttatttataaatgaaaaccaattttaagaataattttcctttaattcgatttcacaaatcgtttaatcatttgtaagaaccagcattttgaaaaacaatctttttaccatgacataaaaagaaacgaaaaaaaggttagagtctcaactaaatgatattgtaaatttcgaaactattcatggtcatcaacaatcatgatcaaataaaaatcactgatcaattggatgagagca

SEQ ID NO: 63018 - DNA, 990 bp, Heterodera glycines
  Genomic contig location: Contig_ID=SeqID_6830; Location=930..1919; Strand=+
  SCN-specific regions: Sequence locations=1-990
atgaatttatggcctttaatattcattattttttgtatagcttataaaattgaatccggcaaaatccgaccaaattttgatgaaatattcggcgatgaatgggaaataaatgaaagtgtagaaaacggagaagaaaatgtaatcaaatcaattggtcaaatgcaaaatgatcaaatttttaaaaatgatcaaaatacgaaagaagaaccaaatgatgaacagaaaagacaaatcatccgaaaatatgaagccataaaagaaaagttgaagcaaagaggaaaatttcaacggaaaaaccaaagcaaaattgagacgaaaattggaaaattattaggcgaaagtcgctacaaaatatacaaatggaaaaaagatttgaatttaaataaaaagaaaaacaacaaaatgaaaaagagtttttatgagcataaaaagagggaattcatacaacgatttgaagaatttaaaagtttatatgcccatggcaaacagaaagaatttgcgaaggaattgggcatttgtgaaaggacattttggaaatggaaaaaagaattggcaccaaaataccataaaagtcaaagtaagaattattttagtgaaattaaattgtactttttctttaagaacatcataccaatgaggacaaattgatgaagatgaagcattatttgcaaataaaagaagcaaatccaaaaatgagtgacgaattaattgccaagaaattgggaattggaagtgcaactctgaaaagattgaaaaaggaatgctctcatccaattgatcagtgatttttatttgatcatgattgttgatgaccatgaatagtttcgaaatttacaatatcatttagttgagactctaacctttttttcgtttctttttatgtcatggtaaaaagattgtttttcaaaatgctggttcttacaaatgattaaacgatttgtgaaatcgaattaaaggaaaattattcttaaaattggttttcatttataa

SEQ ID NO: 63019 - DNA, 371 bp, Heterodera glycines
  Genomic contig location: Contig_ID=SeqID_6830; Location=2807..3177; Strand=-
  SCN-specific regions: Sequence locations=1-130,160-200,222-371
atgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcggagggaagagcatgatgagttcgatcaatctgaagaggaaactgacgaaatttcgcttatcaatgtcatttattgatggtgatttagaaaaagaaattggtgatcgacgggagaagaaaacaatggagaagagcaattcgattttgaatagacacagttcgataaaaggttttcttcgtttttacaggaaataaa

SEQ ID NO: 63020 - DNA, 919 bp, Heterodera glycines
  Genomic contig location: Contig_ID=SeqID_6830; Location=3731..4649; Strand=+
  SCN-specific regions: Sequence locations=1-65,87-99,123-357,379 -688,710-775,797-919
atggaatgtcatgcagtggctggccaacccgtacctcaacgcggtgagaacagaggagacaatgcaaaattggcagaaagcaaaatgcgttcccgctcaaaatttttggattttttaaaatgaaaattgcaaattttaaagctgacttaagtataattcaattgctcccattcaggaaaaggaggcgccatatttggagcgttatgggaacatcaacgacgaatggacacagcgaacggtcgaggcgaaacatcgcaaaatgcccaacaaaccgaaaatccggcaaattgcatctggcgaagtggagaagagacgtgccaatgttggcaatttcttacatgcccatcggacggtggaggacgaactgaagaatttggagcgcagaaaccgatgggactgaacaatccatcaattcaatttccttgtcatttcaacaaatcattgttttagctctacttatatttgctggccacataaaatggggttgttcgtttggatttgggtagttttttgacaaacggcggggggatagcgatgattaggagagaaatgcaaaaaaacgggacaagagagaaatagcacatggaaagacagtgaggggaaaagagagggtgtctttttctgtcccgagcaatgaaatgctacgatctcactaatttgaggtcaaaatggatacatttttttatccaaacacaatacaccacatacaatccgcataacatataatacacacgtatgagcgagaaatattaatacataacacatgttcagagaaaaacatcacatatatgatcacaacatcttagtcttctcttctcgcttatgcaaaaatgagcgccagcacatgcagaacgcgtcccaggagcttgtacgggcccagcaaggcgaagcttctgtttcgatccacctaaaataacga

SEQ ID NO: 63021 - DNA, 906 bp, Heterodera glycines
  Genomic contig location: Contig_ID=SeqID_6830; Location=4498..5403; Strand=-
  SCN-specific regions: Sequence locations=1-877,899-906
gtgtgggggggggggggaaacccatggaatgttcatgtgccgcaattcccttcaaacggaccaccgcaaagcccatggaatgttcatgtgccgcaattcccttcaaacggaccaccgcaaagcccatggaatgttcatgtgccacaactcccttcaaacggaccaccgcaaagcccatggaatgttcatgtgccgcaattcccttcaaccggaccaccgcaaagcccaaggaatgttcatgtgccacaactcccttcaaacggaccaccgcaaaacccatggaatgttcatgtgccgcaattcccttcaaacggaccaccgcaaagcccaaggaatgttcatgtgccacaactcccttcaaacggaccaccgcaaagcccatggaatgttcatgtgccacaactcccttcaaacggaccaccgcaaagcccatggaatgttcatgtgccgcaattcccttcaaacggaccaccgcaaagcccaaggaatgttcatgtgccgcgacgctcatcaaccggaccaccgcaaagcccatggactgtgtctcgtcctgaccatttgattgaacatgcgcatcaactaaatgtggtgccttcagcgtctcttccgtcagatcaaggtggggctcctcaacttagactttaccatagcattaattgattttccttcagtgcaaagttcggcgcgtcaatttgtgtagccgcggttgtcttgcgggtaggaaaatcgttttctttatttttgagatatttattcgttattttaggtggatcgaaacagaagcttcgccttgctgggcccgtacaagctcctgggacgcgttctgcatgtgctggcgctcatttttgcataagcgagaagagaagactaagatgttgtgatcatatatgtgatgtttttctctga

SEQ ID NO: 63022 - DNA, 272 bp, Heterodera glycines
  Genomic contig location: Contig_ID=SeqID_32772; Location=151..422; Strand=-
  SCN-specific regions: Sequence locations=1-166,188-272
ttgtaccaaactatgtgcaaggcagtcagaccattgaagaaacagttccaaatattgtcgaaacaacaccggaacggaaaaggccattaatgaccattcaatgtcaaatggcaccgaaacttcggacattgaaaatgccattaatgtcgattcaataccaaatgtcatcgaaactttggacactgaaaatgcccataatttccattcaatgcaaaatgttagcgaaaacaatggacaatgaaaatgccattatttacaataaaaatgaaaat

SEQ ID NO: 63023 - DNA, 450 bp, Heterodera glycines
  Genomic contig location: Contig_ID=SeqID_32775; Location=280..729; Strand=+
  SCN-specific regions: Sequence locations=1-10,33-100,131-131,156 -335,358-385,408-450
atgcattggtttattgttttggttttgattttgaattcaatttacaattctaatgcgttttttcattcgctggattcagcaactccgggaggtaaattcaaatgaattaaaattattttaagcattgattgtttttaaaatttttaaaataaaatccaaaaatttagaaatttttgcttttcagcttgtcctctcctcgtcccagccccttgggtgtgcgtgtgcggttgccagaaatcagatataaaaaaaatttcgtcgagttacggtggcgctgatcacagtagcagtgatggtgatggaggctacggtggaaatgagagcggtggtggaggggaagaaaatctgaagctaaagattggcaaagtgaaggagtattgcggctgccaaacagtgaatgtcacctgcaaatcatgcgaatcggagcaggaaaacccaatacatattgag

SEQ ID NO: 63024 - DNA, 258 bp, Heterodera glycines
  Genomic contig location: Contig_ID=SeqID_32777; Location=38..295; Strand=-
  SCN-specific regions: Sequence locations=1-37,62-96,142-258
atgattgctcaatctgtgccgaacattggccattattatgaggaggaggaggaagtgatggaagacgaggaggaatattcatacgaagagattgacgaagaggaggaggaagaagaagaggaagtggagaaggaagagaagcgaacagtcgccgcaagggcactgccagcggcgcaattggcggaggacggcggacagaacggcactgcccagggcaatgatcaacttgccaatttggcggatgagtgccgcaggaaa

SEQ ID NO: 63025 - DNA, 60 bp, Heterodera glycines; identical to SEQ ID NO: 52045
  Genomic contig location: Contig_ID=SeqID_32778; Location=535..594; Strand=+
  SCN-specific regions: Sequence locations=1-60

SEQ ID NO: 63026 - DNA, 291 bp, Heterodera glycines
  Genomic contig location: Contig_ID=SeqID_32781; Location=261..551; Strand=-
  SCN-specific regions: Sequence locations=1-291
atggccattaatattagtgacaaaaaatctttgatggagaatattttggctgccgttgagattagtcagactgctaacggtataacagttagcagtgaacgcatagctatgccaaggacgattcagtttgacatcctgggaaagtgccgagaatgtaagggcactgaatgtgaggcggagtggtgtgttaccaaagaaggagtgacaatttggtgcacccgcttcaaaatcagtcctcgatttgtgccttttgatgtaatttatgatttgccaggctacacatttttcaag

SEQ ID NO: 63027 - DNA, 2900 bp, Heterodera glycines
  Genomic contig location: Contig_ID=SeqID_6831; Location=34..2933; Strand=+
  SCN-specific regions: Sequence locations=1-322,350-426,450-502,549 -778,813-818,844-1510,1588-1750,1772-1957,1991-2130,2152-2157,2179 -2667,2689-2900
  Gene Ontology: Mol. function=nucleic acid binding; Cellular component= cytoplasm; Biological process=reproduction
atgtatttttgtgttttgcctggacctggattttttttcacatttgacctggacctggatttcatgacaaaaacccaggaaatccaggtttcgaaaaatggcctggacctggatccaaaaaaatccaggcctggacccaggtccaggtcgagctctagctaattcttatttaaatttgccctttagctgcaaaatgtgaatgtgagcacaattcggagcatcgaagatgctttggtgccgttgatcaagttcactttccaatttgatcaaaacactccgatcgatttcgacattggcctcgtcacttttgatccgaatgagcaaatattcaaatcaaaaatgccattaaaatacgagcaaagcaacgcattgtcagcaaaaattgccaaagaaattggcgagttatctgaacagagaaaacatttcggaggaggagaagttggagagaaaaacattgatgagaagctgaagaagaagctcagatcactttcaagtgggcgacattttttaattaaaggaaaataagaaaattttattaaattaatattcttactaaattcgttaaaagccctcggcttcgaaatttttctggttacgccttaacaaagaaactgtaagtctgaaaatgcatatgtgttatatactattggatagagaaaggtcgatttctgacatattaaaatgtttaatattacgggcccataggcaaatattaaaaaagttatggggcctcaaaattcaaaattttgcctgtgttttcccttcagcgataatgcccaataaaaaatgaattttaaaactgttttcttttgctatggactaataaatttatttatttatgttgagtttgaacccggacctccaaaaatttgaatttaaccaactgagccaatgattttgctcatttgcctcacttggccaccttcgctgaagggaaacacagacaaagtttcggcttttgaggcccataacttttttaattcttgctatggcacgtaatattaaaaacgcatagaagtccaccctgctctctctatacaatggtatataacagctatgcatttttcgacttacagttcgggtggttcccttgtataagacccaacctcctgagattttcatattcgctgttgacaataagctatatagagtttaatttttttctttttttaggtttcgaagtcagctcaataattttaaagcgaattttggccactgaaaatacagaaaatggaaacggaaacattttacaaatctatcgcacttttttactgatgatcaaattttgggcaagaggtaataatttaattttcacagaaagtaataataaattaacaattcttttgccattggcactttcagagcatcacatttatgacaacaaattgggcttcttcaatggcattagtctctcccttttggtggccaaagtgatgcttctttacccaatggcatcacttccttttctcattgaaaagttcttcttcaccttctccacatggtcattttgttttaataatttattttttaaaaatttttaataaaattaaattgtcacttttttttattttaaatgtataaattattctatgcatttttttaggccttggccaaccccggtaaagctgacagatttgccaagcttgtccattcttcgctggaacgcatccgatgagagtgacaaacggggggtaatttactcgagacggggcctaatgcccggactgacaatgccaattgtcacgccgggacatattgaacaaaatgccactttcaatgtgaaccgatccaccgcaacaatcattcagcgggaattgcaaaacggtgaatggaaagtcgggacggaattagccgcgggagagaaatttgttagcggaaaatccgggatatatataaaagccgagaccgggagcagcagtcaaacccatatccctcacaaatcagttttgtataaacaatgaaaaacaattatttatttttagctattaaaatcattcgaaattggccgatggatttgcaaaatttgcaagaagaaaaatgggaaaatctgttaaaagataaaaagtttgaagaaaaagtaattttaaaaaagaatatttctacaaattaaaattccaaatattttttcccgcagttttcccatttcattcgcattaattgcaaagccttcgctttggccgacttttacgacttttgcggctacgtggagacgcgaattcgtctccaattgctgatcgatgtcgaacgatttgatcgcattcgattggcccatgcgaagcaaatcgttgaaaagggacaaattttgggagagaatgaaaagggcgatgaaaatgaagcatttccagtgtcaaaaaggtaacggtgggatggcacaaattgaaattggcactattttaagcggtggttggtgggtgaacggcttcaactatattactgggatgttccaattttttatctgaaaatcgttagaattcgcttactgagaaacaaaaactgaacggcacaaaatcggcacacatttggggatacactacacacaaagggtaccaaacattttggggaccgtacatttatggtcccttctctaagtcggactaatccaaaaagtcactctccaaaaaaccgaatttcacaaatagcaaatcgtgtaaaaattcaattatttggataatattaaatttaattaaagtgaacattatcaaaaaatttggctaattgggcttgaattggacgataaaatcgcagcagtgggagatgagtggattcagagattaaactcaatgctttttcatcaatttgacgcgaccattgagaaggcgtaccgaataaagaagaatttggcaaatgaattgatacaaattgaactaaaatcgaaatatgaaaaagatgaaaattattaa

SEQ ID NO: 63028 - DNA, 215 bp, Heterodera glycines
  Genomic contig location: Contig_ID=SeqID_6831; Location=2133..2347; Strand=-
  SCN-specific regions: Sequence locations=1-136,158-163,185-215
attctctcccaaaatttgtcccttttcaacgatttgcttcgcatgggccaatcgaatgcgatcaaatcgttcgacatcgatcagcaattggagacgaattcgcgtctccacgtagccgcaaaagtcgtaaaagtcggccaaagcgaaggctttgcaattaatgcgaatgaaatgggaaaactgcgggaaaaaatatttggaattttaatttgtag

SEQ ID NO: 63029 - DNA, 159 bp, Heterodera glycines
  Genomic contig location: Contig_ID=SeqID_6831; Location=4541..4699; Strand=+
  SCN-specific regions: Sequence locations=1-73,95-159
atgctcacccatttgtctctgccgccgatggcattgcctttggcggtggcgaaattggaggcgcaggcaccgatttttcagccaccactttgctgttgttgaagaagttcagcggagagccgttgaagaaactcaagcgcaacgcagaagaagaagact

SEQ ID NO: 63030 - DNA, 694 bp, Heterodera glycines
  Genomic contig location: Contig_ID=SeqID_32782; Location=13..706; Strand=-
  SCN-specific regions: Sequence locations=1-5,28-51,101-192,218 -523,545-672
atggtgaaaaggagaaagagaaaaaatcgaaaggaacaggccgaacctaaccatgaaaaggaagagcagaaggaaagggacgaggaggacgaggacgacaacctcccaaccgccacgtttcagcctcgaaattctgtccgacccgggccgaatggacgcgtacatccaccaactgaaggaggttggaaaatgcatcttattttttaaattttatccccattcccacgcagtttgtgtacaacgtggaaacccttcggcgcgacatgcacggccccccgccgttgccttcctcaatggccgccgcacttcgccaccataccaatgtgctcagtccgataccttcctcaacttcttcctcacttttgtcctcaatcggcacaagccaacaacagaaccaacaattgtcagcaatttccatcaaagagttgaagccgccgattggcaattcaataacagcaaaaacggaggaaggaaagggcgaaaagcagcagccgaagcaaacagttcgacaagagaacacgaagaggagcaaagggacagaaacggccgcgccgacacggacaacagccaaaagggagcgtattgaagacggaggtaaattggagagggtacactattcttcaaaaattcgaatttaacaaactaattgtaagccacttgggcactaattgtaagctgaagagaaaacaataaa

SEQ ID NO: 63031 - DNA, 311 bp, Heterodera glycines
  Genomic contig location: Contig_ID=SeqID_32784; Location=65..375; Strand=-
  SCN-specific regions: Sequence locations=1-92,155-259,282-311
atggagcaaaaagcggggtggaatgccactgttgtgatccccgaatcaccacggatattcggcatcccttttgtggaccttttcgctgtaagaaatttaattattaattttttaaatttctatttataataatttaaattttaatacaaaattagggcgagttcaattttgaatttctgttggaaacggagggaaaagagattgcgcatttggaagtgccgacgaatttggcatttgtgccaatcggaatgcaaaatgaggaggacgaagacgaggacgacggaaaagggcaatgttagcaaaaaaataaa

SEQ ID NO: 63032 - DNA, 626 bp, Heterodera glycines
  Genomic contig location: Contig_ID=SeqID_32790; Location=258..883; Strand=+
  SCN-specific regions: Sequence locations=1-366,388-393,418-436,458-626
atgcgtcgtctgttggaagccgaccagcttgcgctgggttgtctggacacatggcttatgatgaagctcagcggctgtgatgatcaaagctttgtcaccgaaccttccagtgcttcttccaccggaatgttcgacccgttcacggtgattgctcattcattttcccagcgtagttaatcattggtccatgcatttaactctaattatacattaattgattttgttctacattaattaggccgagtggggccgtcccattttgcgtctgctcggcttccccgacccgggcgcggtgctcccgtcgctggtcgacacgacgcggctcggcgtgcacacggcgcccgagctgttcggccgcgcaattccaatttttgcatcggtaaaaaacgacggatattttttaaattaattttattagtcctatcccacagtcaaaaacaataaaattgaattaattagtgtacaatatttttttttagctcggcgattcccaagcggccgcgttcggtgccggatgcattcgccgcggggacctgaaaatctcactgggcaccggcactctgttcgactacgtgagcgggcccgaaattcacagtcaatgcatggtcgggcgggaatggtattga

SEQ ID NO: 63033 - DNA, 556 bp, Heterodera glycines
  Genomic contig location: Contig_ID=SeqID_6832; Location=693..1248; Strand=+
  SCN-specific regions: Sequence locations=1-38,60-148,209-376,406-510
atgctttatctgccaattattaaaaatatgatcaaaaagttttttggcccattatttttcgacttggctgcaagcatgctgttcactggcttaattgtgttggtgcttatcaaaacaaattttgagtggctccttttttatgatgtggtaatttgaatttgaatttgaattaaatttgaatttattttattttaaattttaattttatgcaacaatttggctcatgtggctagcaattgcttttatggtgaacttcatttgttatgtgcactcatcagccgcagcagcgcaaatccgccatacagtaaccaaaaataattaattgtatccataaatgacactttaaatagttttataagtgtttgttttaatagacatttttatatatttttaaaaatatttttagagtccaattgccattccgcatccgacatttatctgcgcatttgcactgacaatttgtgtgacaatcggatattgttacatttttgtaatattttttcgttattcaaatataaattgtttataagtaatattattttatcttattttttaa

SEQ ID NO: 63034 - DNA, 1116 bp, Heterodera glycines
  Genomic contig location: Contig_ID=SeqID_6832; Location=1375..2490; Strand=+
  SCN-specific regions: Sequence locations=1-127,162-420,473-496,518 -652,674-758,816-819,841-962,1020-1116
atggcactttatggatgcgataaagccgtggaggcacaacattggcacaattatgaccttggactccgtgttacgcttaacaatttctgcgttcgctttggtttcgttcatttacataatccaacggttatttaattttaatatttttattacaaataattcatttttcggtaaatgattatttacaaaattcagctcttacgtcggcagtttgcgtgacgattttgatccgattgccagaaacacaattaattttgtgttcggtgtgatttggtgccgctttttgctcctcaaggcacttttcataatcgaggcataaataccaagtatttaaaatgaaaatttaattcaattcagcaattttgtcgcgataacaccgaaatggactccgtcatcaagaatctttgtcctccttacatgtaaaatatttttgaaatatttttataattttcaattgataaatttattaattgtcctacaatttgttcctgaaacaaacaaaaatgatctttaaaatctcaaaaatctcttgctatattgggtgagtgcataattattgaacagctcacaaaacagcaaaattcggttcaaatgcttcacacaatgagtaatcgtttgcattgtatgcgtaaaagctgagatattccataatttatagaggacagattttggcctagcaaaataatttcatctttggaaccagcaaaccaatatttaagagtatttctaaattccttaaaaaggataaaaaaaatgtgaaatatataaaaattaaaatgaaatccaaaattattttaaaatttatttatttttaagcaaaaatggcttccattgcaacaatgcgtcactgaacaaacagcaacagatttggtatcggcttcattatgggcttttaaagtcggcaattgtcacttgtgccgccgaactggtccccgtccttctcgtcggacattggtcagaagattaaaaaaaaaaaaaaaaattaattttaaataaatatttaaattttaattaaaattgcttttaaggattgcctgtggacatgcaaaaaaaattgcccagcaaaatttgacacaccgggcaattagcaaattcaaggtgaagggagagcaatga

SEQ ID NO: 63035 - DNA, 923 bp, Heterodera glycines
  Genomic contig location: Contig_ID=SeqID_6832; Location=2745..3667; Strand=+
  SCN-specific regions: Sequence locations=1-82,104-204,296-521,594 -682,732-923
atgcttacgctaatcgtgtcaaaatgctataaaaatgtgatgaaatggcaatccgttttgatctgtgtccttagcattttcctgtggctgttgtgctttcacaattacatcaaagacgacgagcaaagtgttgcggtactcagccaagacattgccgaagtgtttaccggattagtgcaactatgcttcttcataaatgtaaacattatttaaaaaatatatgtttactatactttttattatttgttatttaaatttttaaatgcggttttttatttttaaattcttaaattttcagaaaatttagaaaaaataacttgtttagatccataatttaatacaaaataactaattaattacgcattgtattgtaactttcagcttttcattctcacacgggaaattcccaaggaagggcttgacacggcacgtgctgctcaatcacgtgccgaccacgtgctgctgcttggctcaaccattcttttgacggtggaatgtgtttgtgaggtaaataaaaggacatttaaaaatattgttcaaatttatataaaaaagattttaaatttaaataaatattcaatttttattttttagtgcatagaaatactgcacttctcacacaagaagcaaatgcgcttcctgaccaaatgtttggacattttttacagtattttcacggaggtaataaataataataataataaataattaaaatgttattagattttttagttggccaattggtttgagatttattgtttgaagaagattagtgcgcttaatgatgatttggtccgaaggcttcgcgacactttgccatttgtcgccatttgcggcatcactttgaatttgtccgttttcgtgatgacatatttttacattgaggccgaaaaacaccatttacaggtgaactaacaaggaga

SEQ ID NO: 63036 - DNA, 327 bp, Heterodera glycines
  Genomic contig location: Contig_ID=SeqID_6833; Location=178..504; Strand=+
  SCN-specific regions: Sequence locations=1-139,175-301
atgatcacaagtttgcccaatgattactttgtgttggttggcgttgttgcacgcattttggacaccgccaattacgtgtacacttttaccagcgcactttgttggctcgaagttttgctacggtaaacaaaaacaattgtttaattttattaatttatttaacatattaatttagttataagaagaacaacaacttctttatggttggtaataattttgtgaaagaaggcaatgcaaatcacgcatttgaggaaacggccttttaaaaatgatcaatcccatttaatttaatttttgcatcatttataatatttttataaaaaaata

SEQ ID NO: 63037 - DNA, 478 bp, Heterodera glycines
  Genomic contig location: Contig_ID=SeqID_6834; Location=1078..1555; Strand=+
  SCN-specific regions: Sequence locations=1-15,39-70,92-104,126 -331,353-400,476-478
atggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcgagcgccgaaacgcgtgggtcccgtttgtacagtctttctaaaatattttatgaatttaaaaaaaatactatttttttcagaaaatttttgtgttttaaaagtatttaaaataacaa

SEQ ID NO: 63038 - DNA, 912 bp, Heterodera glycines
  Genomic contig location: Contig_ID=SeqID_6834; Location=1910..2821; Strand=+
  SCN-specific regions: Sequence locations=1-115,145-280,303-306,328 -642,666-723,781-912
atgaataattttctgtcaaaaattttcaatttgatactttttgagtaaggtcatagcacctaattgtcactataagctgattggaccgggataagtgtgatctaactacgagagcacttaaatattttcatatatttagaaaaacaaatctcttaagtttaagtgtgtgaaaaatccgagaaattcctgttaacttaactttggatactgaacaaaaaagggacaggaaggaattttggtaaaaaaaagcgccctatttgactgtttaagttttcttacagtaatgactgcgcattataattaggaaaatataaatgatttacacaattgtttctttcaatttgcatttttttttctaatctaatggcaattttcagctccgtccaattcggattcgccgaaaaaccgttaccaattcgaagacgcaacggcacttatgcttatgatagtgatggccagtttttgattgacggttcaccccaaggaccaaaagccaattcttataatgccggcgatgttgtcggaattggcattaatttggccactcagcaaattttcttcgtcaaaaatggccttcgtttgggttggtgaatagaaattttacggcacaaatcacttagaaactcaatctgcggatagcattttactaaaaacacaaaaaatcatcatttcgctgcctatttctaaaaaaaagtagaggaattcggccttttagcaacaataattgcacagttttcaaaaattattaaaaatgcattaaaactcaacaaattttttgttggcgcgcctacaaaatataatcgtaaaatgaatatttgaaaaaacagcttcaaaccagggcttccatctgtcctggtttgtcagatttgtcttgatttggagataacgaccaaaatttgttctgatttctta

SEQ ID NO: 63039 - DNA, 569 bp, Heterodera glycines
  Genomic contig location: Contig_ID=SeqID_32796; Location=344..912; Strand=-
  SCN-specific regions: Sequence locations=1-100,123-260,285-344,372 -387,416-452,476-569
  Gene Ontology: Mol. function=pyruvate carboxylase activity; Cellular component=cytosol; Biological process=TCA intermediate metabolism
gaatggggagcgggtctctgtaattattgggcattttaaattatttactgtgactgtctttcgaagatcattcgttttcacagattgaagatgcgttcagccgcgccttttccgaagctttgaccgcgttcggtgatggttcgctgttagtcgagaagtacaacttccgatattcggctatggcaataacaaataagcatgtttgatgtttcagattcgtggaaagaccttggcatatcgaagtgcaaataattggggaacattacggaaatttggtgcatttgtacgagagggcctgttctgtgcagcgacggcatcagaagatcgttgatctggcaccggctcctgttttggatccggcaatacgtcagtgaatgttggacgatcctttgaaattgacacgccatgttgggtaactagaacgttggtcagtgtatcgaatgaatcttatcaagaaatgattctgtaaaatcataataattttagtacctgtcgagtttttgctggactataaggggaatcatttcttcatggaagttaatgcacgtcttcaggtggagcacaacgtc

SEQ ID NO: 63040 - DNA, 49 bp, Heterodera glycines
  Genomic contig location: Contig_ID=SeqID_32797; Location=198..246; Strand=-
  SCN-specific regions: Sequence locations=1-49
ggaagctattccggaaggattcggtctccccataattttgggcgcatcg

SEQ ID NO: 63041 - DNA, 466 bp, Heterodera glycines
  Genomic contig location: Contig_ID=SeqID_32801; Location=329..794; Strand=-
  SCN-specific regions: Sequence locations=1-359,382-466
atggatctcagcttggtgttgaggaatgcacgcaaaatgcagccaaatgtgaccaccaattccacggtgcacttctccacagaagcgggcctcgccagccaatcgctccctccgcaatttttggtggccgacgacggcactgtcctcaacggtggcggcgctacagttctcccaccgtctccatccttcgtccccgacgacattggcacggctgcgtcgacgtatgccgctggcgtatctgcgcccctgcaacttggccacattatggacgtggtgagtgagtgtgggcccgaaataaaacattaaaatttcaaaaaaaaattcaggcggctttaacggctcctccataccccattttaccattattttttggaaatttgactccatttcgacataagttgtaacttttacgttataaaaacacttcgggtcttctcaaaaaattgtcaagaaaattcgaaataaa

SEQ ID NO: 63042 - DNA, 3424 bp, Heterodera glycines
  Genomic contig location: Contig_ID=SeqID_6835; Location=348..3771; Strand=-
  SCN-specific regions: Sequence locations=1-386,409-472,494-850,872 -1064,1086-1132,1179-1339,1361-3057,3079-3094,3119-3120,3142 -3290,3322-3424
  Gene Ontology: Mol. function=phosphoglycerate kinase activity; Cellular component=cytosol; Biological process=glycolysis
atgcccaactcatccatagcacgatacgagtcgtcgccgtggcatttaatgccacgaccgagaccgcataatcaaaaataccacggccaagaccacataagcagaaaatgccatgacacggcgatgactcgcagcgttatggatgagttgggggtgactcatcaaaacagttggaatatgccaaagttgtttttttttaattgttaggatggcaaagtgacgagcaatcagcgcattgtggccgctctgccgacaatcaaagtcagtttttattgcttcatgccttcctctattaaaaaaggacccctggtttttttgagaaaaatttatttttggcatgggcgcctgaaaaatcgggttttttttcgtttcggtggtccgtttcgtggtttggttttgcatttttagatgagtcttcccccttccctggtgctcgccagtatttatttcattcgtatattgggtcttgtttttgaagaaatgaattttttaagtcccccccccccctctttccattcactaacctaaattttttgaaaattcgtccctccattaaaaatgctaatgtttctttctccctctcaaaccagtatgccattgaccatgaagcaaagtcagttgtgttgatgagtcacttgggacgaccggacggccaagcacaggcaaaatattcgatgaagccggtgcacgaggaattggagcgactgcttggaaagtacggtctaattagaagcaccccttaattacggaaacggatttccgtaattaaaaagcaaattgtatccgaccccatggttgggaccccgcgccgacatttttgaacagtttcaggattatcatcgacatttccaagcccgaacatcgggttctcaacttttatttctaaatgaatttttcatttttccaagcctgacggcttagaatggtttcaaaatgattttgagtgttaaatttggtccgtagaaaaacggaaattcgacccaaatgagtgacgttgttgtgtgctaattattcatgtttcgtggtcctttttgaaaaaaaacattttttaggacggttgtctttttgactgactgtgtcgggacagaaattgaaaatgcgaccgccgacccaaagccggacaccatcattttgctggagaaccttcgttttcatgtggaggaggagggaaaaggcaaaaattcggctggcgaaacggtaaattttttggcattttacgactaatttttatgggattctttcaattggacccatcgaatttgctgatttgagttcgggtgcggagaacaaatttcttgataaacgcagtcaatttgagaccaactcagtgcctaaacaatttttagaaacaaaaatctcataaaaatgggacggacccctttttcttgtgaattcaatttccatttccgattccaactcaattttagtaaattgcttagcactgatatacaaaaatgcgtttaggtgaaagcgtccaaagaggcggtgaacgcctttcgtgcatctctctcaaaacatggcgacctttacgtgaacgacgcatttggcacggcgcatcgagcgcataggtgaggggtcaatgatggcacattaccactccaggatggggccacctctttaacattccgagttttttttaatacatttttcggggttaccaaacatgaaatttgccatgtaagtattttagcatacattttttcggcttttggaattcaaaaaaacggttgaaagcgcattttgatgtgccgaaatggaaaaaatgtacaaaaaatagtctatttataagatacaatgtattttcaaatcctggttatacaaatgtgagtcctggaaagcttagtatcagcgacgccgaaaaaatgaaattttattcgaaaattcggcgtttttttccagttcaatggtcggctgtgcgatggagaagagggcgtctggttttctgatgaagaaggagttggagtattttgccaaggcactcgagtcgcccacccgtccattcctggccattctcggcggtgccaaagtggcggacaaaattcagctgatcaacaatttgttggacaaggtggacgagatggtcatctgcggtggcatggcattcactttctacaaagtgctcaccggcaaatccattggcaaatcgctgtttgacgaggaggttcatcaaattatttttgagttaaaaaaactcacattcttgggactgggctgtccggtcttcaaaaaacaggctcatattctgtaatccgggattggggaccgggcacgccttgggatgtcgaattttgtgtccaaaagtgcgaccctgaaaaatttggagccatagatatgtgcataattctttggaaattaatgttttttttaggacgattatgctggatagatgcaggaaattattattaaattgcctattaaaaatgttacaaaatcgatgaaaattttaatttgttttttgtatttttagggttccaaaattatcaacgatttgatggcaaaagcgaaggacaaaaatgtgaaaattcaccaaccggttgattttgtggttggcgatgagttcaaagagggcactccattcgccaatgttgacgcaaaggatggaattccggacggaaaaatggttgagtttaaaaaaaagaaagaaaatttttatacaaaaaatgcgattttcttagggcttggacattggtcaggaaactctcaaacaatttgccgaagtgattgggcgtgcaaaaactgtcgtatggaatgggccggcgggtgtgttcgagtggccaaactttgcgcatgggaccaagggcatgttggaggcggtcattggcgcgaccaagtcgggtgcaacaaccataattggtaccttttttggattttttaaaatatggacatttcatttatattttctaaacttcggatacgggcctttcaattaattgggtttactgtgagtatagtatcacaaatgcagaattgtagcaggacgatacaattggaaaattgaatatttactattttttgaggtggcggcgacacggccaccgcggcggagaaatggggagcagaggacaaagtcaggtgagtctcccaaatgtcgtaattttttgttgctttggtttatttaggtgtcatttttcctaaaatttagacacctcccacctaaaataacgacccctttagaggggcaagttgccctctaccaagctttttttaacgattattgggacttgcggtaaaagcaattcttggcacttttcggtttcattgaacatcttatcccctcccccccccctctgattttttatgaaaattttattatttttttttgccacaaatttacagccacgtgagcaccggtggtggtgccagtcttgaactgctcgaaggcaaggttctgcccggcgtcgccgctttgagcgatgctccgtga

SEQ ID NO: 63043 - DNA, 1277 bp, Heterodera glycines
  Genomic contig location: Contig_ID=SeqID_32802; Location=42..1318; Strand=-
  SCN-specific regions: Sequence locations=1-308,330-484,506-748,771 -959,984-1009,1039-1277
atgcgggtgacggtgtgcattacggctcaaaacaacggacaaaaactcaagccgtatgtgttggtcaacagaaagcgatcggtgcctcaaattgtcaaccaatttgctggaaaattggtgatcaatttcgctggttcggtgtggatgaatgatgaaacaacggaggactacttgtacaaaatcatcggcgcaaagctgttcgttggcgaacacctcttggtttgggatgcgtttgacagccacaagtagaacttaaacggtatctcgcccggtgggactcgaacccacgaccccaacaatccgtgccgtgctctatccaattgagctacgggccggagtaggacaaaacgtcgtcagccgaaacgtcgtcgaacgaatttttcgaccataacttttttctttctcaaccaaattaaacattcttgggctcggggtcggtttagtacgggccgttttagtacgagcgcaagtttttggctataacttttttctttgccaaccaaattcaacaatcttgatatcattcgatagccctaagtgtcctctattagcctgcaaaatttcgaaaaattttattaaggttcaaaaaagttatggccagaaaaattcaaaaaaccaaattttccaactttttggctagaactatatgtaatcttgactaaattttttggaatgttgcaggttattaaagaatcagaaagtctttagaatgatattaagagtgtagaattagtttagccctgagttcatatgtaataaaaaatatttaatatgatgcgtatgaatcatgtaaccgttatcttgaagaccatcgttagctagttagacacatcgcactctttgctatttgcattatggactaatgcgaaatatcaaatgatgtgaaggaggttagctggttcatataaattattattagctgggaggctatgttacttgattaagtaaaaatgggatagttattataaaattttttatattatctttcatttgaaaggattataaagattctttgcgaaaaattttttaaaaatctatatattctacagtcagggagcaaaatgtgttagccctgactatataccaactatgcccattgttaatgcctaaaaacgcacaccacatgttgggctgtcgaatatgtcaaaaaaaaggaaaacgttgaatccatgctctggctttgtgctagctagaaagctgcaacaaaattaaacaacctaaaaaaaaagagaatagggaaaactaaaacaggaaataagttgaaaaatgaaaataaa

SEQ ID NO: 63044 - DNA, 621 bp, Heterodera glycines
  Genomic contig location: Contig_ID=SeqID_32805; Location=49..669; Strand=+
  SCN-specific regions: Sequence locations=1-145,326-385,610-621
atgtgcgctgcacttttttgttgtgcgtttgcgcttttcattctctgctcgcacttgagaaagtgttcatcgccatttgtttgtgtctgcccgttttggcgacaatttggagcaggtggacaattaattggtttaatttgtggacaattaattagtttaatttatggacaattaattggtttaatttgtggacaattaattggtttaatttatggacaattaattggtttaatttatggacaattaattggtttaatttgtggacaattaattagtttaatttatggacaattaattggtttaatttgtggacaattaattagtttaatttatggacaattaattggtttaatttgtggacaattaattggtttaatttgtggacaattaattagtttaatttatggacaattaattggtttaatttgtggacaattaattggtttaatttatggacaattaattagtttaatttatggacaattaattggtttaatttatggacaattaattggtttaatttatggacaattaattagtttaatttatggacaattaattggtttaatttatggacaattaattggtttaatttatggacaattaattggtttaatttaa

SEQ ID NO: 63045 - DNA, 88 bp, Heterodera glycines
  Genomic contig location: Contig_ID=SeqID_32806; Location=1..88; Strand=+
  SCN-specific regions: Sequence locations=1-23,50-88
ctttttctatcaattggcagatgaataaaatttttaaaaatttttaattcctttttaaacaggccaaaaagtttaggcttaacttttt

SEQ ID NO: 63046 - DNA, 359 bp, Heterodera glycines
  Genomic contig location: Contig_ID=SeqID_32808; Location=89..447; Strand=+
  SCN-specific regions: Sequence locations=1-10,58-127,149-208,231 -258,283-359
attaatgtcgaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtaa

SEQ ID NO: 63047 - DNA, 289 bp, Heterodera glycines
  Genomic contig location: Contig_ID=SeqID_32808; Location=652..940; Strand=-
  SCN-specific regions: Sequence locations=1-289
atcggaaaataaaagtcatttattgactcttatgtggctctttggcttttaacagaacattcagcacaatgacagattccgtgttaggtcaaaaagaatgtttgttatacagtgtcatttcggagggtcgggtgagcggtcgcatcggatgcctttctcttcttgaccaggctgacgttgccgttcttcttcagcccattcagcaattgttccttcacatgattatactcaacgacacaagttcggcacaacgctctgtacaattcttgacctctgatcatttctaact

SEQ ID NO: 63048 - DNA, 330 bp, Heterodera glycines
  Genomic contig location: Contig_ID=SeqID_6836; Location=3425..3754; Strand=+
  SCN-specific regions: Sequence locations=1-114,146-330
atgccaccaaattttttctacaagcttctgctggaacggctgagccgatcaaagaagtgggagcaggtacagctgaacctgggcatgaacccgaacaacagtttcgccattgacgggccgggcggaggtggcggcggcggtggcgccgcgtgggacaaacaaacggaagcgaaaacgggcgccggcggtcaacaaatctcgggcggatttcagtcgattactggcggaagcaattactcgacgctaagtgtggcgattgaaagccgccagtatgatcagagcggagtcagcggactgaacggaggaggcggtggatcggagatggtagtg

SEQ ID NO: 63049 - DNA, 657 bp, Heterodera glycines
  Genomic contig location: Contig_ID=SeqID_6837; Location=152..808; Strand=+
  SCN-specific regions: Sequence locations=1-657
atggcccttggaatcagtgatattgggcttcaattcaataggaaaggtttgggtaaggctcaatgtttccgggaattcggtttagaaacaccaccgggacggggatcagggtcagagttccccaatttgatcaataccgacctccagttcccgaagaggttgcggaatggtccaaaaatacgggaatttagggtctgatacatcatagggacagggcggggatcagggtcagaatacctccatttgatcaatctcgtcctccaatcaccggataggttggggaatggcccaaaaattccgggatccgggaggaaacatcacagggatagagcaggattagggtcagagacttccccatttgatcaatcccgtccccctaatcgtcaaatcccgtccccctaatagtcaaatcttgtagccctaatccacctctcgttcagcaccactcaagaatttctcggcatttcactgatcgcacccatccctgtgctgttcccgctgatcaacctgttgtgcctgaaggagttccgcaacatcaccagccaaattgtgttgtgcaaaatttggatgcgcaaaaagcgacaggaacgagcggcagcggaacgaaaagcgcaggaaaacattgacgaagacttggtatcggcaagcaaaaacaag

SEQ ID NO: 63050 - DNA, 734 bp, Heterodera glycines
  Genomic contig location: Contig_ID=SeqID_6838; Location=842..1575; Strand=+
  SCN-specific regions: Sequence locations=1-90,112-633,656-734
atgtgtacaagttatccctataatacagtagcatttggggtaatttttcttttttccgctaatcctttttcacataaaaaaggcgatgaaaataattgtaaatttaaaaatatcatggaaactttaacattctttttcattaaaaatgcacaattagaaaattaagggggcctctattagcctgcaaattcaaaaatatttcgtcaattttgaacaaccttatgaccaaagtacatcagaaaccaagttttcattcatttttggccatgactttttggaaccttaatgaaattttttgaaattttacaggctaatagaggatagttagggctatcgaatgatagcagcaatgcttgatttggttgacaaagaaacaaattaaagtccgaggcccaactgaccgagtccgtcaggtcataatacacttgtgttattgggtggatcctcgctgatcagcaggagaagtgaaaactttatttgagtgtgactgatcaaaaacagaaatttcacacagatcagatagaactttaggtagaactacaaactatgcatactgatcagaagcattagtcatagacaccacagtaaatgatagggtagaacaggttgcactgaggaactgatcggaggcttttggaaaaggaaaacgccataaacgcattgatcggatcgatttggcaaatagactttcaatcaataagaaatccatttgagtatctattaaaatacagtta

SEQ ID NO: 63051 - DNA, 967 bp, Heterodera glycines
  misc_feature (17)..(17): n is a, c, g, or t
  misc_feature (32)..(32): n is a, c, g, or t
  misc_feature (61)..(61): n is a, c, g, or t
  misc_feature (68)..(68): n is a, c, g, or t
  misc_feature (70)..(70): n is a, c, g, or t
  misc_feature (94)..(94): n is a, c, g, or t
  misc_feature (100)..(100): n is a, c, g, or t
  misc_feature (110)..(110): n is a, c, g, or t
  Genomic contig location: Contig_ID=SeqID_32813; Location=1..967; Strand=-
  SCN-specific regions: Sequence locations=1-187,223-334,358-817,840-967
  Gene Ontology: Mol. function=protein binding; Cellular component =nucleoplasm
cattttaaaaccgtacnaactgcgcatcattngcatgatgccatgcgaaagaagcacgagncgagcantngggcaaggggaggggggaatttgnagtganaattcattcngaaataattaaggccgaagttacgcaagtcattgctcccattagcaacgaacaggtgacagactaaattcaaattgcaaatttaacattttaatttaaaattcataaattaagcgtcaagcattggctttggagttcaaaaaacaattcggcactgatctgattgccatgctgaaaaaggagttcaaaagcgactttgaagaactgatgtaaattataaaatgcaaaaacagccatttaaatttaaatttacaaagcatttctttgatgcaaacgcccgccgtttacgatgccaaccaaatgcgtgccgcattgtccggctccaatgagtgagtacatttacaattgaattgggataaagcacatggagagaacttcaaaaaggaacgccagtagctcaacaggtttaagtgatagattacggtataaacgccataatgaccacaggagaaacttagctatttgttttggctaaatttaatgttcatataagccatcgaattgatggtggattctggttacagtttacctcatggcttaccgtatgtacatttaattacggtgtctaccgtagggcggtgctaatcgaaattttggcgacgcgcacaaaccgacaaattacggcgctgaagcaggcgtatgagcagttggacagaaggcatcagcacaatcagctggaggagaacatcaaagcgaagacgaagggacccttccaaaatctgttggtgtctttgctcagctgctctcgcgaagaaagtgcgcccgcaagcattgtattggcacacgacgtaattaagtggcaaattggaaaaaattaataaaataatcaattaacacatacataaacaacatcattaa

SEQ ID NO: 63052 - DNA, 229 bp, Heterodera glycines
  Genomic contig location: Contig_ID=SeqID_32816; Location=216..444; Strand=-
  SCN-specific regions: Sequence locations=1-229
atgccgattgaggaaaaagaggacaaggacgtctacagaattgtagtttgggtaagttttacaacaaaacaacaaaataggtcttgttttacaggattcggaaacatcgcaggattcgatttataagggggaccagaaagagcatgtgatcaattatatttcggtgagagttacgtgtacggaatgttgtgacgacaaaaataggacgaattgcaaaatttgtggggag

SEQ ID NO: 63053 - DNA, 644 bp, Heterodera glycines
  Genomic contig location: Contig_ID=SeqID_32817; Location=97..740; Strand=+
  SCN-specific regions: Sequence locations=1-59,82-85,110-133,156 -193,215-231,253-290,318-386,416-644
atgccacttcatttaagatatgcgtatgaggtaatatttattgacttaaaaattgattgaaattaaataaattcattttttgcacaaatataatttttaatataataatgcgtaaattattgaaattttgcagaaaatatatataattttaaattcgaaatgttctttaaaaatagggcacgaaattaaacataaaaataacaaataattacatccttatttattagaataacattttattttaaaattacaacacacatagaaaacccgcattttttattttataaaggatgaagaagtttaaatatttttgttttgagcaaagttatgtgaattatttaaaaaaaatgtaattttgaaggcttatcaaaaaaacttattgatccaaaaaattaagaaattttatttataaatagggcgttctaggtcatctcgtaaaactgtcaattttacagatttttcgagaaaaaaccgtcataactttttttgacacaaccaaaataaagaaacaacttcctgaaaacggaataaagcttatttcatttggctgtgtttatgaaaagttataacgggtttttctcgaaaaatctattatatttgcactttttacgaaaggacctattaacacttaagtaggcacggaa

SEQ ID NO: 63054 - DNA, 476 bp, Heterodera glycines
  Genomic contig location: Contig_ID=SeqID_32819; Location=326..801; Strand=-
  SCN-specific regions: Sequence locations=1-23,48-68,98-140,168 -233,280-448
atgttgaggacggacaaggacgagctgaaggaggagaagcagcggctgaaggaggtgagaatggacggcaataaaaacaacagcaacaacaataaagcgatgaaaataaacattttgttggcacatttgtatgaaaaaaactttattttttaaaatttttcgggcgggggacagtgaattaattgtgtacgggaaatttcggcattttctttggcatgcaaaaaaaatagcggttttaataaaaataaatttcaaatattaggttatttttaaaaaattccaggtctttctgtgcgccaaccaacagggctgggccagtccgaacgctgttgcgcatgtgaaccgttgcaatgtgtcgctgggaatggacatttggctgcactgttggcttggccaaatgctcaaccagtttgtcctcaaattcatcattttttttattaccattttcaaaaaaaaaatcaaaaattaatattaaa

SEQ ID NO: 63055 - DNA, 525 bp, Heterodera glycines
  Genomic contig location: Contig_ID=SeqID_74; Location=566..1090; Strand=-
  SCN-specific regions: Sequence locations=1-49,71-173,195-525
atgaacgccgaacaaattcaacaacttttgaccgctttgctccaaggaaatgccgcttcaagcataagccaagcgaatttggccagctcaatcgacagtagaatttcaaagtttgtttatgaccccgagaatggtcaaacatttgaacagtggcacaaacgcttcggcatattgattgaagaggatggcaaagacttaaccgagcaagccaaagtccgactattgttgggaaagctcggagacgaagagtacacgaagtacagggacacaatcagcccggagttgcccgacaaagctttgtgggctgaatcaatcaacagattaaaagagttgttcgctgaaacgcgctctcttttcgtccgccgatatgaatgctttcgaatcagacagcatccaaaccaagacatcagttctttggttgctcaaatcaacgcagcgtgtgagtatgccaatttgagccttaccaaggaacagctcaaatgcatgattttggtgattttactgagggatgaacatcacgattag

SEQ ID NO: 63056 - DNA, 2560 bp, Heterodera glycines
  Genomic contig location: Contig_ID=SeqID_75; Location=930..3489; Strand=+
  SCN-specific regions: Sequence locations=1-440,487-544,566-1379,1401 -1444,1467-2042,2064-2329,2351-2369,2391-2560
atgcaatcaatacctgtgttaaaccctcggaagcaattcgcttcttcatacttctcaccaagtgaaaaaaagcagaattgcacacgacaaagtggaaagactgtgcggacagcagcgaccatcgcttgctcgaagtccaacgatatggtgtcaggtgcaaaatttggccatctttggacaatcagttgaagcatccgtgtgtatatcacttcacattttgaagtgagaaggcagtacgcaatcggaaaaacccatttatcacgcctaaaaagacaaaaaaaagtggtagaaaattaaggttttactttgcaaggagaacataaatttgactgaacaaaagcggcgccaaactgaaagtgccatctgcgtacgcatttttcataataccggcccattccgaagtcgaagcgcgagcaaatatcaaaattcttaacacggtatttttaaaaattaatggttttattattttaagtttttacttgtaaataattgacagaaaaaaaaacatttgtaaaaacgacttgccagactaaaacgaccctctgactaaaccggaaagactaaaccgaccctctgactaaaccggccagactaaaacgaccctctgactaaaccggccagactaaaacgaccctctgactaaaccggccagactaaaacgacactctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaccaaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacggccagactaaaacggccagactaaaccggccagactaaaacgaccctctgactaaaccggcagactaaaccgaccctctgactaaaccggccagactaaaacgaccctctgactaaaccggccagactaaaacggccagactaaaacggccagactaaaacggccagactaaaccggccagactaaactgacccagtccgcattagccattgttttggagtttttaaagtcaattctgaatttttacataatttttggcatttttttgaaggttaaaagccatttttgcagtttttaaggcatattttggtgcatatttgggcattttttgggtttttagggcatatttgagggatttgtagtgcatattttatgcgcatatttggcatttgctgatgtgtgtgcaatctaaccaaattttaaagtttctccatttgataactgtaattattatttacttttcagatttagctagttcactgcgtcaacaacgcaccgaggacaatcacatttcaattaatggacaaaattacgcggttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacataatcgatgggcaaataaacgctaaatgcaatggaaatttatacatcgatcaatcgtcagatggatgttctcgcataatatgcgtcgacgataaaaagaatggcgttgaaaataactttggacagacacgtgatattttcctgaccggtgatgtcaatatttttgagtctgcaaatggaattatctacaactctatgatgggaggaactttacatatgcataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttaagtcaccaatggcaaatattcggcttaactgtggtggatctttacggatcgaaaagtcgaaaatggaaattggcaacctagacagtggaggaagttcaaccattgtagaatcgccagcgcaaagtctaaagttaaactgtggaggaagtttaaatatgaatgagtgttcaatgaaaaatgttggcattaattgtggtggaagtgcaaccattaagaagtcgaaaatggaaagtggtcgcattaattgtggtggcaatttttctattgatagttcgccaacgggaagtgttcgaattgattacggtggaagaagaattaatttatgaggtcaaacgaatgatcttgttcggaactgatcaaaagttctgaatttctaacataaca

SEQ ID NO: 63057 - DNA, 1628 bp, Heterodera glycines
  Genomic contig location: Contig_ID=SeqID_77; Location=762..2389; Strand=+
  SCN-specific regions: Sequence locations=1-363,385-415,437-489,511 -800,824-830,867-941,1047-1075,1223-1520,1546-1628
atgaaggcacggcgaattcctttcattcaactgcaaattctgctgctgaagctgatcggagacattgtcaccactgatcaacagagagaagaagcgactgacgcgaatggcacaacggagggggaggcggcggaggaagcgaaagacatggcattggcattggcaatgagcagccgccaattttggcaccaaatgacggacgaatggaattacaaaaatggcaaatttcaaaagccaaaagaagaaatgttttccaaagtttcttaccatgactttggtgagttttgtgaaaattggaaaacaaaggcgacggcagtgaattcttttgtgaaaagttggcaatgcaaaaagggagggaaaagcggcgacggcacaacggacggaacgccaacaaaaaacgatggtaatggaaagcggacattttggtgaaaacccattttttccttctgtccgtttcagtgaataggtacatattttttgatttagttttggaatttgacggaacgaattcaagagggactttcaagaattaacaattcgttggaaggatggcattacatttggggatcagttcttgagccaaaaccgctgtttagcaaatttgcaaggtggcaacacatcgttgatgattatgaaaatgcgccagcaaatggcattagagggaaaggtattaggcgaaatccctctttgttgatcaggacaacaatttgcgtcagattttgctgaatttgagcagcgagcagcacaataccccattcgttatctaagagcatgtgcataccatttggggcagaataattgaaattttaaaatatatgtgacattttgccaacattttttaaaaattatttctcatttgtcagtgacgaaatgataggtaaccttcatgtctgccattttttaatgtctaacttagtttatattagggttgcaaccccgacgtcggggttggaaaattcggggttcggggttgtcggggttggaagtgtcggggttcggggtcggggttgccaaatcgttcggggttcggggtcggggtcggggtttttcaatttttgccttatgccaaatagtcaaaatttttttaatattttttcggaaataatatttattaatttccataataatatttgtattgtttttatatttttttatttcttttttatcagaaattttgtatagaattaatttttttttcttgaaattttaaaattttttattacttttttgttttccaaaacatctttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttatttatttatttatttatcgataaagaaaaattgccatcagaagggcggagaccacttactctgatgactgatcacagtaaaatagtctcagagtaagtga

SEQ ID NO: 63058 - DNA, 1207 bp, Heterodera glycines
  Genomic contig location: Contig_ID=SeqID_79; Location=1898..3104; Strand=-
  SCN-specific regions: Sequence locations=1-97,119-236,258-429,451 -579,601-1002,1025-1033,1056-1169,1199-1207
atgtgtgctaaaactggacgaatatcaaaatttccggtaaaagttttgccaaaaacaaattttctttgtccagagataaaaacttacaaagccagaagtttatcctgcccttaaaagttaaaggtttaggcgggagaaaaaagcaagaaaccatttatagtaacaattttccaaaaaattttgcttaattttttctaaaatccaaaaattaccaattttttatgaaaatccataaaattgggaattttttgatgaaaatctactaaaaacatggtaaaattctccattttcccccggcggcgcctatcggcaccgccggaccctattttgccaggttggacaaatgagcttaaaaacatcatttgaatttcatgccaaatacagtcatggtcatatgtttacgaccacttgccattccaataaagaacctttcataaattttttaagctatttgatagacgtacattctttccatttttggtagcctttttaatgggctttccaatgctaccattcattaattgaaacatgggttattgcccgaattacttttgactttgtgtgtcgctacccattttcgggtggtcatatgtttacgaccactttatgcatttcatcctgctaggctaatgttgaccatttctactgtaaaatgcactatttccttaagaaatactgtactttttgtagacaccgaaattgaagtgcccatacctcagcatgtttggtcatagagacctgcgatcttttgaatattgtagagcagtttgttctctttcagatggagataatgatttttttcagaaaaatttttccagccccctaggaatttttttcgaaaaatttcccgattttcagtatatttttgggtgtcccgatcactatgaaggagtgatctgatcaagtttgtgtaaaagacttttttgatcagcatcaaaagtcaaactagcaggaattttttcggaatttttctgtgcactttaacttgagatacaaaaagtggtcgtaaacatatgaccacccaaaattgggcgtgaagtagactttttgttttctaattagtattttaattaagaaatagttcgtgaatgggttgctaattttttgactaaatcaactcataacttttctcagacgcaaaaatgaaaaaattgtcataacttttgaaaaactttatatgatttttaaaatttagcaagctaataaa

SEQ ID NO: 63059 - DNA, 612 bp, Heterodera glycines
  Genomic contig location: Contig_ID=SeqID_79; Location=755..1366; Strand=+
  SCN-specific regions: Sequence locations=1-146,171-418,440-612
cagaaacgcgaagcggcagtgtctgcgccacaagcgttggccaatcaaccgactgacgttcgcagcagccggaggagagaatctggctgttgaagaatgtaagtgatgttctcataggggagcaagcaggtcgtggcccgacccagaaaaataatttaaaatttccaaaataatgcgcattaactagacaagtagcagtttttttccaaaacaatttcgcataaaatgaccaaatttcgcgattttgctcaattacaaaaaaaaattagggttacggcactgccttggaaatttagtagatttttacaaaaaaaatagtaattttggtgaggttggtcttggaggggcaaatcaacaaggaaacccgaaaattttcgacaaaatactatttttcccttaaaatttcagcttcgtaggggtcttcccgccccccttgggaccgtccctgccaaaccgatacagtattttggaatattttattactgttaccatatgaagtgtttgtttgtgtattcagacgagccgctaacgcccaccctggagggcatcgtgattcttcgcgaattggccaaaaaaagtggcggcgccagcattggcccaacaaccgaatga

SEQ ID NO: 63060 - DNA, 1188 bp, Heterodera glycines
  Genomic contig location: Contig_ID=SeqID_79; Location=3287..4474; Strand=+
  SCN-specific regions: Sequence locations=1-464,495-501,523-1188
atggtgtgcctgcgccgcaaattccccggcggtcaccgactcgaccgtcatctcgatgtcgcgcaagccgcctgcccggctgttgcgtcagccgatcacttgcaactgcagcttggaggtatgtcaatgatccttttatgtgaaaattctctccccaaaagtgaaaattccctcctcaaaaaacaaaaacttgataaaaaaaaatgatgtattaaaaactcaagtgtaatacacccgttctacaacggcaacgggaggactgctcggcttctaatgaatttcgttctgatgcgccgttcattgcaaccgatcttcttaccagtaatgcaaagcggcggtgtctgcgccacaagcttggcccatcaaccgactgacgttcgcagcagccggaggagagaatctggctgttgaagaatgtaagtgatgttctcataggggagcaagcaggtcgtggcccgacccagaaaaataatttaaaatttcaaaaacaatgcccattaactggacaagtatcagttttttcccaacgaatttcgcataaaatgaccaaatttcgctattttgatcaatttttaaaataaattagggtcacggcactgcctgggaaatttaatagattttcctcgattttaatagattattaccaaaaaatttggtacttttgtgaggttggtcttggaggggcaaatcaacaaggaaacccgaaaattttcaacaaaaatactattttcccttaaaaatttcgggtgcggtcttcctccctggggtatatttgattgttttactactgtgaccgtatcataataatgtttattttgtgtgttgcagatgaacctttgacgcccaccctggaaggcattgtcatccttcgtgaattggccaaaaaaagcggcggcggcgccagcgttggcccatcaaccgactgaccgaacacagcagccggcggaggggactgataaattaaaaattgttttttttttgtcaatcgcgtgtttattttgaaaaagttttgtgctgttataaaaatggaaacacatggatggggcggggctggtggtgggtgggtgggtggtcattattgtctaattaacattgcttttcgagctcctcggaaattttcggtctcgaatagcgctacgaatttgctcgtatgattgggtaaaactgcaattaattgcgatcccgcca

SEQ ID NO: 63061 - DNA, 472 bp, Heterodera glycines
  Genomic contig location: Contig_ID=SeqID_80; Location=845..1316; Strand=-
  SCN-specific regions: Sequence locations=1-472
atgatcacatctttggcttttcttcctgtccaccatcttcctgctggcctcaatgctttggaggcacaactccctcaacagcttattggcgtcttcgattggtgaatttttaggaatggaaaatcaacaatattttttaaaggttcacggacaattacaccggaaggccgcggttcaatggtggtttgacagcgcctcggttcgcaccggatgaatggagtgtgcatcaacggacgttggatcatcaacacaattcgatgtgagcaaaaatcaattgatgcaggcatcgcccgatgcatcgctggtgaactccctcctcaaaaggcgcccaaatatcgtgccgccgatgcgagaattcttcgactcttgcagagctacaatgccatcaacaataaccaggctcaccaaaatgatcacaattaccatgcccttatcaatgttaacccctataacatcatcaattttctccttg

SEQ ID NO: 63062 - DNA, 1672 bp, Heterodera glycines
  Genomic contig location: Contig_ID=SeqID_873; Location=1117..2788; Strand=+
  SCN-specific regions: Sequence locations=1-1181,1203-1213,1238 -1508,1530-1611,1633-1672
atggctttattatttactcgattgatcagaaatgtaattcttgttattgtgttttttaatgtcgtaagtttgcaaaaccattttatcttttgtttattaatatttttaggtttcctattatctccgctggaaatcttacaacatcgctgctcgggacttcaagaccgcttcggttaactctgcgagtaagttctgtctgttctcattttcatgttatttcgtttctttataaggtaacaatgcgctttcggcggtgtctaagtttcagtctgaactgaaacgcatcacaaagggacaatcggtttccagtgattcgacctgggtctgcatttattgcttattccgattggtctgtctttcatttgcttccttttcagattccactttctgttggaggattgcatttgcgtcttcagatcgcttatgccacactgttcgaagcgtaagtatttccattttcttgtttttgaatgtacttcgattttcctcacagtgtcactttattggtcgctccgtcgccgaccgtcggtcgttcgggcatccactgggccaattcgacttgtactgtgttagtgggggaagtcgtgcgccattccgatgcctacagcggactggtgaaagagacgttcacttcaggtttgtgtctttgttcatccatttttttacattgtggcaatagtcccttattatttttgttatatttttagcccaaaacttccgtcacggtcaatttgagagttacgtctacgagttcaaggagggcactcatgtcgtttgctactggcgtgggttcatccccgccagcggtttgtccgctttggtcggtgccgttgcttccggcgatttgctcggcgccgctcgtcttgtcttttcttattctaaggtccttcattattgcttttgtttaccaatattttttctttttttaggtgacctttgaaaacacctccgttttcttcgtggacactttcaatcacctcaaaaacaaagcgatgaagatggagttgtgagtgttcggatttcgacgttgtcacttctctttcatgtccgattcattttcgactcatcgcctcgctaacaaacgaaatcactttggcattaattcgatcattgggcttttgacttcccctttttatcaattgcacacctaactaaattgtaacagtacaactgacagtagtgcagaaatcaatttaaagaaatttaaaagggacatcttttggttgttttggattttcatttgttttttttattcttaaaagggttttgatcagcatttatttaattctgcccaactgcccgtttcctttggctcattgacattttttgtcattccaaatttgtattttagctcatcattaattatttattcgtacaatccatttttcaatctgttaaagaattcgtaataatgctcagttttaattggtaatattaactcctgaaaattatttcttagcaagtgattaaaatgccaaccgttattttattaataatttcccttttcgttacatttaattaattattttggttcggatggtttctgtggtcgctgggagagtgcatcttttgccgcgtgagttccataacatttgctaaattttaaagccaggaaaatgtagggctgctgcttcccccaccttttggtttcaacgaacacctaaattattaa

SEQ ID NO: 63063 - DNA, 1802 bp, Heterodera glycines
  Genomic contig location: Contig_ID=SeqID_874; Location=208..2009; Strand=+
  SCN-specific regions: Sequence locations=1-239,269-656,678-795,817 -1426,1449-1525,1548-1592,1622-1802
  Gene Ontology: Mol. function=NADH dehydrogenase (ubiquinone) activity; Cellular component=mitochondrion; Biological process =energy pathways
atgggcgcgagagccgcttacatttacatccgaggcgaattttacaacgaggcgtgcattctgcaagaatcaattcacgaagcttacaaagtgagtgcttttgacgaatttctgattttgacttattaaatgagaatgattgtggggaaagttgtttttcttcaggcgggttacattggaaaggactgtcttggcaccggctacaacttcgacattttcgtactaactcatatttcagttccatcaattttcttttttctttcctttggcaggtccatcgcggagcgggcgcttatatctgtggggaggaaacggtagaagaagaagaagaagaaatagcgaagaattaaactcggaattggtccgtttccaggcactcattgagtcgttggaagggaagcagggaaagccccggctgaagccgccatttcccgcggacatcggattgttcggctgtcctacgaccgtaacaaatgtaagcattgagaaagtgtgcgttttcatccttcggatcagaaaatctgtcttttggtaataaaaagcgctgtttttagtattttctccagttttttccttttcattctgtgccttttccttattgttaggttgaaactgtcgctgttgctcccgcaatttgtcgccgcggtggcgcatggtttgccagttttggcagggaaagaaaccgcgggacaaaggtaagaaaaaagtaaaataaatttcatatgaaatacttaaatttgccccgctcagttgtattgcatctccggccatgtcaatgatccgaccaccgttgaggaggaaatgtccatcccattgcgcgatttgatcgaaaggcacagtggtggagtgatcggtggttgggacaaccttttggccatcattcctggcggttcatctgtcccattgttaccgaagaggtgtttatttggcattccgacaatggccctaaagattcgtcttttagcatttgtgacgatgttctaatggatttcgatgcgcttgtccaagtgaattcggggcttggcacagcggcggtcattgttatgaacaaacaggttcaccgatacccttgaacacaatgccgcctcttcaagtctattgcactcgtcgaattaaattttaaaaaaacagggacaaaggaaaatcggaaaatttaagaacttttattttaaggcctttaaaaatcttcatagaatttttgtgagaaattcatgctaaacgaactgccctaaattgcgagtattgttccattcccatttcagtgtgacgttgtcaaatgcattgcgcgtcttgccgagttttacaaacacgaaagttgtggacagtgcacgccttgccgggaggggtgcaattggctgaacaaaataatgtggcgcttcgtccagggcaaaggagtgcccagcgaaattgacatgctgtgggaactgacaaagcaaatagaggggcacaccatttgcgctttgggagacgcagctgcttggccagtacaggtcaaaaaaaattttactgtaaatttcgccaaaaagttggtggtaattttatttttataattacctgaatgggaaaaacatcaacggattttggtggttttcaaaatttttataattttattttatttttagaattactgtattacaatatgatgtattttccgggtgtcagattttttcacgagagggggagaagggtctttttaatttatttttgtgttcttaatgaatttcttaatttagggactgatccgacattttcgtcctgaattggagaggcgcatggcgaaatatgcggagagtcatcccgaa

SEQ ID NO: 63064 - DNA, 1943 bp, Heterodera glycines
  misc_feature (380)..(380): n is a, c, g, or t
  Genomic contig location: Contig_ID=SeqID_874; Location=954..2896; Strand=-
  SCN-specific regions: Sequence locations=1-510,532-1068,1098 -1142,1165-1241,1264-1873,1895-1943
atggaaaatgaaagggaatttgggagggaattcacaaaggaattcgtggaacggcacaatgaactgcgcaaattggtgaccataaagggagagtccccgcacattcacccacactattttttaagcacggatgccccgaattgacgctctgcgaggaactcagcgaaatggccaaagaatgggcggaccgaatcgcatggcaaggccatgtgtcatttgccgaaatgagcggtaataaatgggcagttgggaaggaatggcactgtcagacaacaatcaaggagtgggtgaaaatgtaactgttttccccgaggggaaatgcgcccgcgaaatggtcgactattggtacgcggagaacagaaagtacgaatacgactccncaggctggcaagaaggtaatttgatggaaaataattgaaaaacgattacaaaaataaagggactaattacttcacacaaatcgtatggaaatcgaccagagaggtattctttttgcaatggtaaaaaatgcatttgggcaattctaaagtcagtccctttcgccaaaggtcggagtcggtcggtcgacaatgcgttcattcccacaacagatggaaaaggacgagaaaattacaaatggacactcagaagaagcagtcaaaaaagttgtggtcatagcattttataggcccgcggggaactcaaatcgaagcggccaatttgagcttaatgtgccgaaaccaattgcgcaatgagttcattaattaaaacggaacaactaattaagcgaataaataattatttatgagcctatccatcattttttactctgtacaaacatagcaaaaattcacctaatccaagcaaatgaacaaaggtttttatgcggtcgctaaagtttcctttatttcgggatgactctccgcatatttcgccatgcgcctctccaattcaggacgaaaatgtcggatcagtccctaaattaagaaattcattaagaacacaaaaataaattaaaaagacccttctccccctctcgtgaaaaaatctgacacccggaaaatacatcatattgtaatacagtaattctaaaaataaaataaaattataaaaattttgaaaaccaccaaaatccgttgatgtttttcccattcaggtaattataaaaataaaattaccaccaactttttggcgaaatttacagtaaaattttttttgacctgtactggccaagcagctgcgtctcccaaagcgcaaatggtgtgcccctctatttgctttgtcagttcccacagcatgtcaatttcgctgggcactcctttgccctggacgaagcgccacattattttgttcagccaattgcacccctcccggcaaggcgtgcactgtccacaactttcgtgtttgtaaaactcggcaagacgcgcaatgcatttgacaacgtcacactgaaatgggaatggaacaatactcgcaatttagggcagttcgtttagcatgaatttctcacaaaaattctatgaagatttttaaaggccttaaaataaaagttcttaaattttccgattttcctttgtccctgtttttttaaaatttaattcgacgagtgcaatagacttgaagaggcggcattgtgttcaagggtatcggtgaacctgtttgttcataacaatgaccgccgctgtgccaagccccgaattcacttggacaagcgcatcgaaatccattagaacatcgtcacaaatgctaaaagacgaatctttagggccattgtcggaatgccaaataaacacctcttcggtaacaatgggacagatgaaccgccaggaatgatggccaaaaggttgtcccaaccaccgatcactccaccactgtgcctttcgatcaaatcgcgcaatgggatggacatttcctcctcaacggtggtcggatcattgacatggccggagatgcaatacaactga

SEQ ID NO: 63065 - DNA, 2353 bp, Heterodera glycines
  Genomic contig location: Contig_ID=SeqID_874; Location=4221..6573; Strand=-
  SCN-specific regions: Sequence locations=1-228,250-533,558-797,820 -1057,1079-1146,1171-1442,1480-1674,1701-1783,1806-1868,1901 -1925,1951-2288,2313-2353
  Gene Ontology: Mol. function=electron carrier activity; Cellular component=endoplasmic reticulum; Biological process=protein folding
caaagtttgggagtgcatttacaacgagaactgtttcaagtcgtccaccccctttggcattatgacactttgttttttcttaagacccgacccgaaattcgacaaaaagtttctcctccaaccgacgccaacgggtttatttttgcaattgccaccaattaaacatcgcaattcattgcctttgtcctttagggatgtgtttggagaagagagtgttctatcggctcatctccggccttcactcggccattaccgtttcgattgcggcccacaattacagaccgggtattatccgctttccagagacttatttttgcattatcttaattttccttttagcccccggcggtttcggcaccggcacttggtaccgaaatgttgaagtaaaacaaattttaattaatgctgacatcgcttgatttttctagttttttgaaaatcgcttcggtacgaaatggggcaaagaagggcccgaacggttgaggaatttgtacttcacttacatgctggtgagtggtggcccaaaaatcattggaaaatgagaaaatgaatggaaatgcgaaggaactgagggcattggtcaaagcgacgccgtacatccgaaaaagtcaactgttctacacgggcaacgagcaggtgaataatgaattgtgggcacaattgggaagggcaaaacgaagagggaaagggggcattagggacacgtgtccactcaagccaatcccgggaccatttctgggccaaaggaacgcataaacaaaataataccaaaactcgtaattgtcaggaagaccgagaaacgcagcaatccttggaacacttcctcgccgtgctcaaagagttccccaaccaattcgacgagactcaacttttctcggtaggcattggcccattttcattcattttttatttccttttttgcccttttcccaatcggatttgacttcaaatgcgtctttctttcagaatttccaagagtcccacgcccgtctgctgaaggaagagtttcgccagcacttttggaacatttcgcgtattatggactgtgtcggctgcgacaagtgccgactttggggcaaattgcaaacgcacggaatgggaacggcactgaaagtgctcttttcggaccttccgcggaacggaaacggagggaaagcgaacggaaggaaagagcaaacggaaaacggagaaagtgcagcgaacggcggacttttcaaattgacaaggtgaagaaaaggaattaaaaacgataagggatcaactgattcaggggccgatggatttgatctttttccctcttccacaaatttttccttattttcgttcaaaaatcgacttccaccatggcttcggctttcggtttgcattaaatttacgcctccggcttttgtgcctatgcccaaaagagcttcaaattctgattttgagtcataaatggcgacataaaaaacattaaaataacattattaatatttattagatttggcaaattcattcacaattaatgaagtaaatttgccattttccgtttagaaatgatttggtcgctctgttccaaagctttggcagatattcctccagcatttgggagatcgacggattcagaaaagagttccgacacgacgaattgtgaattgtccgctgaatttctttttcgtttcgcaaatgtcccatttttcctcctcctcatttcctctccttttgtacgatgagtccgattaatttatttctttttgcatttaattctctttgtgattccttttttaaccgccaacagaattttagtgaattatgtatttaaatttacaaaattattgtaaattccgccgcttagtcagtcattaaaatcgtgcattgttatacaaaagaaaaattttttttatttgtttttattttatttctttggctttttccaaaccgcgccgtctttcttttctctctctaattttaaatagagttgagcgggaccgggaattttgggcaaatacgggaccgggaccttttcgggttgaaaaaccgggaatttttggctgggaaaaccgggaaaaaaccgggactagtcccggtcaaaaccgtgacttcggtactcagttgtccgtattcaggtcccggtcccgctcaaccctaattttaataaataaattctctccatccgatggccaatggtgaattcattaatgatcgtgccgaattgtccatcgagcgtggtgagtcgtcctttttgcccttaggcaaaatgaaattcgccgtcagatttgcatcggatgactgaactgattggacggattctgcagaaaagcggcagggaaatgcccaatttggtgcgccttcagcaaaatatccaatcgccctt

SEQ ID NO: 63066 - DNA, 477 bp, Heterodera glycines
  Genomic contig location: Contig_ID=SeqID_875; Location=210..686; Strand=-
  SCN-specific regions: Sequence locations=1-477
atggccaagccgtgtccgttttgggaagacgaagcgggccaatgctcctccaaagaatgttccatcggatattgcgacgacgaagtgccaccggcgctaaaggagcccatcgcgccattgtcggcggttcgttccgcaaatttttccacctccgccgatggaaatgtccgtacggtgggccttcgttttttgaaattacatcaaatttggattttaatggttttgttctgttcaattttgttttaagatgcctttttcaaccacaaaatgccttaaaatttggtgtcattctttttgttttcctttccacaaaatttatttctttttcctttcagtcaaattcgaatgattcgtgcggtggaagtgaaagtaacaaattcgacccgctggacgattcgctaagtgaatttgacagagcgcaactgcgcgaattggacatgtttgaggacaacagcaacaaattttgcgaagtcgaag

SEQ ID NO: 63067 - DNA, 432 bp, Heterodera glycines
  Genomic contig location: Contig_ID=SeqID_875; Location=4124..4555; Strand=+
  SCN-specific regions: Sequence locations=1-8,30-84,106-432
atggcggccaattttcccaaattggtttttggcgtaatgttaccgtacccaatggttgagtaagtggttactgtaagaaggaggaaaggaatttgtgccatttttggcccaccgaccggccaaaaacatcgaattccaaaaggtccaactgggcgccaatgtgtgccgaagtccgacgaactcgttgaactcgcggatgctctttgtcagtttcgtctttttgtgatccgtcgagttcagttccacgcccaactcccaacaccgttcagccaactgaaaatgccaataattcgaaaccattcggtgctcacctgttcagtgtaatttttcagcgccacaattcttccaatgcttgacttggaagggctcaattggaaatgcgaccgccagtggcgctccgggttttttggatgaagcagagaggactttgga

SEQ ID NO: 63068 - DNA, 2138 bp, Heterodera glycines
  Genomic contig location: Contig_ID=SeqID_875; Location=3023..5160; Strand=-
  SCN-specific regions: Sequence locations=1-363,385-485,507-932,954 -1008,1030-1051,1073-1221,1285-1312,1350-1522,1551-1569,1591 -1596,1655-1670,1696-1709,1731-1767,1794-1907,1932-2076,2135-2138
atgttgatacgtaagaaggagatggtcgacagagaaggtgagcagcggaagtgaggggaagtcaattggaaagagtgccaaatgagacagactaattaactatttattagccgaagtaaaccattttgtttcacagagattcaaattttggccgaggtactgctggtcgaacaacgcattcgcgagatgactggccattacaatttggccaattctcagaatagggaccgattggagacattcgcgagcatttcggtgctttttgtccgcctatttaaaacatttttatccgattaattaatttctaatcagacgctaaagaaagagatgcgcaaatacaagcaatttgccatgaatcggatcagaaaagtgagaaaaaatgggcaattgggggatgaattggatggaatagaaatgattttcagaccatttattggtatgtgctgctggtgtacttcttgaccggtatttgttgattgaatccgtctctcattctttgcttgttcaattttcagatcagcagacatataaggtgataaagcacttaagtcagagtcactgctgataaatcactgattaatttccaacaatcattcattatttattccaaagtcctctctgcttcatccaaaaaacccggagcgccactggcggtcgcatttccaattgagcccttccaagtcaagcattggaagaattgtggcgctgaaaaattacactgaacaggtgagcaccgaatggtttcgaattattggcattttcagttggctgaacggtgttgggagttgggcgtggaactgaactcgacggatcacaaaaagacgaaactgacaaagagcatccgcgagttcaacgagttcgtcggacttcggcacacattggcgcccagttggaccttttggaattcgatgtttttggccggtcggtgggccaaaaatggcacaaattcctttcctccttcttacagtaaccacttactcaaccattgggtacggtaacattacgccaaaaaccaatttgggaaaattggccgccatggtgcgttttatgaattttatgaaactaatttgctgtaattctcgaattgtttgtcccctccctttatttaggtttatgccgccattggaattccgtaaaatgccatttgtctctcatttcgtctcaatttgaaatttccccttaaagaatgacttttatggttctgcacaaattgggccgtttctttttgctctgtttcgaacacttttggaacaaattgatttggttcatggaatttgtcagctgtgttaaggacgcggaaaagctgaagggaaaagtgcgcgggacgggccgaatgcccgtgcttttggtcggttccaagccattgaatttatcagcttctcactgttcggagttcctcgaacagacctgcaattaaagtcatccacccaaaatgatcattggttgaagtcaacatagctgatcactgatcagaattcctccattccccagctgatcactgatcggtgtcccttcccctttaggccatcggcgtggccttcgcttggatggtccgtcatttttacctcctttttcattttatgttttaatttctcagtttctttgtgcggccattttcctcaaattcgagaaggattgggactactttaagagcttttattttttcttttgctcattgaccaccatcggatacggtacttttgcgcattttaaaatttacttttcaaaatgtttctttttaaatgcgttttatcagcgaatgtttcaggcgatgtgacccccacaaattccgaggatatgttcatcattttcggcttcatcattgtcggactttccctggtctccgccattttttcctgctcgagactcttgaatttccaccgcttttcggccatttccctttttggccttcttaaacccatttccttctcccccgctcccaaataggtttcaatgtgcatcaatgtcattcaattgaaattggaggaattattcgaggaacttttgctgacgatgatggaagaatatgtggaggcaggcggaccaacggtggaagaaataaccgcaacgatgaagccgaagatgagcatggtcgacctgtggaaagtttggcagcggagaaggcaacgaaggagtaa

SEQ ID NO: 63069 - DNA, 1883 bp, Heterodera glycines
  Genomic contig location: Contig_ID=SeqID_6839; Location=36..1918; Strand=-
  SCN-specific regions: Sequence locations=1-225,254-352,374-530,554 -787,809-1883
  Gene Ontology: Mol. function=long-chain-fatty-acid-CoA-ligase activity; Cellular component=lipid particle; Biological process =lipid transport
atgcaaacggatgtgtactgtgagggcggttcagtgggcttcttccgtggcgacatccgtttgcttgctgacgacatcaaaacactgcgtcccactgtgttgccggtggttccccgtgtgctcaatcgaatctatgacaaagtgttgggcgaggcaaacaaatccgtcttcacgcgtctgctctttgacgccgctgttggactgaaaacgcgcgagctgaacaagtaaattgttttttgttttaatttcttgacgacaaactcactaaatttttcaaaatttgaccaaaaaatgaaacaaaattgttatttttagtccgaaacttgtataaaagaaaactagcctccatatctataatttttaaaaaatcaaacatttttttttggtggccgaagagcaaaaagtcttcgtattccccgttttttccctggtttcgctccaggctggatttcgcccataaataaataactttcaacattattaggtcattttaaaacaaattctaatcaacttcttaaaaagattgatacgaatttaaaaatatttccatttactgtccaaattttcgtatatttgtccccttttcacagttggattgttcgcaacaattcgcttcttgaccaaattgtgttcaaaaaggtgcgcgaagggttgggcggtcgtgtcaaactgatgatcaccggttccgctccgctgtccgaaactgtgctcacattcatgcgctgtgcaaccggtgcccttgtgtgtgaaggctacggtcagacggagtgtgttgcggcagcaacggtaattttttaaaattaattttccagaaatttattccaaaaaaaaaatttcaaaaaattatgagcaaatggtggtctggtggtgtcgttagttgcagccgagaaattttttttttttttggaaatctaaatacaattttctgttctttccattctatgcattccctattttcattgcacagattaccatcgaaggtgacccagttccgggccatgttggtgtgccggttccgtgctgtgccgtcaagttgattgatgtgcccgagctcaactattttgccacgcatggtgcgggcgaagtgtgcatcaaggggcccaacgtgtttcgcggctactacaaaatggctgaacaaacggcggaaacgctggacacagacgggtggctgcacacgggtgacattggacgatggacagagcaggggacgctgaaaattgtggaccgcaagaagcacatcttcaagttggcccaggtgagagccccaacactgggagaggccatgaaattaaaaaaaaatttaatgaaaaaacgggtgtattttttgaactaacaaattgttaaaaacacataatacagaggggttgggtcgacctctccccatcacatgtcgatttacatactcgacaccctttcgaatttagcagagaattttgattgcctccccctccccccccccctaacggttttcatgtatcaacgtgaatatctttttaaaataggagtttttttaaaagaaattttatagatttattactagaaaaacctctaattgtaagaattttgaaaaaataaaaaaaattcaaatgtaataagaaaaaaacatgatttagggcgaatacgttgcacctgagaagattgaactcatctacatgcgttcaaaatacgtggcccaatgctttgtgcatggcgaaagtctgaagacatgtctggtggctgttgttgtgcccgactttgatgtgttgccggaggcggcaaaaaaacaattgggcattgagggaaaaacaatggaggaattgtgccgaaatcagcaagtgaaagcgatggtcatggaggacattcacgaagttggaaagaaggctgggctcttcacctttgaacag

SEQ ID NO: 63070 - DNA, 976 bp, Heterodera glycines
  Genomic contig location: Contig_ID=SeqID_6840; Location=46..1021; Strand=-
  SCN-specific regions: Sequence locations=1-217,256-287,310-577,651 -714,744-976
atggacgcatctgtgtcctttgatatccagaacaactttgtattggtggtgggttataccagtttttttttaatctcgacttggaaatttccgcattttttggtttcactgtttctatcttgtttccctggggcattcatttcccgttttcgatcccttatttacggtaaaattgatttcccgcacatccctcccgctactagctatcattcgctcgaatttttaaaatacatttttaagaattttttttaaaaaccccttttggaattttagaaagacctaattgtaagtaaaaattaaaattttaatggaagtgtgacagtttataatttttaatgcttttttcccacatgtaaatattttgatttgttttctttaagttttgcgacacagtcgctaaagtgaacgggttgttggaacgaaaatcagcgtgtccgtccttgaagtacatcgttttgatggcacccgcttacgacgaactcactgagtccgcgcgtgacattgctgctcagaatggtgtcaaactgttctcatttgacaactttgagcgcatgggtcttcatgaagaggtagaaggaaaatttttttaataaaaatttcatgaaaaaaataatttttttttttttgaaaattttctgaaaaatttttttgttaattcatcatgaaattttggagaaataatttacggcaagggggaacgtagtgtaaccaaaaaattgtatttttcattttgttaatggtttgtttgaatcaaatttttgacaatgtttaagcaatttgggggctcgtggtgccaaagggggaaaaaaattttttgtttttgatttttaatgatatgaaaagagtcaaaatgttttaaaatttgctatcacacacaaattttttttttaggttgcttcgttgtcagatgtgccaccgagcccggacgacttggccaccatttgctatacgtcgggcacaacaagtgtttccaagg

SEQ ID NO: 63071 - DNA, 711 bp, Heterodera glycines
  Genomic contig location: Contig_ID=SeqID_6841; Location=733..1443; Strand=-
  SCN-specific regions: Sequence locations=1-201,223-301,323-442,483-711
aattgccgacatcagcgattggaatgaacagaacaacggcaacacttcactgctgtactcaattggcgccgccgccacaattggagcaatgggactgtggtgggtgtggtcctcacgaccgtcagcgaagaaaatggtgccgttggttgatcccgagtctcaaactcgtgaactgccggtgggttaaactggcggatgttaaaaatttatttgtgggcaaaattaattttggtattttcttgtttataggtaggtggcacgggaaaaaccaaagcgtgggtgatccttttggctcataaaaattataattggtttcattaatcagcgattctggacaaataaataggcttaaaaattagaaaccctccccctcgaaatttttaaatttttctatatttcatagatttttgtcataaaaaatatttaatgtatttttcatgacgatataatgaagagtgggtatctttttctccaggatggctcacgcgtgtgcaagtatttgaaaacggacgcgctgatgcgcttcactcacgcgaacgcaaagacaatttatgagggcgtacggcgcggggcgcatgtgtccaagaatgggccaatgctcggctttcgaaacagacaatgcgacggtgaaccgtacgaatggctgagttatggggacgcgttgcaccgttcggcgcttcttgcgcgcgccatacgttcgctcgggttgag

SEQ ID NO: 63072 - DNA, 248 bp, Heterodera glycines
  Genomic contig location: Contig_ID=SeqID_6841; Location=3321..3568; Strand=-
  SCN-specific regions: Sequence locations=1-101,125-248
ggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataacctttatattacccgttgcctaaccttaggcccatctgaataataaaaaaactcaaattcgagacttggacatttcgtgggctggacattttgtgggtcagcg

SEQ ID NO: 63073 - DNA, 740 bp, Heterodera glycines
  Genomic contig location: Contig_ID=SeqID_6841; Location=3335..4074; Strand=+
  SCN-specific regions: Sequence locations=1-110,134-382,444-479,510 -574,596-740
atgtccagcccacgaaatgtccaagtctcgaatttgagtttttttattattcagatgggcctaaggttaggcaacgggtaatataaaggttatattcgtattcagcgaccccgaaaaccctaaaaatcctaaattagactcattttgtttttataaattttgaaaaattttggacatttcgtgggtttttactcttttggacatttcgtggcttggacactttgtgggggcgccgcaatgatttactaggttaactcattagctgtaaataacaaattttgatttaaactgccaaactctataaacaattagacaataaacatcatcgtttgaatctaattaaatgaaatcgtcgtcataaacttattttccttttcaagagataaaaaatattttatagttatgtaagaatataatttaaaatattttttttttgttaattagacgtggaaatcgatattaattctaaaaattccaagaaattaaaatgaatttttaatttttaaaatgggaaaggaatagagaaagagatatattgaacctgaataaaatctaatccaaaattccaatgactcagtgttaaaaaacatgaatagaaaccggcatgaaaacaagtttttattctcagggagctgggagttttaatcgaagcaacaggaatcgcgcaaatcctttatttttatctttttcggtggccattacattaaataatgttggcgaaaggagggaggagaagaaaa

SEQ ID NO: 63074 - DNA, 326 bp, Heterodera glycines
  Genomic contig location: Contig_ID=SeqID_32823; Location=1..326; Strand=-
  SCN-specific regions: Sequence locations=1-326
catttgtcacagggtttgcctgcagttaccatcgttggtttgcctgaggcggcggtgcgtgagagcaaagaccgcgtgcgctcggcaatcatcaatgcaggttttagctttcccaatcgccgcttgaccatcaaccttgcgcctgcagatctgcccaaagatggcgcacggctggatttaccgattgcgattgggattttggcagccagtggacagctcgacgacagccagctggcaggttatgaattgatcggcgaattggcactcaacggcgaattgcgtcccgtgacaggcgcactggcggtagcacgtgccatcaaaagcga

SEQ ID NO: 63075 - DNA, 458 bp, Heterodera glycines
  Genomic contig location: Contig_ID=SeqID_32826; Location=1..458; Strand=+
  SCN-specific regions: Sequence locations=1-97,119-302,324-458
  Gene Ontology: Biological process=signal transduction
agtttcttcagttctctttccgctggatgaacaaccttttaatgcgtgagattcctctgagggcgaccatccgtctttgggacacttatttggtcggtgcaggacaaattagataaaactcggccgggcccctcccccttctcgtattctttagttaatgatttcatttgtctggaacagagtgaacatgacgggttttcccaatttcacacgtacatttgtggtgctttcctgcgattgtggtcgaaacaactgttaaatgaaaaggactttcaggtgtatcagctcttaaataaataattggaatttaactttagggcataatgttacttcttcaaaatctcccaacaaaaggatggaatgaccagcaaatctgtgaactgaccgcggatgcctactcactcatgcagtttttccatcacgcgaagagccatttacaaacataatgcctgattatg

SEQ ID NO: 63076 - DNA, 795 bp, Heterodera glycines
  Genomic contig location: Contig_ID=SeqID_32830; Location=266..1060; Strand=-
  SCN-specific regions: Sequence locations=1-213,378-534,568-673,695-795
  Gene Ontology: Cellular component=synaptic vesicle; Biological process=synaptic vesicle priming
tgatttgtgccaaagggctgagcgccaaagacaaaacgggcactggtgtgccgtacgtgacggcacaggtgggcaaagcgctcaagcggacgcgcaccattcaccagcagcagcaggagttgaaccacctgccggtgtggaacgagcagttcacattgtgagtggagcattaatattcaaaattgtcttaaattttgtccaaatttttgcgcctttttaaaaattatttttattattttatttgttttaagaatttcgtcgttaaaaatgaatgagttaaatattaaattattatttaaaaaataaattatttgttttaagaatttcgttaaaaatgaaataattaaatattattattattttaaaaataaaaatttgtatttcatggaaaatttttcaataaaaaaatcgtaaatacaaaaacttatttaaaaatttgtcaacaaaaataggtatgtacaaaaagtggtcaaaatatgtcataaatatgtaagaaaaatagccaaatatgtacgaaatatgtgcaaaaacccaaaatatgtaaataaaataataaataaataaataccattttccgcatttatgccactctgatcaaaaattactgcagcgaatgtgacaacatcactgatcggatcaaagtgcgcgtgtgggacgaggacaacgatctgttgctgaagagcagcagcaaactgaggcgaaagctgagccgtgaatcgtcggacgactttcttggccagacaatcatcgaaatgcgcactctgtgcggcgagacggacgtgtggtacaatttgg

SEQ ID NO: 63077 - DNA, 729 bp, Heterodera glycines
  Genomic contig location: Contig_ID=SeqID_6842; Location=263..991; Strand=-
  SCN-specific regions: Sequence locations=1-729
atgacattccaatctctgggactcaacccaccagcatttcaatctctgagactcaattctcaggctttccaatcgctgggactcaacccaccagcatttcaatctctgggactcaaatctccggcattccagacactgggactcaacccaccaactttcaatggcattccaatctctgggactcaacccaccagcatttcaatctctgggactcaacccaccagcatttcaatctctgggactcaacccaccagcatttcaatctctgggactcaaatctccggcattccagacactgggactcaacccaccagcattttaatttcattccaatctctgggactcaatccaccagcatttcaatctctgagactcaattctcaggctttccaatcgctgggactcaacccaccaacatttcaatctctgggactcaaatctccggcattccaaacactgggactcaacccaccaactttcaatggccttccaatctctgggactcaacccaccagctttcatggccttccaatctctgggactcaacccaccagcatttcaatctctgggactcaacccaccagcatttcaatcactgtgactcaaatctccggcattccagacattccactcaatgaaaatcaggccaccagcattccaatactgggactcaattctccggcattccaatctctgggactaaaatctccggcattccaaacaatgtga

SEQ ID NO: 63078 - DNA, 1567 bp, Heterodera glycines
  Genomic contig location: Contig_ID=SeqID_6842; Location=1953..3519; Strand=-
  SCN-specific regions: Sequence locations=1-90,115-275,322-343,366 -473,498-690,714-907,1027-1567
atgagtgaacaacaacacgctggctcttcaaacacggcaaagtgtggccgtaaacgcgacttagccgcggtgcggcatgctttcgaaatgaataaaataaaagttgaaaaaagaaagctgagaatgcgacgcatggaagaagtggtccagcgagaacgagcattgataaagattcgccatgaataccgcaaagccaagtccgctgttttaagcggacagttccgattctcatgtagcgcttcttcaatggttatcacaataccacaaatggtaagttttatttttaatagaattattttcaaattttaataaatttatatagagattttcagtatcatattgcaaatttaaaaattttttttattctgtctattaatttgggcgtttattaaaacccgaaaactcttgtcttccattttgtacgcatttttaggattaatgtttaatattcaaactaaaatttttctttaattaaaagaatttttaggccaaagtggatggtcaggcggcagaatcgttcaccatcgttatcgcttatggaccagcagagcaaggaggaccaaatgttgcctcatctcatgctcagccggccgctcaaaaaaccgttacacaagattctcggccaactgacccgagaattgcgcgcggagtctgtaagtctactgttcatgttgaaaatgtgtttttctttgataataataataatgttattatagcttgtgcaaactctgctgctggttgtggtcccgttactggaaatggccgtgatggtgaagcaacccatcatatttctgtatgtaatttaacgtatcggattttcatgaaaatggatctgaaaaaaatagtcattgtaaaatacctgcatttttttgacaaattatttttaatggaataacaaacgtacaacaaatttaaataataattattttcataattataaaacatttttctaaaactattttctctaattttattaatttcagtttttttctgtatgaaaaaatgttttaaataaaaataattatagatagtgaaaatgttgaaaatgtccaaataattttaggaccatatcaaattctgaaaatagatagttaactaacgaaatttatttaatgtctttaattatcacaagcaaattatcacacgatcattgaccgcggttactggcaacgcaaagactgttgtgggtcagaattgcggtgtggtgtgtggtagcgtgggtgttcgtggtgcagttactggtaatacatgcgtcgtcagctcgattcccgatgggaggggctcttacgtttctcttcccggtgcagcttctgctacaagttctggtcgcacaagtgacttttgcgcaactccgctttcggctgcgtcttcggttctcaaattatcacagctaccggcaccgcccaaggctccagtgcttcgcagtggcggcccgacgcgaccatcaaaaaaacaaaaaatttactcgtctgatgacagttcgtcatctgacaatggagaccgttctgcttcaaaatgcccacttcgaattttggtgtcagatgatgacgagaaagttgaacaataa

SEQ ID NO: 63079 - DNA, 701 bp, Heterodera glycines
  Genomic contig location: Contig_ID=SeqID_6844; Location=1669..2369; Strand=+
  SCN-specific regions: Sequence locations=1-74,97-701
atgagcggattaaaaagattccaaattgtcccatcctctcaaaaaagagtgaccgaagattttccaacgaatccaaaagatcttcgtgccattattcaatttaactcccctggcctattctatgtccgtgccagaattgccgatcttcagttttccctatacaaggtttcgggtcgtctattctagccaacattataaagtagcacggatttaggcctgtccgttgaagaattttggcacattttgtaagaaaaagcttgacgaggagctgtattgtgccagttgtgcccaccatgctaacaaggcaatccgcagtatttacttgagattggagctccgcgactgtgaagatccggagatttgccagactgttactgtcttttccaccgtagcggaacattacctgggcctcaaggttgaacgatttgccaaaatggtagaagagcagcctgaacagctcgaagcgttgcttaaatctaagattgagcgtactgtcaccgccaaacttagtataaaggttcacaaatttactacgtatataaatattatctttttgaattttaaggcaaagggtgagctcaagacgatggactggattgttctgtccatacagcatgagaacggggaaaacgatggagatgatgagacggctcctgatgaacaaaagaaaactgacaatgataacgaagatggagaaataa

SEQ ID NO: 63080 - DNA, 638 bp, Heterodera glycines
  Genomic contig location: Contig_ID=SeqID_32832; Location=114..751; Strand=-
  SCN-specific regions: Sequence locations=1-33,57-433,455-563,586-638
  Gene Ontology: Mol. function=protein kinase activity; Cellular component=bud neck; Biological process=glia cell migration
atgtcgataaacacgcatctgggaaaggaacagagtcgtcgagatgacttggaagcgctcggacacatgtttatgtactttctacgtggctccttgccttggcagggcttgaaagcggacacactcaaagaaaggtatcagaaaatcggtgacacgaagcgcgcaactccgatcgaagtgctttgcgagggattccccggttcgtgtgcacattctaaaccgataaatttgtttctgcagatgaatttgctcaatatttgcgttatgctcgacgactcgatttttttgaaacccctgactatgaatattgttatggtcttttcaaaactgtgcttgaaaggactggtcacacttatgattatgagtttgactggacccataagctcaatcaggcggttcgtttccgttgtcctcctttattctcgtggttatctcagacaaccccaagtggttccattcacaccgccgttggcgtggaaggaggcgaactgcgaaagacgaggaccgattacgcaaaacgtgcatcagtcccgaaaccgcgtaactcggacgggctgttgaggagtggacagcaagtaaacagcacgacaaccggaggtgccatcggacaccacgggcctggcttcggttccacgcag

SEQ ID NO: 63081 - DNA, 446 bp, Heterodera glycines
  Genomic contig location: Contig_ID=SeqID_32833; Location=295..740; Strand=+
  SCN-specific regions: Sequence locations=1-136,160-446
gtgatgtgcgaacagtcgctctgtttgtctctgtccaacgaaaacgcgtgcgaaacgctcattttggccgacctgcactcggcggaacacctgaaaacgcaggctgttgagttcatcaacttgcacgccaacgaggttttggggaattggggcaaaattcggcgcatttatcgtcgtgggaacatttatagagaataatgacattacggcgatgaaaataggtgccgttgggaagaaattttgaatttattggaacatttcctcgcttttcgtcataattcaattcccccctctcccaggtgatggagtcggacgggtggaagattctggtcaaggagcacccgccgttgctcgagcaggtgttcaaggcgttggccacccagcagacgccgcccatcattctgaaccaaccgccccggaaaaggccgcgacaattctgagacgtt

SEQ ID NO: 63082 - DNA, 957 bp, Heterodera glycines
  misc_feature (29)..(29): n is a, c, g, or t
  misc_feature (97)..(97): n is a, c, g, or t
  misc_feature (110)..(110): n is a, c, g, or t
  Genomic contig location: Contig_ID=SeqID_32834; Location=1..957; Strand=-
  SCN-specific regions: Sequence locations=1-957
  Gene Ontology: Mol. function=ATP binding; Biological process=protein amino acid phosphorylation
aaaaggtgccaaaggcaatcgaatgccancaatgcgctccctctcccattttaagctgaagcccggctcccaccgctttgtgtcgcggattttctgncagaggcaatgcncagcaaattcttttatatcagcaaaaggtcgcttttaggctcaactgatgaaacgtctgcgacacccaaaactgcttcagctttacgcggtgtgcactcgggaagagccatttttaatagcgacggaattaatgcagggtaagcaattaggggggagggggggggggatagacccgggctatagaccgctccaattcccaatggtatccaaatccaaagccacaaacatcgtaaacatagctatctttcgcattcagagaatctgctgcactttctgcaaggccatggccgagtgtgtaacgtcgcgcaggttgaagaagcgacgggcgcccttttcacttttctttttcagttggtcgacgtcgccgtgcaaattgcctctggcatgcgttatttggaggtgccaaagcgaaagtgtttaaatttccaattgttcgcaggagaaaaatttcattcaccgtgatctcgctgtgcgaaacattctcatctctcacccttcgatggtcaaaattgcggacttcggacttgctcggcttatccgcgagaacgaatacgaagcgcgagttgggcgcccgttttccgattaaagtcggcgccctttccctcactttttactttaaccattcagtggacgacacctgaggcggctaattacaacaaattcactgtcagatctgacgtttagtcctttggcattctgctcaccgaattggtcacttttggcaggataccgtacccgggtgggcaattttcgcctccaattatgataccgtagttttcctaacacaaaccaggcatgacaaacgcagaagtattgcacaaagtgagaatggatccgaatccatcc

SEQ ID NO: 63083 - DNA, 577 bp, Heterodera glycines
  Genomic contig location: Contig_ID=SeqID_32835; Location=251..827; Strand=+
  SCN-specific regions: Sequence locations=1-151,201-302,344-379,401 -408,445-498,540-577
atgcattcgaacaatgtgaaatatgaggaaattaagcaattgatgacatttccattaacagtggccgaacatttcatgaagcggcttagcaaatttgtacaaaggtattttacttatattagccattggcttaactttcccaaaagtcgggaatttaattatgataatttttattcaaaattatataaaataataatttagatttgactcttataaaatttagagtccaccaagtgttagtgtgagttgcaattattttctaagaaattttcatatttggatgccctagattttggagcaaagcattaattaaaaaaggaccaaattttaaatatttttcccagcgacgtctgtcgtaaatgtcagattcttccgatgaattttttattatttaagtctaaggccaagaaattttttaaatttatatcataattttgaaatattcaagaaaattgtaggcggatactaatagactaccaacactagattttttgggtgaaattaattttaaatttaaaatcattttaataatttaaattcgagtaattggccaatcacattcagccggtacaggtaa

SEQ ID NO: 63084 - DNA, 175 bp, Heterodera glycines
  Genomic contig location: Contig_ID=SeqID_32839; Location=1..175; Strand=+
  SCN-specific regions: Sequence locations=1-175
tgcgacggttttgtcgagtttcactttgtgaaggcgcgccattgcgacgattcgctggcattcgcctgtcgcgtgcgttcgctgtttctgcagtcgcttgagcataaattgcgcagtgacgactacggcgactgtcgcgagttggagcggctgatcatcaaattcgcacgcctcc

SEQ ID NO: 63085 - DNA, 498 bp, Heterodera glycines
  Genomic contig location: Contig_ID=SeqID_32839; Location=379..876; Strand=+
  SCN-specific regions: Sequence locations=1-5,50-60,82-317,351-439,461- 498
atggtgagagagcgagggacagagagagagaggagagatagagagagagtaacaaaaatatttctcacccttttaacacagtatccgaagacgaatagacccacccaggagcatggagtacggtgtgttcaccgccgatggaatgccgcacccgctctccgcctccgttgtgccgaccgccgatggccatggcattttggacgctgtggcggaagacgaagaagtaaacaattggaattgcttggacgcaacggagggagaatgctaattataatccaatttaaaaaggacgcggaattggacgaacaattggacaggcgaaaggcggaggaggaggagcagcagcgggcgaagggacgcgagtatttttgcgacatttgcggacggacactttggtttgcggacaatgtgcaggcgatcaaacacaaaaagggacaccagcaaaaggaggaggagaagccgaagcaggacgaagacggagaaagaacagatggatga

SEQ ID NO: 63086 - DNA, 813 bp, Heterodera glycines
  misc_feature (88)..(88): n is a, c, g, or t
  Genomic contig location: Contig_ID=SeqID_32840; Location=1..813; Strand=+
  SCN-specific regions: Sequence locations=1-209,231-813
aattggttgtgcggcgcaaatgtcgtcgcacagttttcaatgtcagccaattcagccgccgctgcattcgcaccgaaaatggcgcacncatctgatgtcacgccacaaatatctgatcgtcattggcactgtcctcttcgtggacatccttttcctcttcccttattccggcatccaaatggtcgctttgcttcacctcaacaatttgcttgccacttcccaaatgacaacactaattcggtggtgtcttcaggtaatgggccttcctttgctcctattagtactaattacttgcccgattagattctgatcggagttcactccgtttgtcagcctctttgttatttccgaatgacagtgagtaaagaaattgcacatgccaattgccttgtctgtaggaatttcgccgtcttgcctgttgtctgggccaaaagcgtcgttttgggggcagcggaagcagcgcgggcggatccgtttttggtggggcgacggccggcacaatcagtcgaacgacaaaagggaacagaaacgtcggcatcgacgagccccagccgaccacgaagagaagcatcgtattgaggacagtgttctcccagggaatggcccggacagaagaaatagcgacgatgggagaacgaacagagcgaagggaagagagcgccgattgggtaagagagagagagagagaaatgccaaaccaaacgatggcaaaggcaaagaagagcttcagacaatcccaaccgtggatgggccgcaaatgttgctgatcacccaaagacggagatggacgcgcaatctgagcttattgtgcaa

SEQ ID NO: 63087 - DNA, 612 bp, Heterodera glycines
  Genomic contig location: Contig_ID=SeqID_6845; Location=151..762; Strand=+
  SCN-specific regions: Sequence locations=1-109,139-140,162-612
gtcaaattggactacaaatttgaaaaaatactcaaggaacctaattatgatctgaagttgctgaatgaacacgaatttgaacaacttggaaaaattgggcaaaaccttgtaaaaaaatttaaagaaattaaattttttggaagccaaaatcaaacaaaacatttgacagcggaaaagggtaacaaaaaagaacttaccgtagctttactcacaacaggagaagagaaaagtgtgattaacactaatgaagaagcaattagcacacttaatgaagaatttgatgcaatgatgaaagaaaaggccgaaaaagttgactcggatgaagaatatggcaaaatgaacaaagaagcattgaaatggctggtacagtgattgctgattgcttttattcctatttttcactaaaatttctgtatttgaattcattttggcggggggagggagttaaggcatctcatccaaagcagggctgcacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaa

SEQ ID NO: 63088 - DNA, 94 bp, Heterodera glycines
  Genomic contig location: Contig_ID=SeqID_6845; Location=842..935; Strand=-
  SCN-specific regions: Sequence locations=1-59,91-94
agaaaatcttgcaaaacttttgtttcttcatcacaatttgcttttaactggtttctcaattgaatgattttgcttttataaatttgctttttaa

SEQ ID NO: 63089 - DNA, 831 bp, Heterodera glycines
  misc_feature (793)..(793): n is a, c, g, or t
  misc_feature (821)..(821): n is a, c, g, or t
  Genomic contig location: Contig_ID=SeqID_32842; Location=45..875; Strand=+
  SCN-specific regions: Sequence locations=1-802,827-831
atggacaactcagaaaatcatgacaattcgtttgaccaatcaaattgtcctagccagaaaaatcaaactaattattccgctgatacgtcaacagatttattaatgttaccaaatacagtaaatcattatattcattcaaatccaatgatgactttaagccaacaaaattactataatcaggaaaacccatcgacgtcaaccaatcaatcaacttatcctgatcacgcaaacacaatggctttgaacaatcaatcgatttatgctgatcaggcaaacacatatgcattgaacaatcactcaactttttctgatcaaacaaactcactggcattgaacaatcaatcaaattatcctgatcaggcaaactcattggcattgaacaatcaatcaaattatcctgatcaggcaaactcattgacattgaacaatcaatcaaattatcctgatcaggcaaactcattggcattgaacaatcaatcaaattatcctgatcaggcaaacccattggcattgggtaatcaatctacttatcctgatcgctcactatttatggcgaaccaaaacaatgaagttaacggtcttattccaacaattgattctgatcaagctgatcaaactattttgcaatcaaataaaggctccacgggacaacaactgcagcaaaatgtgcaagttcagcagggaaatcttccgacaatgctaagcatgacaacgccagtgcctgaacaaccattcgatgggacgcattcaatggtttctcaatatcgaatatttttgtacccattctttttgngggtttttgttttttatttaattattanaaaaacataa

SEQ ID NO: 63090 - DNA, 501 bp, Heterodera glycines
  Genomic contig location: Contig_ID=SeqID_32843; Location=11..511; Strand=+
  SCN-specific regions: Sequence locations=1-501
atgggttctttgaagaaatattcgatggttctcaaccacgccggccttcgccgtgaattggaacagaaaaaaacgcaccctcgggcgcagtcgcgtggcgccgccaacccgaaacagcaacaacaggaggagggacgaatccgagtgcaactcaaaggggacgacggagaaaatcggtcgggggacggggaaggaatccgacgacaaaaatatttttgaaaatcggaggaaatagaaaaatttacgaatggcaaacaaaaagaaaatcgtttttgtaactttgaccccattattcagtgggcgaaggggcggcacagccaaagttcatgacccgacaacaaatgatggaatacgctgcggaaatggtgcccaaactgaagacacggcagcagcaaacccaagtcgaacagaacgacgcgacggggaagcagaagaagcggaagtgaacgaacggacggacattcaaccaatgacatcaaatgtacaattaatacaattgtt

SEQ ID NO: 63091 - DNA, 240 bp, Heterodera glycines
  Genomic contig location: Contig_ID=SeqID_32844; Location=1..240; Strand=+
  SCN-specific regions: Sequence locations=1-240
tatgtgtataaaatttatcaaaaaaagagatagccatttttcttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 63092 - DNA, 304 bp, Heterodera glycines; identical to SEQ ID NO: 56071
  Genomic contig location: Contig_ID=SeqID_32844; Location=317..620; Strand=+
  SCN-specific regions: Sequence locations=1-304

SEQ ID NO: 63093 - DNA, 391 bp, Heterodera glycines
  Genomic contig location: Contig_ID=SeqID_32850; Location=408..798; Strand=-
  SCN-specific regions: Sequence locations=1-391
  Gene Ontology: Mol. function=copper, zinc superoxide dismutase activity; Cellular component=cytoplasm; Biological process =neurogenesis
ctgcaaagcggcgggtgcgcatttcaatccgcacggaaaacgccacgggagcaaagaatcggaggaaagacacgtgggcgacctgggcaatgtgaaagccgctgtgagaaagagccattcattgggaaaggggatgaaatgccaataaatataatgttcaggagaatggggtggccgtggtggacattaaagactatttggtggcactgaacggcgtcaacagtgtggtcgggagggcattggtcgtacatgagaaggcggacgacatgggcaaggggggcaatgaggagagtgggaagacgggcaatgcgggaaaacggatcgcatgcggagtggtgggagtgatcagagaggaaccaatgaaagtgaccactgatcagaccaacggaat

SEQ ID NO: 63094 - DNA, 646 bp, Heterodera glycines
  Genomic contig location: Contig_ID=SeqID_32851; Location=177..822; Strand=-
  SCN-specific regions: Sequence locations=1-301,323-324,346-494,516-646
atgcgccgttttggagctgctggtccaagaaatcggtttgaagctgatgctgttctgctgatgattggtgcgattcagctaaaacaaaagaaattgtggatttatattcataaaagcataattaatggaataaaaaatttcgcttatttagaaaactaatgaaatacgaaagttatgactagagttcgacattttgaaaaagactgtgacatggattccatgctggacctggataaaaatccaggtccaggaaaaatccaggttcctcgagacctggattttttgaaactcattctggacctggttccaggaaaaatccaggcctggatccagcaggtccaggtcgagctctagttattacatctgttttaaaaatgcgcatttaagaccactaaaaaccctaactcggtctcgaatagcacatcggcatttcacacttcacaaaaagctaaaaagtgtgctgtgcaacaaaaaattctttcaactctctcatgaaaaacaacaaatattttaaaattaattgcttaaaattgaagaaaattcaaaggatcgtaattttatttcatttcatttttgtttttttttgcttcaaggagttttgatcaaattatttttgaatttgatttgatttaactcagaaaataaa

SEQ ID NO: 63095 - DNA, 950 bp, Heterodera glycines
  Genomic contig location: Contig_ID=SeqID_6848; Location=105..1054; Strand=-
  SCN-specific regions: Sequence locations=1-127,150-242,270-315,340 -451,476-576,598-950
  Gene Ontology: Mol. function=UDP-glucose:glycoprotein glucosyltransferase activity; Cellular component=rough endoplasmic reticulum; Biological process=protein modification
atggacggctttcggttctggcggagcggctactgggcccagcatttggcgggccgcaaataccacatcagtgctctttacgtggtggatttggtcaaatttcggtgtgttgattttcaaaaatgttttttaatcatcaaattattaaatgctttgtaaatattttcagccaaattgccgccggcgatcgtctccgtggccaataccaagggctcagctccgacccgaactcgttgtcaaacctggaccaggatttgcccaacaacatggtgagttggcaagcaatttgttgacaaactttacaccaaaattcgtcaattctatgcatttttgagtttagtgtgtctgacggcgacatcagtcaccgccatcgttctcttccccgaaatttaaaaaaaaaatcacaaaccaaaatttttcaaaagaaattagagaattttttataagaaaattacaagtaagaacatttagaaaaaatcttaaagcgatttttcaaaattttatattgtattactaattttttcaaagattcgaaaaaacccctagaaaaatttttcaactaaatctttttcttgcaattttcttgtaaaaatattttctagaaaatttttttaatttctaagtttgaatttttttttcatttccgtgagtgggaaagttatgctctccaacttcggcctttctgatcccaagaattagattttttaagcgtttattttctgcgaaaaaaaaatcaaattctcatattttttacagaaaattcattccatttttatccccattcctcaatgtttcagattcaccaagtgcgcatccactcgctgccccaggaatggctgtggtgcgagacgtggtgtgacgacgtgtccaaggacagtgcgaagaccattgatcttgtaaacactattatttcgaaaatcacacaaattctcgaatattccattatttaa
